United States Patent 10,975,383 (ISOLATED POLYNUCLEOTIDES, POLYPEPTIDES AND METHODS OF USING SAME FOR INCREASING ABIOTIC STRESS TOLERANCE, BIOMASS AND YIELD OF PLANTS) - sequence listing, part 5

SEQ ID NO: 6815 - protein, 108 aa, Fragaria vesca
MASFRAFLNSPVGPKTTHFWGPVANWGFVAAGLADMSKPPEKISGNMTAAMCVYSALFMRFAWMVQPRNYLLLACHVSNETVQLYQLSRWAKGQGYLSQKKKDETATQ

SEQ ID NO: 6816 - protein, 108 aa, Camellia sinensis
MASFRAFLNSPVGPKTTHFWGPVANWGFVIAGLVDMKKPPEMISGNMTGAMCVYSLLFMRFAWMVQPRNYLLLACHASNETVQLYQLSRWAKGNGYLGGQKKDEPAPQ

SEQ ID NO: 6817 - protein, 107 aa, Artemisia annua
  Sequence also found in Organisms: Chrysanthemum coronarium
MASFRAFLNSPVGPKTTHFWGPVANWGFVVAGLVDMQKPPEMISGNMTAAMCVYSALFMRFAWMVQPRNYLLLACHASNESVQMYQFSRWAKSQGYLQQKEDKAPSA

SEQ ID NO: 6818 - protein, 107 aa, Setaria italica
MATVLKSFLNSPVGPKTTHFWGPVANWGFVIAGLVDMNKPPEMISGNMTAAMCVYSGLFMRFAWMVQPRNYLLLACHASNESVQLYQLSRWARAQGYLEKKEPEAQQ

SEQ ID NO: 6819 - protein, 107 aa, Antirrhinum majus
MASFKTFLNSPVGPKTTHFWGPVANWGFVIAGLVDMQKPPEMISGNMTAAMCVYSALFMRFAWMVQPRNYLLLACHASNESVQLYQFSRWAKGQGYLGEKKGEASTQ

SEQ ID NO: 6820 - protein, 107 aa, Catharanthus roseus
MASFRAFLNSPVGPKTTHFWGPVANWGFVVAGLVDTQKPPEMISGNMTAAMCVYSGLFMRFAWMVQPRNYLLLACHASNETVQLYQLSRWAKGQGYLHQKEEKAASN

SEQ ID NO: 6821 - protein, 106 aa, Centaurea maculosa
MASFRAFMNSPVGPKTSHFWGPVANWGFVVAGLVDMQKPPEMISGNMTGAMCVYSALFMRFAWMVQPRNYLLLACHASNETVQLYQFSRWAKSQGYLQKGDKAPST

SEQ ID NO: 6822 - protein, 107 aa, Cephalotaxus harringtonia
MAATFRAFLNSPVGPKTTHFWGPVANWGFVVAGLVDMQKPPDMISGNMTAVMCVYSGLFMRFAWMVQPRNYLLLACHASNETVQLYQLSRWASANGYLSKKEKPEKQ

SEQ ID NO: 6823 - protein, 107 aa, Castanea mollissima
MASFRAFLNSPVGPKTTHFWGPVANWGFVAAGLADINKPPELISGNMTGAMCIYSALFMRFAWMVQPRNYLLLACHVSNETVQLYQLSRWAKGQGYLSQKKEESTSQ

SEQ ID NO: 6824 - protein, 107 aa, Echinacea purpurea
MASFRAFLNSPVGPKTTHFWGPVANWGFVVAGLVDMQKPPEMISGNMTAAMCVYSGLFMRFAWMVQPRNYLLLACHASNETVQMYQLSRWAKHQGYLQLKDEKSTST

SEQ ID NO: 6825 - protein, 106 aa, Flaveria ramosissima
MASFRAFLNSPVGPKTTHFWGPVANWGFVVAGLVDMQKPPEMISGNMTAAMCVYSGLFMRFAWMVQPRNYLLLACHASNETVQMYQLSRWAKHQGYLQKEDKSASS

SEQ ID NO: 6826 - protein, 106 aa, Flaveria ramosissima
MASFRAFLNSPVGPKTTHFWGPVANWGFVVAGLVDMQKPPEMISGNMTAAMCVYSGLFMRFAWMVQPRNYLLLACHASNETVQMYQLSRWAKHQGYLQKEDKSAST

SEQ ID NO: 6827 - protein, 107 aa, Setaria italica
MSTALKAFLNSPVGPKTTHFWGPVANWGFVLAGLVDMNKPPEMVSGNMTAAMCVYSGLFMRFAWMVQPRNYLLLACHASNESVQLYQLSRWARAQGYLEKKEPEPQQ

SEQ ID NO: 6828 - protein, 108 aa, Lotus japonicus
MASSFRAFLNSPIGPKTTHFWGPVANWGFVVAGLADLNKPPEMLSGNMTSAMCVYSALFMRFAWMVQPRNYLLLACHASNETVQLYHFTRWAKSQGYLSGKKEEASPQ

SEQ ID NO: 6829 - protein, 107 aa, Mimulus guttatus
MASFKTFLNSPVGPKTTHFWGPIANWGFVIAGLVDMQKPPEMISGNMTAAMCVYSGLFMRFAWMVQPRNYLLLACHASNESVQLFQLSRWAKAQGYLGEKKDEALSQ

SEQ ID NO: 6830 - protein, 107 aa, Olea europaea
MASFKAFLNSPVGPKTTHFWGPVANWGFVIAGLVDMQKPPEMISGNMTAAMCIYSGLFMRFAWMVQPRNYLLLACHASNESVQLYQLSRWAKGQGYLGGEKDKASSQ

SEQ ID NO: 6831 - protein, 108 aa, Orobanche aegyptiaca
MASSFKSFLNSPIGPKTTHFWGPVANWGFVIAGLVDMKKPPEMISGNMTSAMCVYSGLFMRFAWMVQPRNYLLLACHASNETVQLYQLSRWAKGQGYLGDKNDQTSSQ

SEQ ID NO: 6832 - protein, 107 aa, Cajanus cajan
MASFRAFLNSPVGPKTTHFWGPVANWGFVAAGLADMNKPPEMISGNMTGAMCIYSALFMRFAWMVQPRNYLLLACHASNETVQLYQFSRWARAEGLFSAKKEEASSE

SEQ ID NO: 6833 - protein, 107 aa, Prunus persica
  Sequence also found in Organisms: Prunus mume
MASFRAFLNSPVGPKTTHFWGPIANWGFVAAGLADMNKPPEMISGNMTAAMCVYSALFMRFAWMVQPRNYLLLACHVSNETVQLYQLSRWARGQGYFPQKKDEPASE

SEQ ID NO: 6834 - protein, 107 aa, Oryza sativa
MSTAVKAFLNSPVGPKTTHFWGPVANWGFVLAGLVDMNKPPEMISGNMTAAMCVYSGLFMRFAWMVQPRNYLLLACHASNESVQLYQMSRWARAQGYLEKKEPEAQQ

SEQ ID NO: 6835 - protein, 107 aa, Rosa hybrid cultivar
MASFRAFWNSPVGPKTTHFWGPVANWGFVAAGLADMSKPPEKISGNMTAAMCVYSALFMRFAWMVQPRNYLLLACHVSNETVQLYQLSRWAKGQGYLPQKKDEAATQ

SEQ ID NO: 6836 - protein, 106 aa, Salvia sclarea
MASFKAFLNSPVGPKTTHFWGPIANWGFVVAGLVDMKKPPEMISGNMTAAMCVYSALFMRFAWMVQPRNYLLLACHASNETVQLYQLSRWAKGQGYLEAKKETTPE

SEQ ID NO: 6837 - protein, 107 aa, Sesamum indicum
MASFKAFLNSPVGPKTTHFWGPVANWGFVIAGVVDMKKPPEMISGNMTAAMCVYSALFMRFAWMVQPRNYLLLACHASNESVQLYQFSRWAKGQGYLGEKKPEASPQ

SEQ ID NO: 6838 - protein, 107 aa, Helianthus annuus
MAAFRAFLNSPVGPKTTHFWGPVANWGFVAAGLVDMQKPPEMISGNMTAAMCVYSGLFMRFAWMVQPRNYLLLACHASNETVQLYQLSRFAKHQGYLQPKEDKSTST

SEQ ID NO: 6839 - protein, 107 aa, Panicum virgatum
MSTALKAFLNSPVGPKTTHFWGPVANWGFVLAGLLDMNKPPEMISGNMTAAMCVYSGLFMRFAWMVQPRNYLLLACHASNESVQLYQLSRWARAQGYLEKKEPEAQQ

SEQ ID NO: 6840 - protein, 106 aa, Tabernaemontana elegans
MASFRAFLNSPIGPKTTHFWGPVANWGFVVAGLVDTQKPPEMISGNMTAAMCVYSGLFMRFAWMVQPRNYLLLACHASNEAVQLYQLSRWAKGQGYLQKEEKATSQ

SEQ ID NO: 6841 - protein, 107 aa, Tragopogon dubius
MASFRAFLNSPVGPKTTHFWGPVANWGFVAAGLVDMQKPPEMISGNMTAAMCVYSGLFMRFAWMVQPRNYLLLGCHVSNETVQLYQLSRWAKHQGYLQQKEDKAPSA

SEQ ID NO: 6842 - protein, 108 aa, Triphysaria pusilla
MAFSFKAFLNSPVGPKTTHFWGPVANWGFVIAGLVDMQKPPEMISGNMTAAMCVYSALFMRFAWMVQPRNYLLLACHASNESVQLYQFSRWAKGQGYLGDKKEESTSQ

SEQ ID NO: 6843 - protein, 110 aa, Arabidopsis thaliana
MATSRFQAFLNSPIGPKTTHFWGPIANWGFVAAGLVDMQKPPEMISGNMSSAMCVYSALFMRFAWMVQPRNYLLLACHASNETVQLYQLSRWARAQGYLSSKKEEEKPSQ

SEQ ID NO: 6844 - protein, 110 aa, Brassica juncea
MAASGFQAFLNSPVGPKTTHFWGPIANWGFVAAGLVDMQKPPEMISGNMTSAMCIYSALFMRFAWMVQPRNYLLLACHASNETVQLYQLSRWARAQGYLSSTKEEEKPSQ

SEQ ID NO: 6845 - protein, 116 aa, Chenopodium quinoa
MASTFRAFLNSPVGPKTTHFWGPVANWGFVVAGLVDMNKPPEKISGNMTSAMCVYSALFMRFAWMVQPRNYLLLACHASNETVQLYQLSRWARANGYLSSKKRKALNCDFAFSLGC

SEQ ID NO: 6846 - protein, 108 aa, Ocimum basilicum
MASFKAFLNSPVGPKTTHFWGPVANWGFVIAGLVDMQKPPELISGNMTGAMCIYSGLFMRFAWMVQPRNYLLLACHASNETVQLYQLSRWAKGQGYLGGEKKEKASSE

SEQ ID NO: 6847 - protein, 108 aa, Fraxinus spp
MASFKAFLNSPVGPKTTHFWGPVANWGFVIAGLVDMQKPPEMISGNMTGAMCIYSGLFMRFAWMVQPRNYLLLACHASNESVQLYQLSRWAKGQGYLGGEKKGEASSQ

SEQ ID NO: 6848 - protein, 108 aa, Tropaeolum majus
MASSFKTFLNSPVGPKTTHFWGPIANWGFVAAGLADMSKPPEMISGNMTAAMCVYSALFMRFAWMVQPRNYLLLACHVSNETVQLYQLSRWAKGQGYLSSEKKKEASS

SEQ ID NO: 6849 - protein, 108 aa, Primula obconica
MASFRAFLNSPVGPKTTHFWGPIANWGFVVAGLVDMKKPPEMISGNMTAAMCVYSALFMRFAWMVQPRNYLLLGCHASNETVQLYQFSRWAKAHGYLGEQKKEEAATE

SEQ ID NO: 6850 - protein, 107 aa, Amaranthus tuberculatus
MASRIQAFLNSPIGPKTTHFWGPVANWGFVIAGLVDMNKPPEMISGNMTAAMCIYSGLFMRFAWMVQPRNYLLLACHASNETVQLYQLSRWARANGYLSQKEEAASK

SEQ ID NO: 6851 - protein, 107 aa, Lactuca sativa
MAAFRAFLNSPVGPKTTHFWGPVANWGFVAAGLVDMQKPPEMISGNMTAAMCVYSALFMRFAWMVQPRNYLLLACHASNESVQLYQFSRWAKSQGYLQKKEDEASST

SEQ ID NO: 6852 - protein, 107 aa, Zea mays
MATALKSFLNSPVGPKTTHFWGPVANWGFVIAGLVDMNKPPEMISGNMTAAMCVYSGLFMRFAWMVQPRNYLLLACHASNESVQLYQLSRWARSQGYLEKKEPEAKQ

SEQ ID NO: 6853 - protein, 107 aa, Pennisetum glaucum
MATALKSFLNSPVGPKTTHFWGPVANWGFVIAGLVDMNKPPEMISGNMTAAMCVYSGLFMRFAWMVQPRNYLLLACHASNESVQLYQLSRVARAQGYLEKKEPEAQQ

SEQ ID NO: 6854 - protein, 105 aa, Solanum lycopersicum
  Sequence also found in Organisms: Solanum tuberosum, Solanum phureja
MASFKAFLNSPVGPKTTHFWGPVANWGFVIAGLVDTQKPPEMISGNMTSAMCVYSALFMRFAWMVQPRNYLLLACHASNESVQLYQLSRWAKSQGYLQQNAAKAE

SEQ ID NO: 6855 - protein, 108 aa, Pseudoroegneria spicata
  Sequence also found in Organisms: Secale cereale, Triticum aestivum
MATAFKAFVNSPVGPKTTHFWGPVANWGFVLAGLVDLNKPPEMISGNMTAAMCVYSGLFMRFAWMVQPRNYLLLACHASNETVQLYHLSRCARAQGYLDSKKEPEAQQ

SEQ ID NO: 6856 - protein, 107 aa, Sorghum bicolor
MSTALKAFINSPVGPKTTHFWGPVANWGFVIAGLVDMNKPPEMISGNMTAAMCVYSGLFMRFAWMVQPRNYLLLACHASNESVQLYQLSRWARAQGYLEKKEPEAQQ

SEQ ID NO: 6857 - protein, 107 aa, Glycine max
MASFRAFWNSPVGPKTTHFWGPIANWGFVAAGLADLNKPPEMISGNMTGAMCVYSALFMRFAWMVQPRNYLLFACHASNETVQLYHFSRWAKAQGLLSEKKEEASSQ

SEQ ID NO: 6858 - protein, 107 aa, Helianthus annuus
MAAFRAFLNSPVGPKTTHFWGPVANWGFVAAGLVDMQKPPEMISGNMTAAMCVYSGLFMRFAWMVQPRNYLLLACHASNETVQLYQLSRFAKHQGYLQPKEEKSTST

SEQ ID NO: 6859 - protein, 108 aa, Utricularia gibba
MASSFKSFLNSPVGPKTTHFWGPVANWGFVIAGLVDMKKPPEMISGNMTGAMCIYSGLFMRFAWMVQPRNYLLLACHASNETVQLYQLSRWAKGQGYLGEEKKEAKPV

SEQ ID NO: 6860 - protein, 80 aa, Echinochloa colona
MSTALKAFINSPIGPKTTHFWGPVANWGFVLAGLVDMNKPPEMISGNMTAAMCVYSGTLYEVCVDGTTTELLASGMPCFQ

SEQ ID NO: 6861 - protein, 111 aa, Brassica napus
  Sequence also found in Organisms: Brassica oleracea, Brassica rapa
MAASGFQAFLNSPVGPKTTHFWGPIANWGFVAAGLVDMQKPPEMISGNMTSAMCIYSALFMRFAWMVQPRNYLLLACHASNETVQLYQLSRWARAQGYLSSSTKEEEKPAQ

SEQ ID NO: 6862 - protein, 111 aa, Raphanus sativus
MATASRFQAFLNSPVGPKTTHFWGPIANWGFVAAGLVDMQKPPEMISGNMTSAMCIYSALFMRFAWMVQPRNYLLLACHASNETVQLYQLSRWARAQGYLSSTKQEEKPAQ

SEQ ID NO: 6863 - protein, 110 aa, Brassica napus
  Sequence also found in Organisms: Brassica juncea
MAASGFQAFLNSPVGPKTTHFWGPIANWGFVAAGLVDMQKPPEMISGNMTSAMCIYSALFMRFAWMVQPRNYLLLACHASNETVQLYQLSRWARSQGYLSSTKEEEKPAQ

SEQ ID NO: 6864 - protein, 108 aa, Cyclamen graecum
MASFRAFLDSPVGPKTTHFWGPVANWGFVIAGLVDMKKPPEMVSGNMTAAMCVYSALFMRFAWMVQPRNYLLLACHASNETVQLYQFSRWAKAHGYLGAQKKEEAATE

SEQ ID NO: 6865 - protein, 108 aa, Cicer arietinum
MASFKAFLNSPVGPKTTHFWGPVANWGFVAAGLADINKPPEMISGNMTGAMCIYSALFMRFAWMVQPRNYLLLACHASNETVQLYQHTRWAKAEGYLSGKKEKAPSSE

SEQ ID NO: 6866 - protein, 107 aa, Eschscholzia californica
MAAFKAFLNSPVGPKTTHFWGPIANWGFVVAGLVDMQKPPELISGNMTGAMCVYSALFMRFAWMVQPRNYLLLACHASNETVQLYQLQRWAKAQGYLEKKEEAKVPE

SEQ ID NO: 6867 - protein, 108 aa, Fraxinus spp
MASFKTFLNSPVGPKTTHFWGPVANWGFVIAGLVDMQKPPEMISGNMTAAMCIYSGLFMRFAWMVQPRNYLLLACHASNESVQLYQLSRWAKGQGYLGGEKKGEASSQ

SEQ ID NO: 6868 - protein, 109 aa, Tropaeolum majus
MASSFKAFLNSPIGPKTTHFWGPIANWGFVAAGLADMNKPPEMISGRMTGVMCVYSALFMRFSWMVQPRNYLLLIFHASNETVQLYQLSRWARGQGYLSSEKKDEASSI

SEQ ID NO: 6869 - protein, 108 aa, Lippia dulcis
MASFKAFLNSPVGPKTTHFWGPVANWGFVIAGLVDMKKPPELISGNMTAAMCVYSGLFMRFAWMVKPRNYLLLACHASNETVQLYQLSRWAKGQGYLGEKKEEASSSQ

SEQ ID NO: 6870 - protein, 107 aa, Echinochloa colona
MATALKSFLNSPVGPKTSHFWGPVANWGFVLAGLVDMNKPPEMISGNMTAAMCVYSGLFMRFAWMVQPRNYLLLACHASNESVQLYQFSRWARSQGYLEKKEPEAQQ

SEQ ID NO: 6871 - protein, 107 aa, Echinochloa colona
MSTALKAFINSPIGPKTTHFWGPVANWGFVLAGLVDMNKPPEMISGNMTAAMCVYSGLFMRFAWMVQPRNYLLLACHASNESVQLYQLSRVARAQGYLEKKEPEAQQ

SEQ ID NO: 6872 - protein, 108 aa, Avena sativa
MATAFKAFVNSPVGPKTTHFWGPVANWGFVLAGLVDLNKPPEMISGNMTAAMCVYSGLFMRFAWMVQPRNYLLLACHASNETVQLYHLSRCAKAQGYLDKKKEPEAQQ

SEQ ID NO: 6873 - protein, 106 aa, Ananas comosus
MSAFRAFWNSPVGPKTTHFWGPVANWGFVVAGLVDMNKPPEMISGNMTAAMCVYSGLFMRFAWMVKPRNYLLLACHASNESVQLYQLSRWARAQGFLDKKEPEVQQ

SEQ ID NO: 6874 - protein, 107 aa, Amsonia hubrichtii
MASFRAFLNSPVGPKTTHFWGPVANWGFVVAGLVDTQKPPEMISGNMTAAMCVYSGLFMRFAWMVQPRNYLLLVCHASNEVVQTYQLSRWAKSQGYLQQKEEKTTSQ

SEQ ID NO: 6875 - protein, 108 aa, Hordeum vulgare
MATAFKAFVNSPVGPKTTHFWGPVANWGFVLAGLVDLNKPPEMISGNMTAAMCVYSGLFMRFAWMVQPRNYLLLACHASNETVQLYHLSRCARAQGYLDSKKEPEAKK

SEQ ID NO: 6876 - protein, 106 aa, Cycas rumphii
MAALRAFWNSPVGPKTTHFWGPVANWGFVVAGLVDMQKPPDMISGNMTGVMCVYSALFMRFAWMVQPRNYLLLACHASNETVQLYQLSRWASAQGFLSKKEEPEKQ

SEQ ID NO: 6877 - protein, 105 aa, Solanum melongena
MATFKAFLNSPVGPKTTHFWGPVANWGFVIAGLVDTQKPPKMISGNMTSAMCVYSALFMRFAWMVKPRNYLLLACHASNETVQLYQLSRWAKGQGYLQKNADKAV

SEQ ID NO: 6878 - protein, 108 aa, Panax ginseng
MASSFRAFLNSPVGPKTTHFWGPIANWGFVISGLVDMQKPPEMISGNMTGVLCIYSALFMRFAWMVQPRNYLLLACHASNESVQLYQFSRWAKTQGYFLEKGDKAAPQ

SEQ ID NO: 6879 - protein, 108 aa, Panax ginseng
MASSFRAFLNSPVGPKTTHFWGPIANWGFVISGLVDMQKPPEMISGNMTGALCIYSALFMRFAWMVQPRNYLLLACHASNESVQLYQFSRWAKTQAYFLEKGDKAAPQ

SEQ ID NO: 6880 - protein, 105 aa, Nicotiana benthamiana
  Sequence also found in Organisms: Nicotiana tabacum
MAAFKAFLNSPVGPKTTHFWGPVANWGFVIAGLVDTQKPPEMISGNMTSAMCVYSALFMRFAWMVQPRNYLLLACHASNESVQLYQLSRWAKSQGYLQQNAAKAE

SEQ ID NO: 6881 - protein, 105 aa, Petunia hybrida
MAAFKAFLNSPVGPKTTHFWGPVANWGFVIAGLVDTQKPPEMISSNMTSAMCVYSALFMRFAWMVQPRNYLLLACHASNETVQLYQLSRWAKSQGYLQQNAAKAE

SEQ ID NO: 6882 - protein, 106 aa, Pinus taeda
MAALRTFWNSPVGPKTTHFWGPVANWGFVIAGLVDMQKPPDMISGNMTAAMCVYSGLFMRFAWMVQPRNYLLLACHASNETVQLYQLSRWASANGYLSKKEEAEKQ

SEQ ID NO: 6883 - protein, 107 aa, Oryza sativa
MATAAKAFWNSPVGPRTTHFWGPVANWGFVLAGLVDMNKPPEMISGNMTAAMCVYSGLFMRFAWMVQPRNYLLLACHASNESVQLYQFSRWARAQGYLENKEPEGQQ

SEQ ID NO: 6884 - protein, 107 aa, Glycine max
MASFRAFWNSPVGPKTTHFWGPIANWGFVAAGLADLNKPPEMISGNMTGAMCVYSALFMRFAWMVQPRNYLLFACHASNETVQLYHFTRWAKAQGLLSEKKEEASSQ

SEQ ID NO: 6885 - protein, 107 aa, Thalictrum flavum
MAAFRTFWNSPVGPKTTHFWGPVANWGFVAAGLVDMQKPPELISGNMTGAMCVYSALFMRFAWMVQPRNYLLLACHASNETVQLYQFSRWAKAQGYLEKKSEEASPQ

SEQ ID NO: 6886 - protein, 72 aa, Eschscholzia californica
MQKPPELISGNMTGAMCVYSALFMRFAWMVQPRNYLLLACHASNETVQLYQLQRWAKAQGYLEKKEEAKVPE

SEQ ID NO: 6887 - protein, 69 aa, Fagopyrum esculentum
MASTFKAFLNSPVGPKTTHFWGPVANWGFVAAGLVDMNKPPEMISGKHDYSYVRILGVVYAVCMDGTTP

SEQ ID NO: 6888 - protein, 113 aa, Cannabis sativa
MASFRAFLNSPVGPKTTHFWGPIANWGFVAAGLVDMQKPPEMISGNMTAAMCVYSALFMRFAWMVQPRNYLLLACHASNETVQLYQLSRWAKGQGYLSEKKVEKEEKEKSESQ

SEQ ID NO: 6889 - protein, 111 aa, Brassica napus
  Sequence also found in Organisms: Brassica oleracea, Raphanus sativus
MATASRFQAFLNSPVGPKTTHFWGPIANWGFVAAGLVDMQKPPEMISGNMSSAMCIYSALFMRFAWMVQPRNYLLLACHASNETVQLYQLSRWARAQGYLSSTKEEEKPSQ

SEQ ID NO: 6890 - protein, 111 aa, Brassica rapa
MATASRFQAFLNSPVGPKTTHFWGPIANWGFVAAGLVDMQKPPEMISGNMSSAMCIYSALFMRFAWMVQPRNYLLLACHASNETVQLYQLSRWARAQGYLSSTKVEEKSSQ

SEQ ID NO: 6891 - protein, 111 aa, Brassica napus
MATASRFQAFLNSPVGPKTTHFWGPIANWGFVAAGLVDMQKPPEMISGNMSSAMCIYSALFMRFAWMVQPRNYLLLACHASNETVQLYQLSRWARAQGYLSSTKEEEKSSQ

SEQ ID NO: 6892 - protein, 108 aa, Trifolium pratense
MAAFKAFWNSPVGPKTTHFWGPVANWGFVAAGLADINKPPEMISGNMTGAMCVYSALFMRFAWMVQPRNYLLLACHASNETVQLYQHTRWAKAEGYLSGKKDKEVSSQ

SEQ ID NO: 6893 - protein, 106 aa, Allium cepa
MAAFRNFLNSPVGPKTTHFWGPVANWGFVVAGLVDMQKPPEMISGNMSAAMCVYSALFMRFAWMVQPRNYLLLACHASNETVQLYQFSRWAKHQGYLGKKEAEVQQ

SEQ ID NO: 6894 - protein, 115 aa, Mesembryanthemum crystallinum
MASTFRAFMNSPVGPKTTHFWGPVANWGFVVAGLVDMNKPPEMISGNMTAAMCVYSGLFMRFAWMVQPRNYLLLACHASNETVQLYQFSRWARANGYLSEKKEETTSKKEESTSQ

SEQ ID NO: 6895 - protein, 108 aa, Medicago truncatula
MAAFKAFWNSPVGPKTTHFWGPVANWGFVAAGLADINKPPEMISGNMTGAMCIYSALFMRFAWMVQPRNYLLLACHASNETVQLYQHTRWARAEGYLSGKKEKEASSE

SEQ ID NO: 6896 - protein, 108 aa, Sarracenia psittacina
MASFRAFLNSPVGPKTTHFWGPIANWGFVLAGLVDTKKPPEMISGNMTGAMCIYSALFMRFAWMVQPRNYLLLGCHVSNETVQLYQLSRWAKGNGYLGKKKDDAAASE

SEQ ID NO: 6897 - protein, 109 aa, Sarracenia psittacina
MASSFRAFLNSPVGPKTTHFWGPIANWGFVLAGLVDTKKPPEMISGNMTGAMCIYSALFMRFAWMVQPRNYLLLGCHVSNETVQLYQLSRWAKGNGYLGKKKEDAAASE

SEQ ID NO: 6898 - protein, 108 aa, Trigonella foenum-graecum
MAAFKAFWNSPVGPKTTHFWGPVANWGFVAAGLADINKPPEMISGNMTGAMCIYSALFMRFAWMVQPRNYLLLACHASNETVQLYQHTRWAKAEGYLSGKKEKEASSQ

SEQ ID NO: 6899 - protein, 108 aa, Secale cereale
MATAFKAFVNSPVGPKTTHFWGPVANWGFVLAGLVDLNKPPEMISGNMTAAMCVYSGLFMRFAWMVQPRNTCFWHAMPPTKPFSSIIYSRCARAQGSLDSKKEPEAQQ

SEQ ID NO: 6900 - protein, 108 aa, Avena sativa
MATAFKAFVNSPVGPKTTHFWGPVANWGFVLAGLVDLKKPPEMISGNMTAAMCVYSGLFMRFAWMVQPRNYLLLACHASNETVQLYHLSRCAKAQGYLDKKKEPEAQQ

SEQ ID NO: 6901 - protein, 105 aa, Capsicum annuum
MAAFKAFLNSPVGPKTTHFWGPVANWGFVIAGLVDTQKPPEMISGNMTSAMCVYSALFMRFAWMVQPRNYLLLACHASNESVQLYQLSRWAKSQGYMQQNAAKAE

SEQ ID NO: 6902 - protein, 106 aa, Musa acuminata
MAALKAFWNSPVGPKTTHFWGPVANWGFVIAGLVDMQKPPEMISRNMTSAMCVYSALFMRFAWMVKPRNYLLLACHASNESVQLYQLSRWAKAQGYLEKKEPEGQH

SEQ ID NO: 6903 - protein, 107 aa, Bruguiera gymnorhiza
MASFKAFWNSPVGPKTTHFWGPIANWGFVVAGLVDMKKPPEMISGNMTGAMCIYSALFMRFAWMVQPRNYLLFACHASNETVQLYQFSRWARGQGYLSSGKEESPSQ

SEQ ID NO: 6904 - protein, 95 aa, Ricinus communis
MASFRAFLNSPVGPKTTHFWGPVANWGFVAAGLVDMKKPPEMISGNMTGAMCIYSALFMRFAWMVQPRNYLLLACHASNETVQLYQFSRWARAQG

SEQ ID NO: 6905 - protein, 107 aa, Cynara scolymus
MAPFRAFMNSPVGPKTAHFWGPVANWGFVVAGLVDMQKPPEMISGNMTGAMCVYSALFMRFAWMVQPRNYLLLACHASNESVQLYQFSRWAKSQGYFQQKEDKAPST

SEQ ID NO: 6906 - protein, 107 aa, Cynodon dactylon
MATALKTFWNSPVGPKTSHFWGPVANWGFVIAGLVDMNKPAEMISGNMTGAMCVYSGLFMRFAWMVQPRNYLLLACHASNESVQLYQLSRWARAQGYLEKKEPEAQQ

SEQ ID NO: 6907 - protein, 107 aa, Taraxacum officinale
MAAFRKFLDSPVGPKTTHFWGPVANWGFVAAGLVDMQKPPEMISGNMTAAMCVYSGLFMRFAWMVQPRNYLLLACHASNETVQMYQFSRWAKSQGYLQQKKEKAPST

SEQ ID NO: 6908 - protein, 105 aa, Solanum melongena
MASFKAFLNSPVGPKTTHFWGPIANWGFVIAGLVDTQKPPEMISGNMTTAMCVYSALFMRFAWMVQPRNYLLLACHASNESVQLYQLSRWAKGQGYLQQNAAKAE

SEQ ID NO: 6909 - protein, 105 aa, Nicotiana benthamiana
MAAFKAFLNSPVGPKTTHFWGPVANWGFVIAGLVDTQKPPEMISGNMTSAMCVYSGLFMRFAWMVQPRNYLLLACHASNESVQLYQLSRWAKSQGYLQQNAAKAE

SEQ ID NO: 6910 - protein, 108 aa, Avena sativa
MATAFKAFVNSPVGPKTTHFWGPVANWGFVLAGLVDLNKPPEMISGNMTAAMCVYSGLFMRFAWMVQPRNYLLLACHASNETVQLYHLFRCAKAQGYLDKKKEPEAQQ

SEQ ID NO: 6911 - protein, 108 aa, Avena sativa
MATAFKAFVNSPVGPKTTHFWGPVANWGFVLAGLVDLNKPPEMISGNMTAAMCVYSGLFMRFAWMVQPRNYLLWACHASNETVQLYHLSRCAKAQGYLDKKKEPEAQQ

SEQ ID NO: 6912 - protein, 107 aa, Panicum virgatum
MATALKSFLNSPVGPKTSHFWGPVANWGFVIAGLVDMNKPPEMISGNMTAVMCVYSGLFMRFAWMVQPRNYLLLACHASNESVQLYQLSRWARAQGFLEKKEPEAQQ

SEQ ID NO: 6913 - protein, 107 aa, Panicum virgatum
MATAIKSFLNSPVGPKTSHFWGPVANWGFVIAGLVDMNKPPEMISGNMTAVMCVYSGLFMRFAWMVQPRNYLLLACHASNESVQLYQLSRWARAQGFLEKKEPEAQQ

SEQ ID NO: 6914 - protein, 107 aa, Taxus baccata
MAATFRAFLNSPVGPKTTHFWGPIANWGFVVAGLVDMQKPPDMISGNMTAAMCVYSGLFMRFAWMVQPRNYLLLVCHASNETVQLYQLSRWASANGYLPKKEEPEKQ

SEQ ID NO: 6915 - protein, 111 aa, Eutrema halophilum
MAATSRFQAFLNSPVGPKTTHFWGPIANWGFVAAGLVDMQKPPEMISGNMSSAMCIYSALFMRFAWMVQPRNYLLLACHASNETVQLYQLSRWARAQGYLSSTKEEDKPSQ

SEQ ID NO: 6916 - protein, 106 aa, Allium cepa
MAAFRNFLNSPVGPKTTHFWGPVANWGFVVAGLVDMQKPPEMISGNMSAAMCVYSALFMRFAWMVQPRNYLLLACHASNETVQLHQFSRWAKYQGYLGKKEAEVQQ

SEQ ID NO: 6917 - protein, 106 aa, Allium cepa
MAAFRNFLNSPVGPKTTHFWGPVANWGFVVAGLVDMQKPPEMISGNMSAAMCVYSALFMRFAWMVRPRNYLLLACHASNETVQLYQFSRWAKYQGYLGKKEAEVQQ

SEQ ID NO: 6918 - protein, 109 aa, Populus trichocarpa
MAAYFRTFLNSPVGPKTTHFWGPVANWGFVAAGLVDMKNPPEKISGNMTGAMCVCSALLMRFAWMVQPRNYLLLACHASNETVQLYQLSRWAKGQGYLPSEKKEETRSP

SEQ ID NO: 6919 - protein, 106 aa, Musa acuminata
MAALKAFWNSPMGPKTTHFWGPVANWGFVIAGLVDMQKPPEMISRNMTSAMCVYSALFMRFAWMVKPRNYLLLACHASNESVQLYQLSRWAKAQGYLEKKEPEGQH

SEQ ID NO: 6920 - protein, 107 aa, Brachypodium distachyon
  Sequence also found in Organisms: Festuca arundinacea, Lolium multiflorum
MATAFKAFVNSPVGPKTTHFWGPVANWGFVLAGLVDLNKPPEMISGNMTAAMCVYSGLFMRFAWMVQPRNYLLLACHASNETVQLYHLSRCAKAQGYIGKKEPEAQQ

SEQ ID NO: 6921 - protein, 106 aa, Cocos nucifera
MAALKAFWNSPVGPKTTHFWGPVANWGFVIAGLVDMQKPPEMISGNMTAAMCVYSGLFMRFAWMVKPRNYLLLACHASNESVQLYQLSRWAKAQGYLDKKEPELNQ

SEQ ID NO: 6922 - protein, 107 aa, Avena sativa
MATAFKAFVNSPVGPKTTHFWGPVANWGFVLAGLVDLNKPPEMISGNMTAAMCVYSGLFMRFAWMVQPRNYLLLACHASNETVQLYHLSRCAKAQGYIGKKELEAQQ

SEQ ID NO: 6923 - protein, 107 aa, Allium cepa
MAALRNFLNSPVGPKTTHFWGPVANWGFVVAGLVDMRKPPEMISGNMSAAMCVYSALFMRFAWMVQPRNYLLLACHASNETVQLYQFSRWAKYQGYLGKKEAEVQQQ

SEQ ID NO: 6924 - protein, 95 aa, Cannabis sativa
MASFRAFLNSPVGPKTTHFWGPIANWGFVAAGLVDMQKPPEMISGNMTAAMCVYSALFMRFAWMVQPRNYLLLACHASNETVQLYQLSRWAKGQG

SEQ ID NO: 6925 - protein, 106 aa, Cirsium arvense
MAAFRAFMNSPVGPKTSHFWGPVANWGFVVAGLVDMQKPPEMISGNMTGAMCVYSALFMRFAWMVQPRNYLLLACHASNESVQLYQFSRWAKSQGYFQQGDKAPST

SEQ ID NO: 6926 - protein, 107 aa, Vigna unguiculata
MASFRAFWNSPMGPKTTHFWGPVANWGFVAAGLADMKKPPEMISGNMTGAMCIYSALFMRFAWMVQPRNYLLFACHASNETVQLYQFSRWARAEGNLSAEKEETSAQ

SEQ ID NO: 6927 - protein, 107 aa, Cryptomeria japonica
MATTFRTFLNSPVGPKTTHFWGPIANWGFVVAGLVDMQKPPDMISGNMTGAMCVYSGLFMRFAWMVQPRNYLLLACHASNETVQLYQFSRWASANGYLPKKEGPEKQ

SEQ ID NO: 6928 - protein, 107 aa, Actinidia deliciosa
MSAFRAFLNSPVGPKTTHFWGPVANWGFVIAGLVDMKKPPEMISGNMTGAMCIYSALFMRFAWMVHPPNYLLPACHASNETVQLYQFSRWAKGNGYLGQKKDEAAPQ

SEQ ID NO: 6929 - protein, 106 aa, Pinus pinaster
MAALRTFWNSPVGPKTTHFWGPVANWGFVVAGLVDMQKPPDMISGNMTAAMCVYSGLFMRFAWMVQPRNYLLLACHASNETVQLYQLSRWASANGYLLKKEEAEKK

SEQ ID NO: 6930 - protein, 106 aa, Elaeis guineensis
MAALKAFWNSPVGPKTTHFWGPVANWGFVIAGLVDMQKPPEMISGNMTAAMCVYSGLFMRFAWMVKPRNYLLLACHASNESVQLYQLSRWAKAQGYLDKKEPEVNQ

SEQ ID NO: 6931 - protein, 106 aa, Phalaenopsis aphrodite
MAALRAFWNSPVGPKTTHFWGPVANWGFVTAGLVDTQKPPEMISGNMTAAMCVYSGLFMRFAWMVQPRNYLLLACHVSNETVQLYQLSRWAKAQGYLSNKEPEGQK

SEQ ID NO: 6932 - protein, 107 aa, Platanus occidentalis
MAAFRSFWNSPVGPKTTHFWGPVANWGFVAAGLVDTQKPPEMISSNMTAAMCVYSALFMRFAWMVQPRNYLLLACHVSNESVQLYQLSRWAKSQGYLQKKKEEAEPQ

SEQ ID NO: 6933 - protein, 95 aa, Salvia sclarea
MASFKAFLNSPVGPKTTHFWGPVANWGFVIAGLVDMKKPPEMISGNMTGAMCVYSALFMRFAWMVQPRNYLLLACHASNETVQLYQLSRWAKGQG

SEQ ID NO: 6934 - protein, 107 aa, Sciadopitys verticillata
MAATFRAFLNSPIGPKTTHFWGPVANWGFVIAGLVDMQKPPDMISGNMTAAMCVYSGLFMRFAWMVQPRNYLLLACHASNETVQLYQLSRWASANGYLPKKEEHEKK

SEQ ID NO: 6935 - protein, 112 aa, Tamarix hispida
MAASFRAFLNSPVGPKTTHFWGPIANWGLVVAGSVDMNKPPELISGNMTTAMCVYSGLFMRFAWMVQPRNYLLLACHASDEAVQLYQLSRWARAHGYLSEKKDETQTKTNPE

SEQ ID NO: 6936 - protein, 107 aa, Podocarpus macrophillus
MASTFRAFLNSPMGPKTTHFWGPIANWGFVVAGLVDMQKPPDLISGNMTAAMCIYSGLFMRFAWMVQPRNYLLLACHASNETVQLYQLSRWASANGYLSKKEESDKK

SEQ ID NO: 6937 - protein, 300 aa, Sorghum bicolor
MSAAFKAFLNSPVGPKTTHFWGPVSNWGIILASVADTQKPPEMISGNMTGVLCVYSALFVRFAWMVRPQNYFLMATHSCNEVVQLYQLSRWARAQKIYSRREELWNNLGQKKSSNLLDAMRRYRRVHLNYLIFINPHSPTATGQVLVLFPSPSSSIPLFPPFSTYLLALVDLSLPPPPSTRAALGDFRCFPSPMATALKSFLNSPVGPKTTHFWGPVANWGFVIAGLVDMNKPPEMISGNMTAAMCVYSGLFMRFAWMVQPRNYLLLACHASNESVQLYQLSRWARAQGYLEKKEPEAQQ

SEQ ID NO: 6938 - protein, 105 aa, Linum usitatissimum
MAALKSFWNSPVGPKTTHFWGPIANWGFVAAGLVDMQKPPEMISGNMTGVMCVYSALFMRFAWMVKPRNYLLLACHASNEGVQLYQFSRWARAQGYLSEEKKEVA

SEQ ID NO: 6939 - protein, 107 aa, Daucus carota
MASFKAFLNSPVGPKTTHFWGPIANWGFVISGLVDMQKPAENISGNMTGALCIYSGLFMRFAWMVQPRNYLLLACHASNETVQLYQFSRWAKSQGYLQGKDDKAVSQ

SEQ ID NO: 6940 - protein, 107 aa, Daucus carota
MASFKAFLNSPVGPKTTHFWGPIANWGFVISGLVDMQKPAENISGNMTGALCIYSGLFMRFAWMVQPRNYLLLACHASNETVQLYQFSRWAKSQGYLQGKEDKAVSQ

SEQ ID NO: 6941 - protein, 107 aa, Petroselinum crispum
MASFKAFLNSPVGPKTTHFWGPIANWGFVISGLVDMQKPAENISGNMTGALCIYSGLFMRFAWMVQPRNYLLLACHASNETVQLYQFSRWAKSQGYLQGKEDKAATQ

SEQ ID NO: 6942 - protein, 105 aa, Bupleurum chinense
MASFKAFLNSPVGPKTTHFWGPIANWGFVISGLVDMQKPAENISGNMTGALCIYSGLFMRFAWMVQPRNYLLLACHASNETVQLYQFSRWAKSQGYLQGKEDKAT

SEQ ID NO: 6943 - protein, 107 aa, Chelidonium majus
MAAFRAFLNGPMGPKTTHFWGPIANWGFVIAGLVDTQKPPEMISGNMTGAMCVYSGLFMRFAWMVQPRNYLLLACHASNETVQLYQFSRWAKSQGYLEQKKEEAKPE

SEQ ID NO: 6944 - protein, 107 aa, Distylium racemosum
MAATFRAFLNSPVGPKTTHFWGPIANWGFVIAGLVDMQKPPDMISGNMTAAMCVYSGLFMRFAWMVQPRNYLLLGCHASNETVQLYQLSRWASANGYLPKKEEHGKH

SEQ ID NO: 6945 - protein, 95 aa, Lupinus angustifolius
MASFRAFLNSPVGPKTTHFWGPVANWGFVAAGLADMQKPPEMISGNMTGAMCVYSALFMRFAWMVQPRNYLLLACHVSNEGVQLYQLSRWAKAQG

SEQ ID NO: 6946 - protein, 105 aa, Solanum tuberosum
MASFKAFLNSPVGPKTTHFWGPIGNWGFIIAGLVDTQKPPEMISGNMTSVMCVYSALFMRFAWMVQPRNYLLMVSHASNETVQLYQLSRWAKSQGYLQKKADKAE

SEQ ID NO: 6947 - protein, 106 aa, Pseudotsuga menziesii
MAALRTFWNSPVGPKTTHFWGPIANWGFVVAGLVDMQKPPDMVSGNMTAAMCVYSGLFMRFAWMVQPRNYLLLACHASNETVQLYQLSRWASAQGYLPKKEEAEKK

SEQ ID NO: 6948 - protein, 107 aa, Rhizophora mangle
MASFKAFWNSPIGPKTTHFWGPIANWGFVVAGLVDMKKPPEMISGNMTGAMCIYSALFMRFAWMVQPRNYLLFACHASNETVQLYQLSRWAKGQGYLSSGEKESPSQ

SEQ ID NO: 6949 - protein, 107 aa, Sequoia sempervirens
MAATFRTFLNSPVGPKTTHFWGPIANWGFVVAGLVDMQKPPDVISGNMTAAMCVYSGLFMRFAWMVQPRNYLLLACHVSNETVQLYQLSRWASANGYLPKKEGPEKQ

SEQ ID NO: 6950 - protein, 108 aa, Glycine max
MASNFRAFLNSPVGPKTTHFWGPIANWGFVAAGLIDMKKPPEMISGNMTAVMCVYSALFMRFAWMVQPRNYLLLACHASNEAVQIRQLTRWAKGNGYLSVKKEGASSK

SEQ ID NO: 6951 - protein, 114 aa, Papaver somniferum
MAAFKAFLNSPVGPKTTHFWGPIANWGFVAAGLVDMQKPPELISGNMTGAMCVYSGLFMRFAWMVQPRNYLLLACHASNETVQLYQFSRWAKAQGYLENKKDEVKKPEEAKKPE

SEQ ID NO: 6952 - protein, 63 aa, Triphysaria pusilla
MASSFKAFLNSPVGPKTTHFWGPVANWGFVIAGLVDMQKPPEMISGNMTAAMCVYSALFMRFA

SEQ ID NO: 6953 - protein, 106 aa, Persea americana
MSAFRAFWNSPVGPKTTHFWGPIANWGFVAAGLVDMQKPPELISGNMTAVMCVYSGLFMRFAWMVQPRNYLLLACHASNETVQLYQLSRWGRAQGYLQKKEEAEKA

SEQ ID NO: 6954 - protein, 106 aa, Musa acuminata
MAAFKAFWNSPVGPKTTHFWGPIANWGFVAAGLVDTQKPPEMISRNMTAAMCVYSGLFMRFAWMVQPRNYLLLVCHASNESVQLYQLSRWANAQGYLEKKEPEGQH

SEQ ID NO: 6955 - protein, 107 aa, Phaseolus vulgaris
MASFRAFWNGPMGPKTTHFWGPVANWGFVAAGLADTKKPPEMISGNMTGAMCIYSALFMRFAWMVQPRNYLLFACHLSNESVQLYQFSRWARAEGPLSAKKEEASSQ

SEQ ID NO: 6956 - protein, 104 aa, Flaveria ramosissima
MASFRAFLNSPVGPKTTHFWGPVANWGFVAAGLVDMQKPPEMISGNMTAAMCVYSGLFMRFAWMVQPRNYLLLACHASNETVQMYQLSRWAKHTRVFAEGRQVC

SEQ ID NO: 6957 - protein, 107 aa, Gnetum gnemon
MAATFKAFLNSPVGPKTTHFWGPVANWGFVVAGLADMEKPPDMISGNMTTAMCIYSGLFMRYAWMVQPRNYLLLACHVSNEAVQLYQLSRWASARGDQSKKDVATEK

SEQ ID NO: 6958 - protein, 97 aa, Lolium multiflorum
MATAFKAFVNSPVGPKTTHFWGPVANWGFVLAGLVDLNKPPEMISGNMTAAMCVYSGLFMRFAWMVQPRNYLLLACHASNETVQLYHLSRCAKAQGY

SEQ ID NO: 6959 - protein, 105 aa, Solanum lycopersicum
MASFKAFLNSPVGPKTTHFWGPIGNWGFIIAGLVDTQKPPEMISRNMTSVMCVYSALFMRFAWMVQPRNYLLMVSHASNETVQLYQLSRWAKSQGYLKKKTDKAE

SEQ ID NO: 6960 - protein, 107 aa, Amorphophallus konjac
MASTFRAFLNSPIGPKTTHFWGPVANWGFVIAGLVDMQKPPDVISGNMTAAMCVYSGLFMRFAWMVQPRNYLLLACHASNETVQLYQLSRWAKVQGYTPTKEQEKKE

SEQ ID NO: 6961 - protein, 158 aa, Gossypium raimondii
MKMAISLVLSRLILFLTLTCFAAVSSSTTTTTTLKRHSGFLYSRTRGKCTPQFWSSRREAWPRMVPQGSTVSNVFGSRASERYRSDMTLLESRAVNEEGNVFNELLKQASAALLNSYARKGFPYSAWEVKTLMIQGLVSEYAAARLTRRFSVANDACI

SEQ ID NO: 6962 - protein, 182 aa, Pennisetum glaucum
MGSPAPLRPLALACFIFLCSSFWAANGMYGRVDAAAAEGESRRRMGLHTDGSRGDAHAWPGYLYTRAVGRCTPQFWSSGAEPWPNIVPQEAAVSKVFGSRSVERYGPRLTLLEATMRTDDIGGTAFVKLVKQGSAALLNAYTRRGFPFDSWEVKALLLEALVSEEAAAVQAERFEQANESCV

SEQ ID NO: 6963 - protein, 182 aa, Saccharum officinarum
MDSQAPLRPLAFACFIFLCSSFWAANGMYARVGAAAAAEGESRRMRLHTDGSRGDAHAWPGYLYTRAVGRCTPQFWSSGAEPWPNIVPQEAAVAKVFGSRSVERYGPRLTLLEATMRTDDIGGSAFAKLVKQGSAALLNAYTRRGFPFDSWEVKALLLEALVSEEAAVVQAERFEQANESCV

SEQ ID NO: 6964 - protein, 182 aa, Sorghum bicolor
MDSLAPLRPLALACFIFLCSFFWAANGMYARVGVAAAADGESRRMRLHTDGSRGDAHAWPGYLYTRAVGRCTPQFWSSGAEPWPNIIPQEAAVAKVFGSRSVERYGPRLTLLEATMRTDDIGGSAFVKLVKQGSAALLNAYARRGFPFNSWEVKALLLEALVSEEAAVVQAERFEQANESCV

SEQ ID NO: 6965 - protein, 182 aa, Zea mays
MDSQAPLRPPLAFACFIFLCSSFCAANGMYDRVGAAASDGESRRMRLHTDGSRGDAHAWPGYLYTRAVGRCTPQFWSSGAEPWPNIVPQEAAVAKVFGSRSVERYGPRLTLLEATMRTDDAGGSAFVKLVKQGSAALLNAYARRGFPFDSWEVKALLLEALVSEDAAVVQAERFEQANESCV

SEQ ID NO: 6966 - protein, 180 aa, Panicum virgatum
SPAPRRPLALAWFILICSSFWAANGMHGRVRVAAAEEGESRRMRLHTDGSRGDAHAWPGYLYTRAVGRCTPQFWSSGAEPWPNIAPQEAAVWKVFGSRSVERYGPRLTLLEATMRTDDIGGSPFVKLVKQGSAALLNAYTRRGFPFDSWEVKALLLEALVFEEAAAVQAERFELANQSCV

SEQ ID NO: 6967 - protein, 936 aa, Zea mays
MDQQRRSSIRLYGSNASSRSGSFDFEHDQDKERADQPSDGDRREVVVKIDAEPHSPVSLHAAGGMSGHSSAVSTPRAGGAVSMLAASASGSSASTSSAGGDAPRSGESFSFKNRTPQSSAGGGESSEDPPSRLIGSFLRKQAAAGGELSIDPDFEVDEMRRPPRAPTSVNASRELRVSFQDPRKRFSPSTSSASSSSYDASHNRNQSTIDLDTAEVLRCTSTSTGSSLLARSKTRSRLMDPPPPSTSSAPASEVDPRKSFVSKGLPPKSGQLRSGLIGKSGLIGKSGPIGKSGAFEDEDDDPFMDEGMTSDFKRDTMDCLLIMEWVSLVVIVGALICSVTIPSLSIKKLSGLHLWKWELLVFVLICGRLVSGWVIRIAVFFVERNFLLRKKVLYFVYGVRRAVRNVLWLGVALVSWHLLFDKAAKRETHTLVLPYVTKVLCCLLVATVIRLIKTLLLKVLASSFHVSTYFDRIQEALFNQYVIETLSGPPLVDESRMMAEVQRLQSAGASIPSELEATAMPGKSGPLPKSGRLTTATSRREGGGASKQLHRQKTERHLDDGISIDQLHKLSQKNISAWSMKRLMKIVRYGALTTMDEQLKHATGEDELATEIHSEYEAKVAAKRIFQNVAKPGSKHIYLSDLMRFMRQEEALKAMDLFEGAQEHNRVSKRSLKNWVVNAFRERKALALTLNDTKTAVNKLHQMANVVVALIVLALWLLILGIATSKFFVLLSSQLLVAVFMFGNTLRTIFEAIVFLFVMHPFDVGDRCEVDGMQVVVEEMNIMTTIFLRYDNLKVYYPNSKLAQLPIMNYYRSPDMGDSVDFTVHVATPVEKLSLMKERLMHYLDNKKEHWYPGSMVVLRDVDDTNKLKASIWCRQTINFHDMGMRFERRELLLQEMIKVLRDLEIEYRMLPLDINVRNAPAIQSSRMPSTWTFSY

SEQ ID NO: 6968 - protein, 938 aa, Sorghum bicolor
MDQHRSSSLRSYTSNASSRAGSFDFDHDQDKERAGLTGGGDRREVVVKIDAEPHSPVSLHAPGGVSGHSSAVSTPRAGGAVSILAPSASGSSASTSSPGGDASRSGESFSFKNRPPQSPAGGESSEDPPSRLIGNFLRKQAAAGGELTIDPDFDVDEMRRPPRAPTSANNASRELRVSFQDPRKRFSPSTSTASSSSYDGGDNRNQSNIDLDTAEVLRCTSTSTGSSLLARSKTRSRLMDPPPPSSSSAGPAGEGDPRKSFVSKGLPPKSGQLRSGLIGKSGLIGKSGPIGKSGAFDDEDDDPFVDEGMTSDFKRDTMDCLLIMEWVSLVVIVAALICSVTIPSLSKKKLSGLHLWKWELLVFVLICGRLVSGWVIRIAVFFVERNFLLRKKVLYFVYGVRGAVRNVLWLGIALVSWHLLFDKDAKRETHTVVLQYVTKVLCCLLVATVIRLVKTLLLKVLASSFHVSTYFDRIQEALFNQYVIETLSGPPLVDESRMMAEVQRLQSAGASIPSELEATAMPGKSGPLPKSGRLTTVASKRGGGAGASKQLHRQKTELHLDDGIPIDQLHRLSQKNISAWSMKRLMKIVRYGALTTMDEQLKHATGEDELATEIHSEYEAKVAAKRIFQNVAKPGSKHIYLSDLMRFMRQEEALKAMDLFEGAQEHNRVSKRSLKNWVVNAFRERKALALTLNDTKTAVNKLHQMANVVVALIVLALWLLILGIATSKFFVLLSSQLLVAVFMFGNTLRTIFEAIVFLFVMHPFDVGDRCEVDGMQVVVEEMNIMTTIFLRYDNLKVYYPNSQLAQLPIMNYYRSPDMGDAVDFTVHVATPVEKLSLMKERLMHYLDNKKEHWYPGSMVVLRDVDDTNKLKASIWCRHTINFHDMGLRFERRELLLQEMIKILRDLEIEYRMLPLDVNVRNAPTIQSSRMPSTWTCNY

SEQ ID NO: 6969 - protein, 941 aa, Zea mays
MDQQRKSSLRSYGSNASSQSGSFDFNHDQDTERAGQPGGDDRREVVVKIDAEPHSPVSLHAAGGVSGHSSAASTPRAGGAAVRILAPSASGSSASTSSVGGDASGSGESFSFRKRPPQSPAGGDPGEDPPSRLIGSFLRKQAAAGGELSLDPDFEVEEMRRPPRAPTSVNASRELRVSFQDPRKRMSPSTSSASSSSYGAGGDSRNQSTIDVDAAEVLRCTSTSTGSSLLARSRTRSRLMDPPPPSTSSSAPANEGDPRKSFVSKGLPPKSGQLRSGLIGKSGLIGKSGPIGKTGAFDDEDDDPFMDEGMTSDFKRDTMDCLLIMEWVSLVVIVGALICSVTIPSLSVKKLSGLHLWKWELLVFVLICGRLVSGWVIRIAVFFVERNFLLRKKVLYFVYGVRRAVRNVLWLGVALVSWHLLFDKAAKRETHTLVLPYVTKVLCCLLVATVIRLVKTLLLKVLASSFHVSTYFDRIQEALFNQYVIETLSGPPLVDESRMMAEVQRLQSAGASIPSELEATAMPGKSRPLPKSGRLTTVASKRGGGGAAAASKQLHRQKTERHLDDGISIDQLHKLSQKNISAWSMKRLMKIVRYGALTTMDEQLKHATGEDELATEIHSEYEAKVAAKRIFQNVAKPGSKHIYLSDLMRFMRQEEALKAMDLFEGAQEHNRVSKRSLKNWVVNAFRERKALALTLNDTKTAVNKLHQMANVVVALIVLALWLLILGIATSKFFVLLSSQLLVAVFMFGNTLRTIFEAIVFLFVMHPFDVGDRCEVDGMQVVVEEMNIMTTIFLRYDNLKVYYPNSQLAQLPIMNYYRSPDMGDSVDFSVHVATPVEKLSLMKERLLHYLDNKKEHWYPGSMVVLRDVDDTNKLKVSIWCRQTINFHDMGMRFERRELLLQEMIKVLRDLEIEYRMLPLDVNVRSAPTIQSSRMPATWTFNY

SEQ ID NO: 6970 - protein, 934 aa, Oryza sativa
MDPRGKGSITSHASDKSSRSGSFDFEHDQDPDRDRRHDDAHRREVVVKIEPEAHVPVDLHAGGSHAANAPGAGGVAVGGVVPGSGSVSSASSSPGGGGNGESFSFKNRPPQSPASPAMSVGGEGSDDPPTRLIGSFLRKQAAAGGELALDPDLEMEEMRRPPRAPTSMNASRELRVSFQDPHKRFSPSTSSASTSSYAGDSRNQACSTAEAAEVIRCTSMSTGNNLLARSKTRSRLMDPPPPTISHPTEAERNDRKSFVGKGPPKSGQLRSGLIGKSGLIGLSGPIGKPGAFDDDDDDPFVDEGLAADLKRDTVDCLLILEWVGLIVIMGALVCSLSIRSLANKKLSGLHLWKWELLVFVLICGRLVSGWVIRICVFFVERNFLLRKKVLYFVYGVRRAVRNVLWLGLALISWHLLFDKDAKRDSHTLVLPYVTKVLCCLLVATVIRLVKTLLLKVLASSFHVSTYFDRIQDALFNQYVIETLSGPPLVDESRMLAEVQRLQSAGINIPSELEATAMPSKPPMPAKSGRLTVNPSKRGGAGGGANKQLQKQKSDRHCDDGITIDQLHRLSQKNISAWSMKRLMKIVRYGALTTMDEQIKHATGEDELATQIHSEYEAKVAAKRIFHNVAKPHSKHIYLSDLMRFMRQEEALKAMDLFEGAQEHNRVSKRSLKNWVVSAFRERKALALTLNDTKTAVNKLHQMANVVVVVIVIALWLSILGIATSRFFVFISSQLLVAVFMFGNTLKTIFEAIVFLFVMHPFDVGDRCEVDGMQVVVEEMNIMTTIFLRYDNLKVYYPNSQLAIQPIMNYYRSPDMGDAVDFSVHVATPVEKLALMKERLMHYLDNKKEHWYPGSMVVLRDVDDTNKLKVSIWCRHTINFQDMGMRFERRELLLQEMIKILKDLDIEYRMLPLDINVRNAPMIQSLRMPSTWITY

SEQ ID NO: 6971 - protein, 139 aa, Pennisetum glaucum
MQIRVRCGCGDSSCPEWAVVELQGMVQPQASFSGDIRGLHIGRLCSAPSPSSSKGGYTFTVGYHELAGTKVSLKKPLLVLRKKKVTGGAADQEPPMAAGEAELEVIGIIRHKILFKDRPKALISKPPTKEKKALQPAAN

SEQ ID NO: 6972 - protein, 138 aa, Panicum virgatum
MEIRVRCGCGDSSCPEWAVVELQGVVQPQASFSGDIRGLHIGRLCSAPSPSSSKGGYTFTVGYHELAGTKVTLKKPLLVLRKKKVAGGAADQEPPTAAEVELEVIGVIRHKILFKDRPKALISKPPTKEKKAAQAAAN

SEQ ID NO: 6973 - protein, 138 aa, Panicum virgatum
MEIRVRCGCGDSSCPEWAVVELQGVVQPQASFSGDIRGLHIGRLCSAPSPSSSKGGYTFTVGYHELAGTKVTLKKPLLVLRKKKVGGGAPDQEPPMAAEVELEVIGVIRHKILFKDRPKALISKPPSKEKKAVQQAAN

SEQ ID NO: 6974 - protein, 140 aa, Sorghum bicolor
MQIRVQCGCGESSCPEWAVVELQGVVQPQASFAGDIRGLHIGRLCSAPSPSSSSKAGYTFTVGYHELAGTKVTLKKPLLVLRKKKVNAGCGEQEPPAAAEEVELEVIGIIRHKILFKDRPKALISKPPTKEKKTVQPAAK

SEQ ID NO: 6975 - protein, 140 aa, Zea mays
MQIRVQCACGESSCPEWAVVELQGVVQPQASFAGDIRGLHIGRLCSSPSPASASSKAGFTFTVGYHELAGTKVTLKKPLLVLRKKKVNAGAQEEEPPTAAEVELEVIGIIRHKILFKDRPKALISKPPTKEKKAVQPAAK

SEQ ID NO: 6976 - protein, 141 aa, Saccharum officinarum
MQIRVQCGCGESSCPEWAVVELQGVVQPQASFAGDIRGLHIGRLCSAPSPASASSKAGYTFTVGYHELAGTKVTLKKPLLVLRKKKANAVCGEQEPPPAATEVELEVIGIIRHKILFKDRPKALISKPPTKEKKTVQPAAK

SEQ ID NO: 6977 - protein, 123 aa, Pennisetum glaucum
MGNCLERSRRGRSGGGGGSVHYSRTNPVWVEEEVGRKEEEEEAAAARKGESAPAATTEVKIRITRKQLEELLRRVEGGTESGDGVPVRDVISELLYVASTSSNFRHRGDDEGQWRPSLQSIPE

SEQ ID NO: 6978 - protein, 122 aa, Panicum virgatum
MGNCLESSRRGSCGGGGGAAVHYSKTRAVWVEEEEVGRKEEEARKGESAPAAGAAATTEVKIRITRKQLEELLRRVEDGKESGDGVPARDVVSELLIVASTSSNFRHRDEGQWRPSLQSIPE

SEQ ID NO: 6979 - protein, 120 aa, Panicum virgatum
MGNCLERSRRGSCRGGGAAAHYSKTSAVWVEEEVGGKEEEEEEEARKGESAPAATTEVKIRITRKQLEELLRRVEDGKESGDGVPARDVVSELLIVASTSSNFRHREEGQWRPSLQSIPE

SEQ ID NO: 6980 - protein, 87 aa, Pennisetum glaucum
MPNAGLRAYREVLRLVRRLPAETRLYYAKYARENFVNYRDLSADDDLAALLRRAYTHSSWVLSKYSIDGEKAAARLKDLGDGRPAGQ

SEQ ID NO: 6981 - protein, 86 aa, Panicum virgatum
MPNAGLRAYREVLRLVRRLPAETRPYYAKYARENFVNYRDLSADDDLAALLRRAYAHSSWVLSKYSIDAEKAAARLKALGDGHAGR

SEQ ID NO: 6982 - protein, 86 aa, Panicum virgatum
MSNAGLRAYREVLRLVRRLPAETRLYYAKYARENFVNYRDLSADDDLAALLRRAYTHASWVLSKYSIDAEKAAARLKALGDGHAGR

SEQ ID NO: 6983 - protein, 86 aa, Sorghum bicolor
MASAGLRAYREVLRLVRRLPAETRPYYAKYARENFVNYRDLSADDDLAALLRRAYTHSTWVLSKYSIDAGKAAARLKDLSDGHAGL

SEQ ID NO: 6984 - protein, 438 aa, Sorghum bicolor
MEAAAVLDAFSAAPRHKLRPAAWWRSTRLASQACRATAPFARADWQTACAILASNSSTGGGGGHDASSSSNNRQPAPRVNGQKPLPAPAPAPALEEATPTPTELDLVPVSNLPRPLSISDLSPAPMHGSQLRVAYQGVPGAYSEAAAAKAYPGCDAIPCDQFEVAFQAVELWIADRAVLPVENSLGGSIHRNYDLLLRHRLHIVGEVQLPVHHCLLALPGVRRELLTRVISHPQALAQCELTLNAMGLNVAREAFDDTAGAAEHVAAGGLRDTAAIASARAAELYGLQVLADGIQDDAGNVTRFVMLAREPIIPRTDRPFKTSIVFAHDTDGTSVLFKVLSAFAFRDISLTKIESRPHRHRPIRLVDDANVGTAKHFEYMFYIDFQASMADVRAQNALAEIQEFTSFLRVLGSYPMDMTPWDAALSSSSRADDTSQHY

SEQ ID NO: 6985 - protein, 479 aa, Zea mays
MNWLYAQSLVLAGARGERGVPRRHVHGVAPEHPEEGGELLDLRERVLRADVGHGRLEVDVEHVLEVLGGADVGVVDEADGAVAVRAALDLGEGDVAEGEGGEHLEEDGGAVGVVREHDAGLERPVGARDDGLPRQHDEAGDVAGVVLDAGGEDLEAVELGGARGRDGGGVPEAPRGDVLGGARGVVEGLAGHVEAHGVERQLALRQRLRVGDDPGEQLPSHPGEREEAVVDGELDLPDDVEAVPEEEVVVAVDAAAEGVLHGEHGAVGDPELDGLKGHLELVAGDGVAAWVGLGGGRLAVGARDALVRHAELRPVHGRRGQVADAERAGEVGHGHQIQLVRRRRRLQGWRGLLAVDPRRWLRVVVAAGIVAGAARAVAGEDGAGGLPVGAGEWGGGAARLGREARGSAPGCRAELVARRGGEGVEQSCGVHGDGRVDWIGLARRFGPPRPVWPCSLPGSWWLLFFLTPPALVWSGRLVC

SEQ ID NO: 6986 - protein, 422 aa, Zea mays
MDAAALLDAFSAAPRHQLRPAAWCRSTRFASQACRATAPFARADWQAACAILASNSTGGAGHDASSNNNAQPAPRVNGQKPPPALEATPTPDELDLVPVSNLPRPLSISDLSPAPMHGSQLRVAYQGVPGAYSEAAAAKAYPGCDAIPCDQFEVAFQAVELWIADRAVLPVENSLGGSIHRNYDLLLRHRLHIVGEVQLPVHHCLLALPGVRRELLTRVISHPQALAQCELTLNAMGLNVAREAFDDTAGAAEHIAAGGLRDTAAIASARAAELYGLQVLAAGIQDDAGNVTRFVMLAREPIIPRTDRPFKTSIVFAHDTDGTSVLFKVLSAFAFRDISLTKIESRPHRHRPIRLVDDANVGTAKHFEYMFYIDFQASMADVRAQNALAEIQEFTSFLRVLGSYPMDMTPWDAALSSRASQY

SEQ ID NO: 6987 - protein, 93 aa, Panicum virgatum
MLEGKAMVEDTDMPAKMQAQAMAAASRALDRFDVLDCRSIAAHIKKEFDTIHGPGWQCVVGSSFGCYFTHSKGSFIYFRLESLRFLIFKGAAA

SEQ ID NO: 6988 - protein, 93 aa, Sorghum bicolor
MLEGKAVVEDTDMPAKMQAQAMSAASRALDRFDVLDCRSIAAHIKKEFDAIHGPGWQCVVGSSFGCYFTHSKGSFVYFRLESLRFLVFKGAAA

SEQ ID NO: 6989 - protein, 93 aa, Zea mays
MLEGKAVVEDTDMPAKMQAQAMSAASRALDRFDVLDCRSIASHIKKEFDAIHGPGWQCVVGSGFGCYITHSKGSFIYFRLESLRFLVFKGAAA

SEQ ID NO: 6990 - protein, 104 aa, Hordeum vulgare
MLEGKATVEDTDMPAKMQLQATSAASRALDRFDVLDCRSIAAHIKKEFDTAHGPGWQCVVGCSFGCYFTHSKGSFIYFKLESLRFLVFKGMSDDQEQPLPLPPC

SEQ ID NO: 6991 - protein, 93 aa, Oryza sativa
MLEGKAMVEDTDMPVKMQLQAMSAAYKALDRFDVLDCRSIAAHIKKEFDMIHGPGWQCVVGASFGCYFTHSKGSFIYFKLGALRFLVFKGAAS

SEQ ID NO: 6992 - protein, 94 aa, Brachypodium distachyon
MLEGKATVEDTDMPANMQLQATSAASKALDRFDVLDCRSIAAHIKKEFDAVHGPGWQCVVGCSFGCYFTHNKGSFIYFRLESLRFLVFKGAAEK

SEQ ID NO: 6993 - protein, 99 aa, Lolium multiflorum
MLEGKATVEDTDMPAKMQLQATSAASRALDRFDVLDCRSIAAHIKKEFDTIHGPGWQCVVGCSFGCYFTHSKGSFIYFKLESLRFLVFKGAADEQPRRC

SEQ ID NO: 6994 - protein, 99 aa, Avena sativa
MLEGKATVEDTDMPAKMQLQATSAASRALDRFDVLDCRSIAAHIKKEFDAIHGPGWQCVVGCSFGCYFTHSKGSFIYFKLESLRFLVFKGAADEQPRPC

SEQ ID NO: 6995 - protein, 99 aa, Secale cereale
  Sequence also found in Organisms: Triticum aestivum
MLEGKATVEDTDMPAKMQLQATSAASRALDRFDVLDCRSIAAHIKKEFDTIHGPGWQCVVGCSFGCYFTHSKGSFIYFKLESLRFLVFKGMADEQPLPC

SEQ ID NO: 6996 - protein, 95 aa, Festuca arundinacea
MLEGKATVEDTDMPAKMQLQATSAASRALDRFDVLDCRSIAAHIKKEFDTIHGPGWQCVVGCYFTHSKGSFIYFKLESLRFLVFKGAADEQPRPY

SEQ ID NO: 6997 - protein, 100 aa, Prunus persica
MLEGKAFVEDTDMPVKMQMQAMAAASQALDLYDVFDCRSIAAHIKKEFDMRYGGGWQCVVGSNFGCFFTHSKGSFIYFTLESLSFLIFKGASSPSSSPEG

SEQ ID NO: 6998 - protein, 366 aa, Panicum virgatum
MPLLAVASSTRAAAVRPLRASAASGEAVPSPAAAAAETAARRPVKVILPKKKPQKWSTGMEPGEYGGGPATIKPRKYWWGKEDRDPVGNTDDFIWNKDFLPHMERVIANGGASAEPTITRLTPVDEEESGFLSINRAMSLDSVEVDLSKELQAPTRPILQTQVEAARRGRAFGAEAVNGATSARWRLVPTRREQAKWNRAAKAATGGSDVILRESKSRVQQGDPKVLAARSREEYLKLKQRLQLLTLGVGGVGVVSAYVSYSPEIAASFGAGLIGSLVYLRMLGTSVDSLAGGTGETVKSAAAQPRLLIPVLLVMMYNRWNEILVPDYGFMHLELIPMLVGFFTYKIATFAQAIQDSIPTVGNREV

SEQ ID NO: 6999 - protein, 366 aa, Panicum virgatum
MPLLAIASSTRAAAVRPLRASAASGEAAPAPAATAAETAGRRPVKVILPKKKPQKWSTGMEPGEYGGGPATIKPRKYWWGKEDRDPVGNTDDFIWNKDFLPHMERVIANGGSNAEPTITRLTPVDEEESGFLSINRAMSLDSVEVDLSKELLAPTRPILQTQVEAARRGRAIGAEAVNGATSARWRLVPTRREQAKWERAAKAATGGSDVILRESKSRVQQGDPKVLAARSREEYLKLKQRLQLLTLGIGGVGVVSAYVSYSPEIAASFGAGLIGSLAYLRMLGTSVDSLAGGTGETVKSAAAQPRLLIPVVLVMMYNRWNEILVPDYGFMHLELIPMLVGFFTYKIAMFAQAIQDSIPAVGNHEI

SEQ ID NO: 7000 - protein, 359 aa, Echinochloa colona
ASSTRAAAVRPPRASAASGEAVPAPAAEAAGAGRRPVKVILPKKKPQKWSTGMAPGEYGGGPSTIKPRKYWWGKEDRDPVGNTDDFIWNKDFLPYMERVVANGGAAAEPTITQLAPVDEEGSGFLSINRAMSLDSVEVDLSKELQAPTRPILQTQVEAARRGRAIGAEAVNGATSPRWRLVPTRREQAKWDRAAKAATGGSDVILRESKSRVQQGDPKVLAAKSREDYLKLKERLQLLTLGIGGVGVVSAYVSYSPEIAASFGAGLIGSLVYLRMLGTSVDSLAGGTGETVKSAAAQPRLLIPVVLVMMYNRWNGILVPDYGFMHLELIPMLVGFFTYKIATFAQAIQDSIPTVGNREV

SEQ ID NO: 7001 - protein, 365 aa, Zea mays
MSLLAVASSTRAAAVRPLCASAASDEAVPAPAVADTAGRRPVKVILPKKKPQKWSTGMAPGEYGGGPATIKPRKYWWGKEDRDPVGNTDDFIWNKDFLPHMERVIANGGADAEPTITRLAPVDEEGESGFLSINRAMSLDSVEVDLSQELQAPTRPILQTQVEAAWRGRAIGAEAVNGASAPRWRLVPTRREQAKWDRAAKAATGGSDVILRESKSRVQQGDPKVLAARSREDYLQLKQRLQWFTLGIGGVGVISAYISYTPEIAVSFGAGLIGSLVYLRMLGTSIDSLAGGTGETVKSAAAQPRLLIPVVLVMMYNRWNQILVPDYGFMQLELIPMLVGFFTYKIATFAQAIQDSIPPVGNREG

SEQ ID NO: 7002 - protein, 368 aa, Sorghum bicolor
MSLLAVASSTRAAAVRPLCASAASSGEAVPAPATAATTEAAGRRPVKVILPKKKPQKWSTGMAPGEYGGGPATIKPRKYWWGKEDRDPVGNTDDFIWNKDFLPHMERVIANGGADAEPTITRLSPVDEEESGFLSINRAMSLDSVDVDLSQELLAPTRPILQTQVEAAWKGRAIGAEAVNGANTPRWRLVPTRREQAKWDRAAKAATGGTDVILRESKSRVQQGDPKLLAARSREDYLKLKQRLQWLTLGIGGVGVISAYISYSPEVAASFGAGLIGSLVYLRMLGTSVDSLAGGTGETVKSAAAQPRLLIPVVLVMMYNRWNGILVPDYGFMQLQLIPMLVGFFTYKIATFAQAIQDSIPAVGNREG

SEQ ID NO: 7003 - protein, 364 aa, Oryza sativa
MSLPALAAGRAASVRPPRASAASGEAAAAAAADQPAGRRPVKVILPKKKPQKWSTGMAPGEYGGGPATPKPRKYWMGKEDRDPVGNTDDFIWNKDFLPHMERVIANGGADTPPTITRLTPVDEDTESGFLSINRAMSLDSVDVDLSKELQAPTRPILKTQVEAAWRGRAIGAEAVNGVASPRWRLVPTRREQAKWDRAAKAATGGSDVILRESKSRVQQGDPEVLAAKSREQYLELKQRLQLFTLGIGGIGLVSAYFSYSPEIAASFGAGLIGSVLYLRMLGTSVDSLAGGTGETVKSAAAQPRLLIPVALVMMYNRWNEILVPDYGFMHLELIPMLVGFFTYKIATFAQAIQESIPAVGNRES

SEQ ID NO: 7004 - protein, 363 aa, Brachypodium distachyon
MSLLAVVPSRAAAVRPPRASAASGEAAAVPDLPAARRPVKIILPKKKPQKWSTGMEPGEYGGGPTTVKPRKYWMGKEDRDPVGNTDDFIWNKNFLPHMERVIANGGTDTPPTIPRLTPVDEDANSGFLSINRAMSLDSVEVDLSKELLAPTESILKTQVNAARRGRSIRAEAVNRSTFIRWKLAPTRREQEQWDRATRATTGGIDVILKESKSKVQQQGDPKVLAAEAREQYLKLKERLQLLTLGIGGIGVVSAYVSYSPEIAVSFGAGLIGSLVYLRMLGTSVDSLAGGTKATAKGAVAQPRLLIPMVLVMMYNRWNAILVPDYGFMHLELIPMLVGFFTYKIAMFTQAIQESIPDVGKREV

SEQ ID NO: 7005 - protein, 307 aa, Pennisetum glaucum
MEPGEYGGGPATIKPRKYWWGKEDRDPVGNTDDFIWNKDFLPYMERVIANGGAAAEPTITRRAPVDEEGSGFLSINRAMNLDSVEIDLSKELQAPTRPILQTQVEAARRGRAIGAEAVNGATSARWRLVPTRREQAKWDRAAKAATGGSDVILRESKSRVKQGDPKESAARAREDYIKLKQRLQLLTLGIGGIGVVSAYVSYSPEIAVSFGAGLIGSLVYLRMLGTSVDSLAGGTGETVRSAAAQPRLLIPVVLVMMYNRWNEILVPDYGFMHLELIPMLVGFFTYKIATFAQAIQDSIPPVGNREV

SEQ ID NO: 7006 - protein, 893 aa, Panicum virgatum
MPTKGQFSSERNVKNISGRDGQKKGNSLHDQIASLPKDRVGAVNGNVDGKFEDRIRVAKNDKFRRQRESLSGERAACMKGSKPWPGRKTNTVDELVKHMSNVPSYLQHKETADHRQDKALNVGVLEWGLLANWSQQQKHDLTRSHGASPSSTSRSVLFSSPSHSSASPSSRSLESNQSTPVSDNHHSSIRGQQSRLADKHHGTARYSPSPNSAVLSLLPAHSKHPCPETTSNYVGSGLSNVSLPSDSLGSSSRSCGRPEMDEDEESRRIEDIVHHCSRRLFTDSDSIGKNLFASNNNNSLCNDPEQSSVLNGQSFEPLISYAVMDTPRNGSRLPDVFLEDIEPSHEFPQIPYSCPLPIIDSAAKEIHTTSTEARNNFVGTAAKVSKNSNRNRSVMSGIENPPQCSAKFSDRMPDRHLGARMNRVSRSSSLKETQCARQPDVGPSVDTIGDRSSSNGKGRRSPLRRMLDPILKPRHSSPVRPSFVPKCHLPVNTTKQSLDMGGSVPQNVQRSVDMIVNSNYPTEACINQPPHVLLNSARYLQQEKDSPTTRQALLQLAWKNGLPLFMMSYGESDILAATVRKKGISEKDDLESTYAVFTVEEPKKKSGTWIKAGGKNKKHHLLSSIVGELKVAHKKSRCHHTKNVHVHREFVLIGSEFLPSSEESGDLHISGELAAFISALPQQEAETSNQSSSQNMGQSDLAPSGCGCPPLGNFQPSTRNANSGPANVIAVLPDGFHGTSTSGQPLPLIERWKSGGSCDCGGWDEGCMLSVLTGTLGNGAVQANQAMDGSQRFELVAQGRLREDRNAFSMTSFKEGLYTVEFRSSIALLQAFAMCIVMLHGRWYPNKMQVASQAVQEHDLLANHELKTMAASQGRAPTSYVPHRPPLSPVGRA

SEQ ID NO: 7007 - protein, 892 aa, Panicum virgatum
MPTKGQFSSERNVKNISGRDGQKKGNSLPDQIAPLPKDRVAAVNGNGDRKFVDRIRVAKNDKFRRQRESLSGERSACMKGSKPWPGRKTTTVDELVKHMSNVPSYLQHKETADHRQDKALNVGVLEWGLLANWSQQQKHDLARSHGTSPSNTSRSVLFSSPSHSSASPSSRSLESNQSTPVNDHHHSSIRGQQSRLADKHHGTARYSPSPNSAVLSLLPAHGKHPCPETSSNYVGSGLSNVSLPSDSLGSSSRSCGRPEMDEDEESRRIEDIVHHCSRRLFTDSDSIGKSLFTSNNNDSDPEQSSVLNGQNFEPQIPDAAMDTPRNGSRLPDVFLEDIEPSHEFPRIPHSCPLPIIDSAAKEIHTTSTEARNNFVGTAAKVSKNSNQNRSAMSGIENPPQCSAKFSDRMPDRYLGAGTNRVNRSSSLKETPCDRQPDVGPSGDKIGDRSSSNSKGRRSPLRRMLDPILKPRHSSPVRPSFVPKCHLPVNTPKQSLDMGGSVPQNVQRRSVDMVVNSNYPTEACINQPPHVLLNSARYLQQEKDSPTTRQALLQLAWKNGLPLFMMSYGESGILAATVRKKGISEKDDLESTYAVFTVEEPKKKSGTWIKAGGKNKKHHLLSSIVGELKVSHRKSRCHHTKNAHVHREFVLVGSEYLPSSEESGDSHISGELAAFISALPQQEAETSNQSSSQNMGQSDLAPSGCGCPPLGNFQPSTRNANSGSANVIAVLPDGFHGTSTSGQPLPLIERWKSGGACDCGGWDEGCTLSVLAGMAPGNGAVQANQAMDGSQRFELVAQGRLREDRNAFSMTSFKEGLYTVEFRSSIALLQAFAMCIVMLHGRWYPNKMQVASQAVQERDLLANHELKTMAAIQSRAPTSYVPHRPPLSPVGRA

SEQ ID NO: 7008 - protein, 894 aa, Sorghum bicolor
MPTKGQVSSERSVKIISGRDGQKKGNSQHDQIVHVPKDMVTAVNGNVDGKFEDKVRVVKNDKFRRQRESWGGERAACMKGSKPWPGRKATTVDELVKHMSNVPSYLQRKETSDHLQDKALNVGVLEWGLLANWSQQQKLELARSHGASPSNTSRSVLFSSPSHSSASPSSRSLESNQSTPMSDHHHSSIRAQQSRLADKHHGKARCSPSPNSAVLSLLPGHGTHPCPENGRNYVDLGLSNVSLASDSLGSSSRSCGRHEMVEDEETRWKIEDVVHHCSRRLFTDSDNIGKHFFTSNNNDSMCNDPEQSSGLNGENFESLISDDLMDTARSGSRSPDCFLEDIEPSREFPRIPYSCPLPIIDSAAKEIGTTSIEAGDNFVGTAAKVNKNSNRNQSAMNVTENHPQYSAKFSDRMPDRHIGSGMNRVSRSSSLKESPHRQPNIVPPVDKTGDRSSPNSKGRRSPLRRMLDPILKPRHSSPVRPSFVPKCHLPVNTTKQSLDLGGSVPQNVQRRSVDLVVNSNYPIEANINQPPRVLLNSARYTQKDKDSATTRQALLQLAWKNGLPLFMLSYGDSDILAATVRRKGISEKDDLESTYAVFTVEEPKKKSGAWIKAGGKNKKHNLLSSIVGEIKVACRKSRCHHTADVHVHREFVLVGSEFLPSSEESGDSHVSGELAAFITALPQQEAETSNQSSSQNTRQRNSAPTGCGCPPLGNFQPSTRNANSASANVIAVLPDGFHGTSTTGQPLPLIERWKSGGACDCGGWDEGCTLSILTDAAQENDAIQANLAKDGSQRFELLVQGRSREDRHAFSMTSFKEGLYTVEFRSSIALLQAFAMCIVMLHGRYPSRMQVGSQAAQEHDLLAGHELKAMAASQGRAPTSYVPHRPPLSPVGRA

SEQ ID NO: 7009 - protein, 890 aa, Zea mays
MPTKVQVSSERNVKIISGRDGQKKGNSQHDQIVRVPKDMVTPVNGNVDGKFEDKVRVVKNDKFRRQRESWGGERAACMKGSKPWPGRKATTVDELVKHMSNVPSYLQRKETSEHLQDKALNVGVLEWGLLANWSQQQKHELARSHGASPSNTSRSVLFSSPSHSSASPSSRSLESNQSTPISDYHHSSIRAQQSRLADKHHGKARCSPSPNSAVLSLLPGHGTHPCQENGCNYVDLDLNNVSLASDSLGSSSRSCSRHEIVEDEETRWKIEDVVHHCSRRLFTDSDNIGKHFFTSNNKDSMCNDPEQSSGLDCENFESLISDAVMDTARNGSRSPDCFLEDIETSREFPRIPYSCPLPIIDSAAKEIGTTSTEAGDNFIGTAAKVSKNSSLNQSALNATENPPRYSAKFSDRMPDRHQGSVMNRVSRSSSLKESPHARQPNVVPPVDKTGDRSSPNSKGRRSPLRRMLDPILKPRHSSPIRPSFVPKCHLPVNTTKQSLDLGGSVPQNMQRRSVDLVVNSNYRIEANTNQPPRVLLNSARYIQKEKDSTTTRQAFLQLAWKNGLPLFMLSYGDSDILAATVRRKGISEKDDLESTYAVFTVEEPKKKSGAWIKAGGKNKKHHLLSSIVGEIKVARRKSRCHHTADVHVYREFVLLGSGFLPSSEESGDSHVSGEFAAFISALPQQEAETSNQSSSQNTRQKNLALTGCGCPPLGNFQPSSASANVIAVLPDGFHGKSTSGQPLPLIERWKSGGACDCGGWDEGCMLSVLTDAAEENDAVQANQAKDGSQRFELLAQGGSREDRHAFSMTSFKEGLYTVEFRSSIALLQAFAMCIVMLHGRYPDRLQVGSQAAQEHDLLAGHEVKAMVASQGRAPTSYVPHRPPLSPVGRA

SEQ ID NO: 7010 - protein, 636 aa, Saccharum officinarum
MAEDEETRWKIEDVVHHCSRRLFTDSDNIGKHFFTSNNNDSMCNDPEQSSGLNGENFESLISDALMDTARSGSRSPDCFLEDIEPSLEFPRIPYSCPLPIIDSAAKEIGTTSTEAGDNFVGTAAKVNKNSNRNQSAMNVTENPPRYSAKFSDRMPDRHIGSGMNRVSRSSSLKESPHARQPNVVPPVDKTGDRSSPNSKGRRSPLRRMLDPILKPRHSSPVRPSFVPKCHLPVNTTKQSLDLGGSVPQNVQRRSVDLVINSNYPIEANINQPPRVLLNSARYIQKDKDSATTRQALLQLAWKNGLPLFMLSYGDSDILAATVRRKGISEKDDLESTYAVFTVEEPKKKSGAWIKAGGKNKKHNLLSSIVGEIKVARRKSRCHHTADVHVHREFVLVGSEFLPSSEESGDSHVSGELAAFITALPQQEAETSNQSSSQNTRQRNSAPIGCGCPPLGNFQPSTRNANSASANVIAVLPDGFHGTSTSGQPLPLIERWKSGGACDCGGWDEGCMLSVLTDAAQDNDAIQANQAKDGSQRFELLVQGRSREDRNAFSMTSFKEGLYTVEFRSSIALLQAFAMCIVMLHGRYPSRMQVGSQAAQEHDLLAGHELKAMAASQGRAPTSYVPHRPPLSPVGRA

SEQ ID NO: 7011 - protein, 894 aa, Zea mays
MFTHHKYSNKGQMNSERNVKIISGRDGQKKGNSQYGQIVHMPKDMVTTVNGNVDAKFEDEVRVVKNDRFQRQRESWGGECKKGSKPWPGRKAATVDELVKHMSNVPSYLQRKETSDHLQDKALNVGVLEWGLLANWSQQEKHKLTRSYGPSPPNTSRSVLFPSPSHSSPSPSSRSLESNQSTPMSGHHHSSIRAQQNRLTDKHHERARCPPSPNSAVLSLLSGHGTHPCPENGHNYVGLGLSNVSLASDSLGSSSRSCGRHEMVGDEETRRKTEDVVHHCSRRLFADSDNIGKHFFASNTNDSMCNDPEQSIGLNGENFESLTSDAVMDTARNDSKSSDYLLEDIEPSLEFPRIPYSCPLPIIDSAAKEIGITSTEAGDAKVSKNSNRNQSAMNVTENPPQYSAKFSDKMPYCHLGSGMNRGSCSSSLKESPHIRQPNIVPPVDKTGDRSSPNSKGRRSPLRRMLDPILKPRHSSPVRPSFVPKCQLPVNTTKQSLDLGKSVPHNVQRRSVDLVVNSNYLIEENRNQPPPRVLLNSARYIQKGNDSATTRQALLQLAWKNGLPLFILSYGDSDILAATVRRKGIPEKDGLESTYAVFTVEEPKKKSGAWIKTGGKNKKHHLLSSIVGEIKVARRKSRCHHTTDVHVHREFVLVGSKFLPSSEESGDSNVSGELAAFISTLPQQEAETSKQSSSQNTRQRNSMPIGCGCPPLGNFHPSTRSANSASANVVAVLPDGFHGTITSGQPLPLIERWRSGGACDCGGWDEGCMLSVLTDAAEENDAIQANQAKDGSQRFELLDQGRSREERHAFSMTSFKEGLYTVEFRSSIALLQAFAMCIVMLHGRYPRRTQVGSQAEQEHDLLAGHELKAMAASQGRRPPTSYVPHRPPLSPVGRA

SEQ ID NO: 7012 - protein, 560 aa, Panicum virgatum
MASMMQPQIILLKEGTDTSQGRAQVVSNINACTAVADTVRTTLGPRGMDKLIHDDKGGVTISNDGATIMRLLDIVHPAAKILVDIAKSQDSEVGDGTTTVVLLAAEFLKEAKPYVEDGVHPHSLIRSYRTAGNMAIQRVKELAVSIEGKSLEEKKSLLAKCAATTLSSKLIGGEKEFFASMVVDAVLAIGNDDRLNLIGIKKVPGGTMRDSFLVNGVAFKKTFSYAGFEQQPKKFLNPKILLLNIELELKSEKENAEIRLSDPLQYQSIVDAEWNIIYDKLDKCVKSGAKIVLSRLAIGDLATQYFADRDIFCAGRVTEEDLQRVAAATGGMVQTSVNNVIDEVLGSCEVFEEKQVGNERFNIFSGCPSGQTATIVLRGGADQFIEEAERSLHDAIMIVRRALKNSTVVPGGGAIDMEISKYLRQHARTIAGKSQFFVNSFAKALEVIPRQLCDNAGFDATDVLNKLRQKHASGEGANYGVDINTGGITDSFANFVWEPAVVKINAINAATEASCLILSVDETVKNPKSESAQGEAAAGAMAGRGGGAMRGRGGRGMRRR

SEQ ID NO: 7013 - protein, 560 aa, Echinochloa colona
MASMMQPQIILLKEGTDTSQGRAQVVSNINACTAVADTVRTTLGPRGMDKLIHDDKGGVTISNDGATIMRLLDIVHPAAKILVDIAKSQDSEVGDGTTTVVLLAAEFLKEAKPYVEDGVHPHSLIRSYRTAGSMAIQRVKELAVSIEGKSLEEKKSLLAKCAATTLSSKLIGGEKEFFASMVVDAVLAIGNDDRLNLIGIKKVPGGTMRDSFLVNGVAFKKTFSYAGFEQQPKKFLNPKILLLNIELELKSEKENAEIRLSDPLQYQSIVDAEWNIIYDKLDKCVKSGAKIVLSRLAIGDLATQYFADRDIFCAGRVTEEDLQRVAAATGGTVQTSVNNVIDEVLGSCEVFEEKQVGNERFNIFSGCPSGQTATIVLRGGTDQFIEEAERSLHDAIMIVRRALKNSTVVPGGGAIDMEISKYLRQHARTIAGKSQFFVNSFAKALEVIPRQLCDNAGFDATDVLNKLRQKHASGEGANYGVDINTGGITDSFANFVWEPAVVKINAINAATEASCLILSVDETVKTQKSESAQGDAAAGAMAGRGGGAMRGRGGRGMRRR

SEQ ID NO: 7014 - protein, 560 aa, Sorghum bicolor
MASMMQPQIILLKEGTDTSQGRAQVVSNINACTAVGDTVRTTLGPRGMDKLIHDDKGGVTISNDGATIMRLLDIVHPAAKILVDIAKSQDSEVGDGTTTVVLLAAEFLKEAKPYIEDGVHPHSLIRSYRTAGNMAIQRVKELAVSIEGKSLEEKKTLLAKCAATTLSSKLIGGEKEFFASMVVDAVLAIGNDDRLNLIGIKKVPGGTMRDSFLVNGVAFKKTFSYAGFEQQPKKFLNPKILLLNIELELKSEKENAEIRLSDPLQYQSIVDAEWNIIYDKLDKCVKSGAKIVLSRLAIGDLATQYFADRDIFCAGRVTEEDLQRVAAATGGTVQTSVNNVIDEVLGSCEVFEEKQVGNERFNIFSGCPSGQTATIVLRGGAEQFIEEAERSLHDAIMIVRRALKNSTVVPGGGAIDMEISKYLRQHARTIAGKSQFFVNSFAKALEVIPRQLCDNAGFDATDVLNKLRQKHASGEGANYGVDINTGGIADSFANFVWEPAVVKINAINAATEASCLILSVDETVKNPKSESAQGEAAAGAMAGRGGGAMRGRGGRGMRRR

SEQ ID NO: 7015 - protein, 560 aa, Saccharum officinarum
MASMMQPQIILLKEGTDTSQGRAQVVSNINACTAVGDTVRTTLGPRGMDKLIHDDKGGVTISNDGATIMRLLDIVHPAAKILVDIAKSQDSEVGDGTTTVVLLASEFLKEAKPYIEDGVHPHSLIRSYRTAGNMAIQRVKELAVSIEGKSLEEKKTLLAKCAATTLSSKLIGGEKEFFASMVVDAVLAIGNDDRLNLIGIKKVPGGTMRDSFLVNGVAFKKTFSYAGFEQQPKKFLKPKILLLNIELELKSEKENAEIRLSDPLQYQSIVDAEWNIIYDKLDKCVKSGAKIVLSRLAIGDLATQYFADRDIFCAGRVTEEDLQRVAAATGGTVQTSVNNVIDEVLGSCEVFEEKQVGNERFNIFSGCPSGQTATIVLRGGADQFIEEAERSLHDAIMIVRRALKNSTVVPGGGAIDMEISKYLRQHARTIAGKSQFFVNSFAKALEVIPRQLCDNAGFDATDVLNKLRQKHASGEGANYGVDINTGGIADSFANFVWEPAVVKINAINAATEASCLILSVDETVKNPKSESAQGEAAAGAMAGRGGGAMRGRGGRGMRRR

SEQ ID NO: 7016 - protein, 560 aa, Zea mays
MSAMMQPQIILLKEGTDTSQGRAQVVSNINACTAVGDTVRTTLGPRGMDKLIHDDKGGVTISNDGATIMRLLDIVHPAAKILVDIAKSQDSEVGDGTTTVVLLAAEFLKEAKPYIEDGVHPHSLIRSYRTAGNMAIQRVKELAVSIEGKSLEEKKSLLAKCAATTLSSKLIGGEKEFFASMVVDAVLAIGNDDRLNLIGIKKVPGGTMRDSFLVNGVAFKKTFSYAGFEQQPKKFLNPKILLLNIELELKSEKENAEIRLSDPLQYQSIVDAEWNIIYDKLDKCVKSGAKIVLSRLAIGDLGTQYFADRDIFCAGRVTEEDLQRVAAATGGTVQTSVNNVINDVLGSCEVFEEKQVGNERFNIFSGCPSGQTATIVLRGGADQFIEEAERSLHDAIMIVRRALKNSTVVPGGGAIDMEISKYLRQHARTIAGKSQFFVNSFAKALEVIPRQLCDNAGFDATDVLNKLRQKHASGEGANYGVDINTGGIADSFANFVWEPAVVKINAINAATEASCLILSVDETVKNPKSESAQGEAAAGAMAGRGRGAMRGRGGRGMRRR

SEQ ID NO: 7017 - protein, 557 aa, Brachypodium distachyon
MSAMMQPQIILLKEGTDTSQGRAQVVSNISACTAVADTVRTTLGPRGMDKLIHDDKGTTISNDGATIMRILDIVHPAAKILVDIAKSQDSEVGDGTTTVVLLAAEFMKEAKPYVEDGVHPHSLIRSYRTAGNMAIQRVKELAVSIEGKSLEEKKSLLAKCAATTLSSKLIGGEKDFFASMVVDAVLAIGHDDRLNLIGIKKVPGGTMRDSFLVSGVAFKKTFSYAGFEQQPKKFLNPKILLLNIELELKSEKENAEIRLSDPLQYQSIVDAEWNIIYDKLDKCVKSGAKIVLSRLAIGDLATQYFADRDIFCAGRVTEEDLQRVSSATGGTVQTSVNNVIDEVLGTCEVFEEKQVGNERFNIFSGCPSGQTATIVLRGGADQFIEEAERSLHDAIMIVRRAVKNSTVVPGGGAIDMEISKYLRQHARTIAGKSQFFVNSFAKALEVIPRQLCDNAGFDATDVLNKLRQKHASGDGANYGVDVNTGGIADAFANFVWEPAVVKINAINAATEAACLILSVDETVKNPKSESAQGDAAAMGGRGGGATRGRGGRGMRRR

SEQ ID NO: 7018 - protein, 560 aa, Oryza sativa
MASMMQPQIILLKEGTDTSQGRAQVVSNINACTAVADTVRTTLGPRGMDKLIHDDKGGTTISNDGATIMRLLDIIHPAAKILVDIAKSQDSEVGDGTTTVVLLAAEFLKEAKPYIEDGVHPHSLIRSYRTAGHLAIEKVKDLATSIEGKSLEEKKELLAKCAATTLSSKLIGGEKEFFASMVVDAVLAISNDDRLNLLGIKKVPGGTMRDSFLVNGVAFKKTFSYAGFEQQPKKFLSPKILLLNIELELKSEKENAEIRLSDPLQYQSIVDAEWNIIYDKLDKCVKSGAKIVLSRLAIGDLATQYFADRDIFCAGRVAEEDLQRVAAATGGTVQTSVNNVIDEVLGTCEVFEERQVGNERFNIFSGCPSGQTATIVLRGGADQFIEEAERSLHDAIMIVRRALKNSTVVPGGGAIDMEISKYLRQHARTIAGKSQFFVNSFAKALEVIPRQLCDNAGFDATDVLNKLRQKHASGEGANFGVDINTGGIADSFANFVWEPAVVKINAINAATEAACLILSVDETVKNPKSESAQGDAAASAMAGRGGGAMRGRGGRGMRRR

SEQ ID NO: 7019 - protein, 557 aa, Lolium multiflorum
MSSMMQPQIILLKEGTDTSQGRGQMLSNISACTAVADTVRTTLGPRGMDKLIHDDKGTTISNDGATIMRLLDIIHPAAKVLVDIAKSQDSEVGDGTTTVVLLASEFMKEAKPYVEDGVHPHSLIRSYRMAGNMAIQRVKELAVSIEGKSLEEKKSLLAKCAATTLSSKLIGGEKEFFASMVVDAVLAIGHDDRLNLIGIKKVPGGTMRDSFLVNGVAFKKTFSYAGFEQQPKKFLNPKILLLNIELELKSEKENAEIRLSDPLQYQSIVDAEWNIIYDKLDKCVQSGAKIVLSRLAIGDLATQYFADRDIFCAGRVTEEDLQRVSSASGGTVQTSVNNVIDEVLGTCEVFEEKQVGNERFNIFSGCPSGQTATIVLRGGADQFIEEAERSLHDAIMIVRRAVKNSTVVPGGGAIDMEISKYLRQHARTIAGKSQFFVNSFAKALEVIPRQLCDNAGFDATDVLNKLRQKHASGDGANYGVDINTGGIADSFANFVWEPAVVKINAINAATEAACLILSVDETVKNPKSESAQGDAAAMGGRGGGGMRGRGGRGMRRR

SEQ ID NO: 7020 - protein, 558 aa, Avena sativa
MSAMMQPQIILLKEGTDTSQGRGQMLSNISACTAVADTVRTTLGPRGMDKLIHDDKGVTTISNDGATIMRLLDIIHPAAKVLVDIAKSQDSEVGDGTTTVVLLASEFMKEAKPYVEDGVHPHSLIRSYRIAGNMAIQRVKELAVSIEGKSLEEKKSLLAKCAATTLSSKLIGGEKEFFADMVVEAVLAIGHDDRLNLIGIKKVPGGTMRDSFLVNGVAFKKTFSYAGFEQQPKKFLNPKILLLNIELELKSEKENAEIRLSDPLQYQSIVDAEWNIIYDKLDKCVQSGAKIVLSRLAIGDLATQYFADRDIFCAGRVTEEDLQRVSSASGGTVQTSVNNVIDEVLGTCEVFEEKQVGNERFNIFSGCPSGQTATIVLRGGADQFIEEAERSLHDAIMIVRRAVKNSTVVPGGGAIDMEISKYLRQHARTIAGKSQFFVNSFAKALEVIPRQLCDNAGFDATDVLNKLRQKHASGDGANYGVDINTGGIADSFANFVWEPAVVKINAINAATEAACLILSVDETVKNPKSESAQGDAAAMGGRGGGGMRGRGGRGMRRR

SEQ ID NO: 7021 - protein, 558 aa, Avena sativa
MSAMMQPQIILLKEGTDTSQGRGQMLSNISACTAVADTVRTTLGPRGMDKLIHDDKGVTTISNDGATIMRLLDIIHPAAKVLVDIAKSQDSEVGDGTTTVVLLASEFMKEAKPYVEDGVHPHSLIRSYRIAGNMAIQRVKELAVSIEGKSLEEKKSLLAKCAATTLSSKLIGGEKEFFADMVVEAVLAIGHDDRLNLIGIKKVPGGTMRDSFLVNGVAFKKTFSYAGFEQQPKKFLNPKILLLNIELELKSEKENAEIRLSDPLQYQSIVDAEWNIIYDKLDKCVQSGAKIVLSRLAIGDLATQYFADRDIFCAGRVTEEDLQRVSSASGGTVQTSVNNVIDEVLGTCEIFEEKQVGNERFNIFSGCPSGQTATIVLRGGADQFIEEAERSLHDAIMIVRRAVKNSTVVPGGGAIDMEISKYLRQHARTIAGKSQFFVNSFAKALEVIPRQLCDNAGFDATDVLNKLRQKHASGDGANYGVDINTGGIADSFANFVWEPAVVKINAINAATEAACLILSVDETVKNPKSESAQGDAAAMGGRGGGGMRGRGGRGMRRR

SEQ ID NO: 7022 - protein, 560 aa, Setaria italica
MSAMLQPQVILLKEGTDTSQGKAQMVSNINACTAVVDTVRTTLGPRGMDKLIHDDKGGVTISNDGATIMRLLDIVHPAANILVDIARSQDSEVGDGTTTVVLLAGEFLKEAKPYIEDGVHPHSLIRSYRTAGHLATEKVKELAVSIEGKSLEEKKILLAKCAATTLSSKLIGGEKEFFASMVVDAVLAIGNDDRLNMIGIKKVPGGTMRDSFLVNGVAFKKTFSYAGFEQQPKKFLNPKILLLNIELELKSEKENAEIRLSDPLQYQSIVDAEWNIIYDKLDKCVKSGAKIVLSRLAIGDLATQYFADRDIFCAGRVTEEDLQRVAAATGGFVQTSVNNVIDEVLGSCEVFEERQVGNERFNIFSGCPSGQTATIVLRGGADQFIEEAERSLHDAIMIVRRALKNSTVVPGGGAIDMEVSKYLRQHARTIAGKSQFFVNSFAKALEVIPRQLCDNAGFDATDVLNKLRQKHASGEGANYGVDINTGGIADSFANFVWEPAVVKINAINAATEAACLILSVDETVKNPKSESAQGDAAAMGGRGRGGAAMRGRGGRGMRRR

SEQ ID NO: 7023 - protein, 557 aa, Leymus cinereus x Leymus triticoides
MSSMMQPQIILLKEGTDTSQGRAQVVSNISACTAVADTVRTTLGPRGMDKLIHDDKGTTISNDGATIMRLLDIVHPAAKILVDIAKSQDSEVGDGTTTVVLLAAEFMKEAKPYVEDGVHPHSLIRSYRSAGNMAIERVKELAVSIEGKSLEDKKSLLAKCAATTLSSKLISGEKEFFASMVVDAVLAIGHDDRLNLIGIKKVPGGTMRDSFLVNGVAFKKTFSYAGFEQQPKKFLNPKILLLNIELELKSEKENAEIRLSDPLQYQSIVDAEWNIIYDKLDKCVQSGAKIVLSRLAIGDLATQYFADRDIFCAGRVTEEDLQRLSSATGGTVQTSVNNVIDEVLGTCELFEEKQVGNERFNIFSGCPSGQTATIVLRGGADQFIEEAERSLHDAIMIVRRAVRNSTVVPGGGAIDMEISKYLRLHARTIAGKSQFFVNSFAKALEVIPRQLCDNAGFDATDVLNKLRQKHAADGGANYGVDINTGGIADSFANFVWEPAVVKINAINAATEAACLILSVDETVKNPKSESAQGDAAAMGGRGGGAMRGRGGRGMRRR

SEQ ID NO: 7024 - protein, 557 aa, Hordeum vulgare
MSSMMQPQIILLKEGTDTSQGRAQVVSNISACTAVADTVRTTLGPRGMDKLIHDDKGTTISNDGATIMRLLDIVHPAAKILVDIAKSQDSEVGDGTTTVVLLAAEFMKEAKPYVEDGVHPHSLIRSYRSAGNMAIERVRELAVSIEGESLEEKKSLLAKCAATTLSSKLISGEKEFFASMVVDAVLAIGHDDRLNLIGIKKVPGGTMRDSFLVNGVAFKKTFSYAGFEQQPKKFLNPKILLLNIELELKSEKENAEIRLSDPMQYQSIVDAEWNIIYDKLDKCVQSGAKIVLSRLAIGDLATQYFADRDIFCAGRVTEEDLQRLSSATGGTVQTSVNNVIDEVLGTCEVFEEKQVGNERFNIFSGCPSGQTATIVLRGGADQFIEEAERSLHDAIMIVRRAVRNSTVVPGGGAIDMEISKYLRLHARNIAGKSQFFVNSFAKALEVIPRQLCDNAGFDATDVLNKLRQKHATDGGANYGVDINTGGIADSFANFVWEPAVVKINAINAATEAACLILSVDETVKNPKSESAQGDAAAMGGRGGGGMRGRGGRGMRRR

SEQ ID NO: 7025 - protein, 557 aa, Triticum aestivum
MSSMMQPQIILLKEGTDTSQGRAQVVSNISACTAVADTVRTTLGPRGMDKLIHDDKGTTISNDGATIMRLLDIVHPAAKILVDIAKSQDSEVGDGTTTVVLLAAEFMKEAKPYVEDGVHCHNIIRSYRSAGNMAIERVKELAVSIEGKSLEEKKSLLAKCAATTLSSKLISGEKEFFASMVVDAVLAIGHDDRLNLIGIKKVPGGTMRDSFLVNGVAFKKTFSYAGFEQQPKKFLNPKILLLNIELELKSEKENAEIRLSDPLQYQSIVDAEWNIIYDKLDKCVQSGAKIVLSRLAIGDLATQYFADRDIFCAGRVTEEDLQRLSSATGGTVQTSVNNVIDEVLGTCEIFEEKQVGNERFNIFSGCPSGQTATIVLRGGADQFIEEAERSLHDAIMIVRRAVRNSTVVPGGGAIDMEISKHLRLHARSIAGKSQVFVNSFAKALEVIPRQLCDNAGFDATDVLNKLRQKHAADGGANYGVDINTGGIADSFANFVWEPAVVKINAINAATEAACLILSVDETVKNPKSESAQGDAAAMGGRGGGGMRGRGGRGMRRR

SEQ ID NO: 7026 - protein, 549 aa, Secale cereale
MSSMMQPQIILLKEGTDTSQGRAQVVSNISACTAVADTVRTTLGPRGMDKLIHDDKGTTISNDGATIMRLLDIVHPAAKILVDIAKSQDSEVGDGTTTVVLLAAEFMKEAKPYVEDGVHPHSLIRSYRSAGNMAIARVKELAVSIEGKSLEEKKSLLAKCAATTLSSKLISGEKEFFASMVVDAVLAIGHDDRLNLIGIKKVPGGTMRDSFLVNGVAFKKTFSYAGFEQQPKKFLNPKILLLNIELELKSEKENAEIRLSDPMQYQSIVDAEWNIIYDKLDKCVQSGAKIVLSRLAIGDLATQYFADRDIFCAGRVTEEDLQRLSSATGGTVQTSVNNVIDEVLGTCEVFEEKQVGNERFNIFSGCPSGQTATIVLRGGADQFIEEAERSLHDAIMIVRRAVRNSTVVPGGGAIDMEISKYLRLHARTIAGKSQFFVNSFAKALEVIPRQLCDNAGFDATDVLNKLRQKHAADGGANYGVDINTGGIADSFANFVWEPAVVKINAINAATEAACLILSVDETVKNPKSESAQGDAAAMGGRGGGAMRGR

SEQ ID NO: 7027 - protein, 562 aa, Elaeis guineensis
MAAMLQPQIILLKEGTDTSQGRAQVVSNINACTAVADAVRTTLGPRGMDKLIHDDKGNTTISNDGATIMKLLDIIHPAAKILVDIAKSQDSEVGDGTTTVVLLAGEFLKEAKPFIEDGVHPQNLIRSYRTASYLAIDKIKELAVSIEGKSLEEKKTLLAKCAATTLSSKLIGGEKEFFASMVVDAVMAIGNDDRLNLIGIKKVPGGNMRDSFLVNGVAFKKTFSYAGFEQQPKKFLNPKILLLNIELELKSEKENAEIRLSDPMQYQSIVDAEWNIIYDKLDKCVKSGAKIVLSRLAIGDLATQYFADRDIFCAGRVTEEDLQRVAAATGGTVQTSVNNIIDEVLGSCEVFEEKQVGNERFNIFSGCPSGQTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHASGEGVNYGVDINTGGIADSFANFVWEPAVVKINAINAATEAACLILSVDETVKNPKSESAQGEAAANAMAGRGRGGAAFRGRGGRGMRRR

SEQ ID NO: 7028 - protein, 562 aa, Cocos nucifera
MAAMLQPQIILLKEGTDTSQGRAQVVSNINACTAVADAVRTTLGPRGMDKLIHDDKGNTTISNDGATIMKLLDIVHPAAKILVDIAKSQDSEVGDGTTTVVLLAGEFLREAKPFIEDGVHPQNLIRSYRTASYLAIDKIKELAVSIEGKSLEEKKTLLAKCAATTLSSKLIGGEKEFFASMVVDAVMAIGNDDRLNLIGIKKVPGGNMRDSFLVNGVAFKKTFSYAGFEQQPKKFLNPKILLLNIELELKSEKENAEIRLSDPVQYQSIVDAEWNIIYDKLDKCVKSGAKIVLSRLAIGDLATQYFADRDIFCAGRVTEEDLRRVAAATGGTVQTSVNNIIDEVLGSCEVFEERQVGNERFNIFSGCPSGQTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHASGEGVNYGVDINTGGIADSFANFVWEPAVVKINAINAATEAACLILSVDETVKNPKSESAQGEAAANAMAGRGRGGAAFRGRGGRGMRRR

SEQ ID NO: 7029 - protein, 560 aa, Musa acuminata
MAAMLQPQIILLKEGTDTSQGKAQVVSNINACTAVADAVRTTLGPRGMDKLIHDEKGSTTISNDGATIMKLLDIVHPAAKILVDIAKSQDSEVGDGTTTVVLLAGEFLKEAKPFIEDGVHPQNLIRSYRTASFLAINKIKEIAVSIEGKSLEEKKSLLAKCAATTLSSKLIGGEKEFFASMVVDAVLAIGNDDRLNLIGIKKVPGGNMRDSFLVNGVAFKKTFSYAGFEQQPKKFLNPKILLLNIELELKSEKENAEIRLSDPLQYQSIVDAEWNIIYDKLDKCVKSGAKIVLSRLAIGDLATQYFADRDIFCAGRVTEEDLQRVAAATGGTVQTSVNNVIDEVLGSCEVFEERQVGNERFNIFNGCPSGQTATIVLRGGADQFIDEAERSLHDAIMIVRRALKNSTIVPGGGAIDMELSRYLRLHARTIAGKSQLFINSYAKALEVIPRQLCDNAGFDSTDVLNKLRQKHASGEGANFGVEINTGGIADSFANFVWEPAVVKINAINAATEAACLILSVDETVKNPKSESAQGEAAANAMAGRGGPAFRGRGGRGMRRR

SEQ ID NO: 7030 - protein, 561 aa, Cocos nucifera
MAAMLQPQIILLKEGTDTSQGRAQVVSNINACTAVADAVRTTLGPRGMDKLIHDDKGNTTISNDGATIMKLLDIVHPAAKILVDIAKSQDSEVGDGTTTVVLLAGEFLREAKPFIEDGVHPQNLIRSYRTASYLAIDKIKELAVSIEGKSLEEKKTLLAKCAATTLSSKLIGGEKEFFASMVVDAVMAIGNDDRLNLIGIKKVPGGNMRDSFLVNGVAFKKTFSYAGFEQQPKKFLNPKILLLNIELELKSEKENAEIRLSDPVQYQSIVDAEWNIIYDKLDKCVKSGAKIVLSRLAIGDLATQYFADRDIFCAGRVTEEDLRRVAAATGGTVQTSVNNIIDEVLGSCEVFEERQVGNERFNIFSGCPSGQTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHASGEGANYGVDINTGGIADSFANFVWEPAVVKINAINAATEAACLILSVDETVKNPKSEGAQGEAAANAMAGRGHAAALRGCGGRGMRRR

SEQ ID NO: 7031 - protein, 562 aa, Ananas comosus
MAAMLQPQIILLKEGTDASQGKAQLVSNINACTAVADAVRTTLGPRGMDKLIHDDKGNTTISNDGATIMKLLDIVHPAAKILVDIAKSQDSEVGDGTTTVVLLAAEFLKEAKPFIEDGVHSQNLIRSYRTASYLAIDKIKELAVSIEGKSLEEKKSLLAKCAATTLSSKLIGGEKEFFASMVVDAVLAIGNDDRLNLIGIKKVPGGNMRDSFLVNGVAFKKTFSYAGFEQQPKKFLNPKILLLNIELELKSEKENAEIRLSDPLQYQSIVDAEWNIIYDKLDKCVQSGAKIVLSRLAIGDLATQYFADRDIFCAGRVTEEDLQRVAAATGGTVQTSVNNIIDEVLGSCEVFEEKQVGNERFNIFSGCPSGQTATIVLRGGADQFIEEAERSLHDAIMIVRRALKNSTVVPGGGAIDMEISRFLRLHARTIAGKSQLFINSYAKALEVIPRQLCDNAGYDATDVLNKLRQKHASGEGANYGVDINTGGIADSFANFVWEPAVVKINAINAATEAACLILSVDETVKNPKSESAQGEAAASAMAGRGRGGAAFRGRGGRGMRRR

SEQ ID NO: 7032 - protein, 562 aa, Musa acuminata
MAAMMQPQIILLKEGTDTSQGKAQVVSNINACTAVADAVRTTLGPRGMDKLIHDDKGNTTISNDGATIMKLLDIIHPAAKILVDIAKSQDSEVGDGTTTVVLLAGEFLKEAKPFIEDGVHPQNLIRSYRTASSLAINKIKELAVSIEGKSLEEKKSLLAKCAATTLSSKLIGGEKEFFASIVVDAVLAIGNDDRLNMIGIKKVPGGNMRDSFLVNGVAFKKTFSYAGFEQQPKKFVNPKILLLNIELELKSEKENAEIRLSDPLQYQSIVDAEWNIIYDKLDKCVKSGAKIVLSRLAIGDLATQYFADRDIFCAGRVTEEDLQRVAAATGGTVQTSVNNIIDEILGSCEVFEERQVGNERFNIFNGCPSGQTATIVLRGGADQFIDEAERSLHDAIMIVRRALKNSTIVPGGGAIDMELSRYLRQHARTIAGKSQLFINSYAKALEVIPRQLCDNAGFDSTDVLNKLRQKHASGEGSNYGVDINTGGIADSFANFVWEPAVVKINAINAATEASCLILSVDETVKNPKSESAQGEAAASAMMGRGQGGPAFRGRGGRGMRRR

SEQ ID NO: 7033 - protein, 562 aa, Cocos nucifera
MAAMLQPQIILLKEGTDTSQGKAQVVSNINACTAVTDAVRTTMGPRGMDKLIHDDKGHTTISNDGATIMKLLDIVHPAAKILVDIAKSQDSEVGDGTTTVVLLAGEFLKEAKPFIEDGVHSQNLIQSYRAASYLAIDKIKELAVSIEGKSLVEKKTLLAKCAATTLSSKLIGGEKEFFASMVVDAVMAIGNDDRLNLIGIKKVPGGNMRDSFLVNGVAFKKTFSYAGFEQQPKKFLNPKILLLNIELELKSEKENAEIRLSDPVQYQSIVDAEWNIIYDKLDKCVKSGAKIVLSRLAIGDLATQYFADRDIFCAGRVTEEDLRRVAAATGGTVQTSVNNIIDEVLGSCEVFEERQVGNERFNIFSGCPSGQTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHASGEGVNYGVDINTGGIADSFANFVWEPAVVKINAINAATEAACLILSVDETVKNPKSESAQGEAAANAMAGRGRGGAAFRGRGGRGMRRR

SEQ ID NO: 7034 - protein, 562 aa, Theobroma cacao
MAAMLQPQIILLKEGTDTSQGKAQLVSNINACTAVADVVRTTLGPRGMDKLIHDDKGNVTISNDGATIMKLLDIVHPAAKILVDIAKSQDSEVGDGTTTVVLLAGEFLKEAKPFVEDGVHPQNLIRSYRTACYLAIEKVKELAVSIEGKSLEEKKSLLAKCAATTLSSKLIGGEKEFFASMVVDAVIAIGNDDRLNLIGVKKVPGGTMRDSFLVNGVAFKKTFSYAGFEQQPKKFLNPKILLLNIELELKSEKENAEIRLSDPSQYQSIVDAEWNIIYDKLDKCVKSGAKVVLSRLAIGDLATQYFADRDIFCAGRVAEEDLQRVAAATGGTIQTSVNNIIDEVLGTCEVFEERQVGNERFNIFSGCPSGRTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHALPSGEGAPYGVDINTGGIEDSFANFVWEPSVVKINAINAATEAACLILSVDETVKNPKSESAQGEAAASAMAGRGHGGGFRGRGRGMRRR

SEQ ID NO: 7035 - protein, 561 aa, Elaeis guineensis
MAAMLQPQIILLKEGTDTSQGKAQVVSNINACTAVADAVRTTLGPRGMDKLIHDDKGNTTISNDGATIMKLLDIVHPAAKILVDIAKSQDSEVGDGTTTVVLLAGEFLKEAKPFIEDGVHSQNLIRSYRIASYLAIDKIKELAVSIEGKSLEEKKTLLAKCAATTLSSKLIGGEKEFFASMVVDAVMAIGSDDRLNLIGIKKVPGGNMRDSFLVNGVAFKKTFSYAGFEQQPKKFLNPKILLLNIELELKSEKENAEIRLSDPLQYQSIVDAEWNIIYNKLDKCVQSGAKIVLSRLAIGDLATQYFADRDIFCAGRVMEEDLQRVAAATGGTVQTSVNNIIDEVLGSCKVFEERQVGNERFNIFSGCPSGQTATIVLRGGADQFIEEAERSLHDAIMIVRRALKNSTVVAGGGAIDMEISRYLRQHARAIAGKSQLFINSYAKALEVIPRQLCDNAGFDATDILNKLRQKHASGQGANYGVDINTGGIADSFANFVWEPAVVKINAMNAATEAACLILSVDETVKNPKSESAQGEAAANAMAGRGRGAAFRGRGGRGMRRR

SEQ ID NO: 7036 - protein, 562 aa, Daucus carota
MSTMMQPQIILLKEGTDTSQGKAQLVSNINAVMAVADVVRTTLGPRGMDKLIHDDKGNTTISNDGATIMKLLDIVHPAAKILVDIAKSQDSEVGDGTTTVVLLAGEFLKEAKPFIEDGVHPQNLIRSYRTASYLAIEKIKELAVSIEGKSLDEKRSLLAKCAATTLSSKLIGGEKEFFASMVVDSVLAIGNDDRLNMIGIKKVPGGTMRDSFLVNGVAFKKTFSYAGFEQQPKKFENPKILLLNIELELKSEKENAEIRLSDPLQYQSIVDAEWNIIYDKLDKCVKSGAKIVLSRLAIGDLGTQYFADRDIFCAGRVAEEDLQRVAAATGGTVQTSVNNVIDEVLGSCEIFEEKQVGNERFNIFSGCPSGQTATIVLRGGADQFIEEAERSLHDAIMIVRRAMKNSTVVAGGGAIDMEISRYLRQHARTIAGKSQLFINSYAKALEVIPRQLCDNAGFDATDVLNKLRQKHALASGEGALYGVDINTGGIADSYANFVWEPAVVKINAINAATEAACLILSVDETVKNPKSESAQGEAAAGAMGRGRGGGALRGRGRGMRRR

SEQ ID NO: 7037 - protein, 562 aa, Allium cepa
MSSMLQPQIILLKEGTDTSQGKAQVISNINACTGVADCVRTTLGPRGMDKLIHDDKGNTTISNDGATIMKLLDIVHPAAKILVDIAKSQDSEVGDGTTTVVLLAGEFLKEAKPFIEDGVHPQNLIRSYRAASNLAINKVKELAVSIEGKSLEEKKSLLAKCAATTLSSKLIGGEKEFFATMVVDAVLAIGNDDRLNLIGIKKVPGGTMRDSFLVNGVAFKKTFSYAGFEQQPKKFLSPKILLLNVELELKSEKENAEIRLSDPLQYQSIVDAEWNIIYDKLDKCVQSGAKIVLSRLAIGDLATQYFADRDIFCAGRVAEEDLKRVAAATGGTVQTSVNNIIDEVMGCCEVFEERQVGNERFNIFSGCPSGQTATIVLRGGADQFIEEAERSLHDAIMIVRRAVKNSTVVAGGGAIDMEISGYLRQHARTIAGKSQLFINSFAKALEVIPRQLCDNAGFDATDVLNKLRQKHASGQGANYGVDINTGGITDSFANFVWEPSVVKINAINAAAEAACLILSVDETVKNPKSESAQGEAAGAMGGRGRGGAAFRGGRGGRGMRRR

SEQ ID NO: 7038 - protein, 560 aa, Capsicum annuum
MAAMMQPQIILLKEGTDTSQGKAQLVSNINACMAVADVVRTTLGPRGMDKLIHDDKGNTTISNDGATIMKLLDIIHPAAKILVDIAKSQDSEVGDGTTTVVLLAGEFLKEAKPFVEEGVHPQNLIRSYRTASNMAIEKVKELAVSIEGKSLEEKKSLLAKCAATTLSSKLIGGEKEFFASMVVDAVLAIGNDDRLNMIGIKKVPGGTMRDSFLVDGVAFKKTFSYAGFEQQPKKFVNPKILLLNIELELKSEKENAEIRLSDPAQYQSIVDAEWNIIYDKLDKCVKSGAKVVLSRLAIGDLATQYFADRDIFCAGRVSEEDLQRVAAAAGGTVQTTVNNVIDEVLGSCEIFEEKQVGNERFNIFSGCPSGKTATIVLRGGADQFIEEAERSLHDAIMIVRRAVKNSTVVPGGGAIDMEISRFLRQHARSIQGKSQLFINSYAKALEIIPRQLCDNAGFDATDVLNKLRQKHALASGEGAPYGVDINTGGIADSFANFVWEPAVVKINAINAATEAACLILSVDETVKNPKSESAQGDAAAGAMGGMGGRGRGRGRGMRRR

SEQ ID NO: 7039 - protein, 557 aa, Gossypium hirsutum
  Sequence also found in Organisms: Gossypium raimondii
MAAMLQPQIILLKEGTDTSQGKAQLVSNINACTAVADVVRTTLGPRGMDKLIHDDKGNVTISNDGATIMKLLDIVHPAAKILVDIAKSQDSEVGDGTTTVVLLAGEFLKEAKPFVEDGVHPQNLIRSYRTACYLAIDKIKELAVSIEGKSLEEKKSLLAKCAATTLSSKLIGGEKVFFASMVVDAVIAIGNDDRLNMIGIKKVPGGNMRDSFLVNGVAFKKTFSYAGFEQQPKKFLNPKILLLNIELELKSEKENAEIRLSDPSQYQSIVDAEWNIIYDKLDKCVKSGAKVVLSRLAIGDLATQYFADRDIFCAGRVAEEDLQRVAAATGGTVQTSVNNIIDEVLGTCEVFEEKQVGNERFNIFSGCPSGRTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHALPSGEGASYGVDINTGGIADSFTNFVWEPSVVKSNAINAATEAACLILSVDETVKNPKSESAQGEAAASAMAGRGRGRGRGMRRR

SEQ ID NO: 7040 - protein, 561 aa, Populus trichocarpa
MAAMMQPQIILLKEGTDTSQGKAQLLSNINACTAVADVVRTTLGPRGMDKLIHDDKGNVTISNDGATIMKLLDIIHPAAKILVDIAKSQDSEVGDGTTTVVLLAGEFLKEAKPFVEDGVHPQNLIRSYRTACNLAIEKVKELASSIEGKSLEEKKSLLAKCAATTLSSKLIGGEKEFFASMVVDAVIAIGNDDRLNMIGIKKVPGGNMRDSFLVNGVAFKKTFSYAGFEQQPKKFVNPKILLLNIELELKSEKENAEIRLSDPSQYQSIVDAEWNIIYDKLDKCAQSGAKIVLSRLAIGDLATQYFADRDIFCAGRVSEEDLQRVAAATGGTVQTTINNVIDEVLGTCEIFEEKQVGNERFNIFNGCPSGTTATIVLRGGADQFIEEAERSLHDAIMIVRRAMKNSTVVAGGGAIDMEISRYLRQHARTIAGKSQLFINSYAKALEVIPRQLCDNAGFDATDVLNKLRQKHALPSGEGAPYGVDINTGGIADSFANFVWEPAVVKINAINAATEAACLILSVDETVKNPKSESAQGEAAAGAMGGRGGGGFRGRGRGMRRR

SEQ ID NO: 7041 - protein, 563 aa, Castanea mollissima
MSAMMQPQIILLKEGTDTSQGKAQLVSNINACTAVADVVRTTLGPRGMDKLIHDDKGSVTISNDGATIMKLLDIVHPAAKILVDIAKSQDSEVGDGTTTVVLLAGEFLKEAKPFIEDGVHPQNLIRSYRIASNLALEKVKELAVSIEGKSLEEKKSLLAKCAATTLSSKLIGGEKEFFASMVVDAVIAIGHEDRLNMIGIKKVPGGNMRDSFLVNGVAFKKTFSYAGFEQQPKKFLNPKILLLNIELELKSEKENAEIRLSDPSQYQSIVDAEWNIIYDKLDKCVQSGAKVVLSRLAIGDLATQYFADRDIFCAGRVTEEDLRRVAAATGGTVQTSVNNVIDEVLGTCELFEERQVGNERFNIFSGCPSGLTATIVLRGGADQFIEEAERSLHDAIMIVRRAMKNSTVVAGGGAIDMEISRYLRQHARTIAGKSQLFINSYAKALEVIPRQLCDNAGFDATDVLNKLRQKHALQSGEGANYGVDINTGGITDSFANFVWEPAVVKINAINAATEAACLILSVDETVKNPKSESAQGEAAASAMGGRGRGGAGFRGRGRGMRRR

SEQ ID NO: 7042 - protein, 559 aa, Panax ginseng
MSAMMQPQIILLKEGTDTSQGKAQLVSNINACMVVADVVRTTLGPRGMDKLIHDDKGNTTISNDGATIMKLLDIVHPAAKILVDIAKSQDSEVGDGTTTVVLLAGEFLKEAKPFVEDGVHPQNLIRSYRTASYLAIEKIKELAVSIEGKSLEEKRSLLAKCAATTLSSKLIGGEKEFFASMVVDSVVAIGNDDRLNMIGIKKVPGGTMRDSFLVNGVAFKKTFSYAGFEQQPKKFGNPKILLLNIELELKSEKENAEIRLSDPLQYQSIVDAEWNIIYDKLDKCVKSGAKIVLSRLAIGDLATQYFADRDIFCAGRVSEEDLQRVAAATGGTVQTSVNNVIDEVLGSCELFEERQVGNERFNIFSGCPSGQTATIVLRGGADQFIEEAERSLHDAIMIVRRAMKNSTVVAGGGAIDMEISRYLRQHARTIAGKSQLFINSYAKALEVIPRQLCDNAGFDATDVLNKLRQKHALPSGEGALYGVDVNTGGIADSFANFVWEPAVVKINAINAATEAACLILSVDETVKNPKSESAQGEAAASAMGRGRGGGGRGRGMRRR

SEQ ID NO: 7043 - protein, 562 aa, Vitis vinifera
MAAMLQPQIILLKEGTDTSQGKAQLVSNISACTVVADVVRTTLGPRGMDKLIHDDKGNTTISNDGATIMKLLDIVHPAAKILVDIAKSQDSEVGDGTTTVVLLAGEFLKEAKPFIEDGVHPQNLIRSYRTASYLAIEKIKELAVSIEGKSLEEKKSLLAKCAATTLSSKLIGGEKEFFASMVVDSVIAIGNDDRLNMIGIKKVPGGTMRDSFLVNGVAFKKTFSYAGFEQQPKKFLNPKILLLNIELELKSEKENAEIRLSDPLQYQSIVDAEWNIIYDKLDKCVQSGAKIVLSRLAIGDLATQYFADRDIFCAGRVTEEDLQRVAAATGGTVQTTVNNIIDEVLGSCELFEERQVGNERFNIFSGCPSGQTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHALPSGEGGLFGVDINTGGIADSFANFVWEPAVVKINAINAATEAACLVLSVDETVKNPKSESAQGEAAASAMGGRGRGGAFRGRGRGMRRR

SEQ ID NO: 7044 - protein, 563 aa, Quercus alba
MSAMMQPQIILLKEGTDTSQGKAQLVSNINACTAVADVVRTTLGPRGMDKLIHDDKGSVTISNDGATIMKLLDIVHPAAKILVDIAKSQDSEVGDGTTTVVLLAGEFLKEAKPFIEDGVHPQNLIRSYRIASNLALEKVKELAVSIEGKSLEEKKSLLAKCAATTLSSKLIGGEKEFFASMVVDAVIAIGHEDRLNMIGIKKVPGGNMRDSFLVNGVAFKKTFSYAGFEQQPKKFLNPKILLLNIELELKSEKENAEIRLSDPSQYQSIVDAEWNIIYDKLDKCVQSGAKVVLSRLAIGDLGTQYFADRDIFCAGRVTEEDLHRVAAATGGTVQTSVNNVIDEVLGTCELFEERQVGNERFNIFSGCPSGLTATIVLRGGADQFIEEAERSLHDAIMIVRRAMKNSTVVAGGGAIDMEISRYLRQHARTIAGKSQLFINSYAKALEVIPRQLCDNAGFDATDVLNKLRQKHALQSGEGANYGVDINTGGIADSFANFVWEPAVVKINAINAATEAACLILSVDETVKNPKSESAQGEAAASAMGGRGRGGAGFRGRGRGMRRR

SEQ ID NO: 7045 - protein, 207 aa, Allium cepa
MSSMLQPQIILLKEGTDTSQDKAQVISNINACTGVADCVRTTLGPRGMDKLIHDDKGNTTISNDGATIMKLLDIVHPAAKILVDIAKSQDSEVGDGTTTVVLLAGEFLKEAKPFIEDGVHPQNLIRSYRAASNLAINKVKELAVSIEGKSLEEKKSLLAKCAATTLSSKLIGGEKEFFATMVVDAVLAIGNDDRLNLIGIKKFPVAP

SEQ ID NO: 7046 - protein, 562 aa, Petroselinum crispum
MSTMMQPQIILLKEGTDTSQGKAQLVSNINAVMAVADVVRTTLGPRGMDKLIHDDKGNTTISNDGATIMKLLDIVHPAAKILVDIAKSQDSEVGDGTTTVVLLAGEFLKEAKPFIEDGVHPQNLIRSYRTASYLAIEKIKELAVSIEGKSLDEKRSLLAKCAATTLSSKLIGGEKEFFASMVVDSVLAIGNDDRLNMIGIKKVPGGTMRDSFLVNGVAFKKTFSYAGFEQQPKKFENPKILLLNIELELKSEKENAEIRLSDPLQYQSIVDAEWNIIYDKLDKCVKSGAKIVLSRLAIGDLGTQYFADRDIFCAGRVAEEDLQRVAAATGGTVQTSVNNVINEVLGSCEIFEEKQVGNERFNIFSGCPSGQTATIVLRGGADQFIEEAERSLHDAIMIVRRAMKNSTVVAGGGAIDMEISRYLRQHARTIAGKSQLFINSYAKALEVIPRQLCDNAGFDATDVLNKLRQKHALASGEGALYGVDINTGGIADSYANFVWEPAVVKINAINAATEAACLILSVDETVKNPKSESAQGEAAASAMGRGRGGGALRGRGRGMRRR

SEQ ID NO: 7047 - protein, 558 aa, Solanum lycopersicum
  Sequence also found in Organisms: Solanum tuberosum
MSAMMQPQIILLKEGTDTSQGKAQLVSNINACMAVADVVRTTLGPRGMDKLIHDDKGNTTISNDGATIMKLLDIIHPAAKILVDIAKSQDSEVGDGTTTVVLLAGEFLKEAKPFVEEGVHPQNLIRSYRTASNMAIEKVKELAVSIEGKSLEEKKSLLAKCAATTLSSKLIGGEKEFFASMVVDAVLAIGTDDRLNMIGIKKVPGGTMRDSFLVNGVAFKKTFSYAGFEQQPKKFVNPKILLLNIELELKSEKENAEIRLSDPAQYQSIVDAEWNIIYDKLDKCVKSGAKVVLSRLAIGDLATQYFADRDIFCAGRVSEEDLQRVAAAAGGTVQTTVNNVIDEVLGSCEIFEEKQVGNERFNIFSGCPSGKTATIVLRGGADQFIEEAERSLHDAIMIVRRAVKNSTVVPGGGAIDMEISRFLRHHARTIQGKSQLFINSYAKALEIIPRQLCDNAGFDATDVLNKLRQKHALPSGEGAPYGVDINTGGIADSFANFVWEPAVVKINAINAATEAACLILSVDETVKNPKSESAQGDAAASAMGGGRGRGRGRGMRRR

SEQ ID NO: 7048 - protein, 565 aa, Musa acuminata
YLDLLVRWLQQPQIILLKEGTDTSQGKAQVVSNINACTAVADAVRTTLGPRGMDKLIHDEKGSTTISNDGATIMKLLDIVHPAAKILVDIAKSQDSEVGDGTTTVVLLAGEFLKEAKPFIEDGVHPQNLIRSYRTASFLAINKIKEIAVSIEGKSLEEKKSLLAKCAATTLSSKLIGGEKEFFASMVVDAVLAIGNDDRLNLIGIKKVPGGNMRDSFLVNGVAFKKTFSYAGFEQQPKKFLNPKILLLNIELELKSEKENAEIRLSDPLQYQSIVDAEWNIIYDKLDKCVKSGAKIVLSRLAIGDLATQYFADRDIFCAGRVTEEDLLRVAAATGGTVQTSVNNVIDEVLGSCEVFEERQVGNERFNIFNGCPSGQTATIVLRGGADQFIDEAERSLHDAIMIVRRALKNSTIVPGGGAIDMELSRYLRLHARTIAGKSQLFINSYAKALEVIPRQLCDNAGFDSTDVLNKLRQKHASGEGANFGVEINTGGIADSFANFVWEPAVVKINAINAATEAACLILSVDETVKNPKSESAQGEAAANAMAGRGGPAFRGRGGRGMRRR

SEQ ID NO: 7049 - protein, 555 aa, Chelidonium majus
MSSMMQPQIILLKEGTDTSQGKPQLISNINACTAVADVVRTTLGPRGMDKLIHDDKGNVTISNDGATIMKLLDIVHPAAKILVDIAKSQDSEVGDGTTTVVLLAGEFLKEAKPFIEDGVHPRNLIRSYRTASNLAIEKVKELAVSIEGKSLEEKKRLLAKCASTTLSSKLIGGEKEFFATMVVDAVIAIGIDDRLNLIGIKKVPGGTMRDSFLVNGVAFKKTFSYAGFEQQPKKFLNPKILLLNIELELKSEKENAEIRLSDPLQYQSIVDAEWNIIYDKLDKCVQSGAKIVLSRLAIGDLATQYFADRDIFCAGRVAEEDLQRVAAATGGTVQTSVNNVIDEVLGSCELFEERQVGNERFNIFSGCPSGQTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHALPSGEGALYGVDINSGGIVDSYANFVWEPAVVKINAINAATEAACLVLSVDETVKNPKSESAQGEAAAGAMGRGRGRGRGMRR

SEQ ID NO: 7050 - protein, 561 aa, Populus trichocarpa
MAAMMQPQIILLKEGTDTSQGKAQLVSNINACTAVADVVRTTLGPRGMDKLIHDDKGNVTISNDGATIMKLLDIIHPASKILVDIAKSQDSEVGDGTTTVVLLAGEFLKEAKPFVEEGVHPQNLIRSYRTACNLAIEKVKELAVSIEGKSLEEKKSLLAKCAATTLSSKLIGGEKEFFASMVVDAVIAIGNDDRLNMIGIKKVPGGTMRDSFLVNGVAFKKTFSYAGFEQQPKKFVNPKMLLLNIELELKSEKENAEIRLSDPSQYQSIVDAEWNIIYDKLDKCVQSGAKVVLSRLAIGDLATQYFADRDIFCAGRVSEEDLQRVSAASGGTVQTTVNNIIDEVLGTCEIFEEKQVGNERFNIFSGCPSGRTATIVLRGGADQFIEEAERSLHDAIMIVRRAMKNSTVVAGGGAIDMEISRYLRQHARTIAGKSQLFINSYAKALEVIPRQLCDNAGFDATDVLNKLRQKHALPSGEGAPYGVDINTGGIADSFSNFVWEPSVVKINAINAATEAACLILSVDETVKNPKSESAQGEAAAGAMGGRGGGGFRGRGRGMRRR

SEQ ID NO: 7051 - protein, 558 aa, Solanum phureja
MSAMMQPQIILLKEGTDTSQGKAQLVSNINACMAVADVVRTTLGPRGMDKLIHDDKGNTTISNDGATIMKLLDIIHPAAKILVDIAKSQDSEVGDGTTTVVLLAGEFLKEAKPFVEEGVHPQNLIRSYRTASNMAIEKVKELAVSIEGKSLEEKKSLLAKCAATTLSSKLIGGEKEFFASMVVDAVLAIGTDDRLNMIGIKKVPGGTMRDSFLVNGVAFKKTFSYAGFEQQPKKFVNPQILLLNIELELKSEKENAEIRLSDPAQYQSIVDAEWNIIYDKLDKCVKSGAKVVLSRLAIGDLATQYFADRDIFCAGRVSEEDLQRVAAAAGGTVQTTVNNVIDEVLGSCEIFEEKQVGNERFNIFSGCPSGKTATIVLRGGADQFIEEAERSLHDAIMIVRRAVKNSTVVPGGGAIDMEISRFLRHHARTIQGKSQLFINSYAKALEIIPRQLCDNAGFDATDVLNKLRQKHALPSGEGAPYGVDINTGGIADSFANFVWEPAVVKINAINAATEAACLILSVDETVKNPKSESAQGDAAASAMGGGRGRGRGRGMRRR

SEQ ID NO: 7052 - protein, 561 aa, Cocos nucifera
MAAMLQPQIILLKEGTDTSQGKAQVVSNINACTAVTDAVRTTMGPRGMDKLIHDDKGHTTISNDGATIMKLLDIVHPAAKILVDIAKSQDSEVGDGTTTVVLLAGEFLKEAKPFIEDGVHSQNLIQSYRAASYLAIDKIKELAVSIEGKSLVEKKTLLAKCAATTLSSKLIGGEKEFFASMVVDAVMAIGNDDRLNLIGIKKVPGGNMRDSFLVNGVAFKKTFSYAGFEQQPKKFLNPKILLLNIELELKSEKENAEIRLSDPIQYQSIVDAEWNIIYNKLDKCVQSGAKIILSRLAIGDLATQYFADRDIFCAGRVTEEDLQRVAAATGGTVQTSVNNIIDEVLGSCEVFVERQVGNERFNIFSGCPFGQTATIVLRGGADQFIEEAERSLHDAIMIVRRALKNSTVVAGGGAIDMEMSRCLRQHARAIAGKSQLFINSYAKALEVIPRQLCDNAGFDATDVLNKLRQKHASGEGANYGVDINTGGIADSFANFVWEPAVVKINAINAATEAACLILSVDETVKNPKSEGAQGEAAANAMAGRGHAAALRGCGGRGMRRR

SEQ ID NO: 7053 - protein, 560 aa, Lupinus angustifolius
MSSMMQPQIILLKEGTDTSQGKAQLVSNINACTAVADVVRTTLGPRGMDKLIHDDKGSVTISNDGATIMKLLDIVHPAAKILVDIAKSQDSEVGDGTTTVVLLAAEFLREAKPFIEDGVHSQNLIKSYRAASTLAIEKIKDLATSIEGKSLEEKKSLLAKCAATTLSSKLIGGEKEFFASMVVDAVIAIGYDDRLNMIGIKKVPGGTMRDSFLVNGVAFKKTFSYAGFEQQPKKFLNPKILLLNIELELKSEKENAEIRLSDPSQYQSIVDAEWNIIYDKLDKCVNSGAKVVLSRLAIGDLATQYFADRDIFCAGRVTEEDLKRVAAATGGTVQTSVNNVIDEVLGTCEVFEEKQVGNERFNLFSGCPSGQTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHALPSGEGAPYGVDIATGGIADSFANFVWEPAVVKINAINAATEAACLILSVDETVKNPKSESAQGDAAASAMGGRGRGGFRGRGRGMRR

SEQ ID NO: 7054 - protein, 563 aa, Amsonia hubrichtii
MATMMQPQIILLKEGTDTSQGKPQLVSNINACTAVADVVRTTLGPRGMDKLIHDEKGNTTISNDGATIMKLLDIIHPAAKILVDIAKSQDSEVGDGTTTVVLLAAEFLKEAKPFIEDGVHPQNLIRSYRAASHLAIEKVKELAVSIEGKSLEEKKSLLAKCAATTLSSKLIGGEKDFFAPMVVDAVLAIGNDDRLNMIGIKKVPGGTMRDSFLVNGVAFKKTFSYAGFEQQPKKFVNPKILLLNIELELKSEKENAEIRLTDPSQYQSIVDAEWNIIYDKLDKCVNSGAKIVLSRLAIGDLATQYFADRDIFCAGRVTEEDLNRVAAATGGTIQTTVNNVIDEVLGTCEYFEEKQVGNERFNIFSGCPLGQTATMVLRGGADQFIEEAERSLHDAIMIVRRALKNSTVVPGGGAIDMEISRYLRQHARTIAGKSQLFINSYAKALEVIPRQLCDNAGFDATDVLNKLRQKHALPSGEGAPYGVDINTGGISDSFANFVWEPAVVKINAINAATEAACLILSVDETVKNPKSESAQGEAAANAMGGRGRGGPAFRGRGRGMRRR

SEQ ID NO: 7055 - protein, 561 aa, Lupinus angustifolius
MASMMQPQIILLKEGTDTSQGKAQLVSNINACSAVADVVRTTLGPRGMDKLIHDDKGSVTISNDGATIMKLLDIVHPAAKILVDIAKSQDSEVGDGTTTVVLLAAEFLKEAKPFVEDGVHSQNLIKSYRAASTLAIEKVKELATSIEGKSLDEKKSLLSKCAATTLSSKLIGGEKEFFASMVVDAVIAIGYEDRLNMIGIKKVPGGTMRDSFLVNGVAFKKTFSYAGFEQQPKKFLNPKILLLNIELELKSEKENAEIRLSDPSQYQSIVDAEWNIIYDKLDKCVNSGAKVVLSRLAIGDLATQYFADRDIFCAGRVTEEDLKRVAAATGGTVQTSINNVIDEVLGTCEVFEEKQVGNERFNLFSGCPSGLTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHALPSGEGAAYGVDIATGGIADSFANFVWEPAVVKINAINAATEAACLILSVDETVKNPKSESAQGDAAASAMGGRGRGGGFRGRGRGMRR

SEQ ID NO: 7056 - protein, 461 aa, Vaccinium corymbosum
MTAMMQPQIILLKEGTDTSQGKAQLVSNINACMAVADVVRTTLGPRGMDKLIHDEKGNTTISNDGATIMKLLDIVHPAAKILVDIAKSQDSEVGDGTTTVVLLAGEFLKEAKPFIEDGVHPQNLIRSFRTAAYLAIEMVKELAQSIEGKSLEEKKSLLAKCAATTLSSKLIGGEKEFFASMVVDAVLAIGTDDRLNMIGIKKVPGGNMRDSFLVNGVAFKKTFSYAGFEQQPKKFVMPKILLLNIELELKSEKENAEIRLSDPSQYQSIVDAEWNIIYDKLDKCVKSGAKIVLSRLAIGDLGTQYFADRDIFCAGRVAEEDLQRVAAATGGTVQTSVNNIIDEVLGSCELFEERQVGNERFNIFSGCPSGQTATIVLRGGADQFIEEAERSLHDAIMIVRRALKNSTVVAGGGAIDMEISRYLRQHARTIAGKSQLFINSYAKALEVIPRQLCDNAGFDCD

SEQ ID NO: 7057 - protein, 157 aa, Amorphophallus konjac
MAAMLQPQIILLKEGTDTSQGKAQVVSNINACTAVADVVRTTLGPRGMDKLIHDDKGNTTISNDGATIMKLLDIVHPAAKILVDIAKSQDSEVGDGTTTVVLLAGEFLKEAKPFIEDGVHPQNLIRSYRTACNLAISKIKELAMSIEGKSLEEKRSC

SEQ ID NO: 7058 - protein, 558 aa, Daucus carota
MSTMMQPQIILLKEGTDTSQGKAQLVSNINACGAVADVVRTTLGPRGMDKLIHDDKGNTTISNDGATIMKLLDIVHPAAKILVDIAKSQDSEVGDGTTTVVLLAGEFLKEAKPFIEDGVHPQNLIRSYRTASYLAIEKIKELAVSIEGKSLDEKRSLLAKCAATTLSSKLIGGEKEFFASMVVDSVLAIGNDDRLNMIGIKKVPGGTMRDSFLVNGVAFKKTFSYAGFEQQPKKFENPEILLLNIELELKSEKENAEIRLSDPLQYQSIVDAEWNIIYDKLDKCVKSGAKIVLSRLAIGDLGTQYFADRDIFCAGRVAEEDLQRVAAATGGTVQTSVNNVIDEVLGTCEIFEEKQVGNERFNIFSGCPSGQTATIVLRGGADQFIEEAERSLHDAIMIVRRAMKNSTVVAGGGAIDMEISRYLRQHSRTIAGKSQLFINSYAKALEVIPRQLCDNAGFDATDVLNNLRQKHALTSGEGALYGVDINTGGIADSYANFVWEPAVVKINAINAATEAACLILSVDETVKNPKSESAQGEAAAGAMGRGRGGGRGRGMRRR

SEQ ID NO: 7059 - protein, 562 aa, Gossypium hirsutum
MASMLQPQIILLKEGTDTSQGKAQLVSNINACTAVADVVRTTLGPRGMDKLIHDDKGNVTISNDGATIMKLLDIVHPAAKILVDIAKSQDSEVGDGTTTVVLLAGEFLKEAKPFVEDGVHPQNLIRSYRTACNLAIVKIKELAVSIEGKSLEEKKSLLAKCAATTLSSKLIGGEKEFFASMVVDAVIAIGSEDRLNMIGIKKVPGGNMRDSFLVNGVAFKKTFSYAGFEQQPKKFMNPRILLLNIELELKSEKENAEIRLSDPSQYQSIVDAEWNIIYDKLDKCVKSGAKVVLSRLAIGDLATQYFADRDIFCAGRVAEEDLNRVAAATGGTIQTSVNNIIDEVLGTCEVFEEKQVGNERFNIFSGCPSGRTATIVLRGGADQFIEEAERSLHDAIMIVRRALKNSTVVAGGGAIDMEISRYLRQHARTIAGKSQLFINSYAKALEVIPRQLCDNAGFDATDVLNKLRHKHALPSGEGAPYGVEINTGGIADSFANFVWEPSVVKINAINAATEAACLILSVDETVKNPKSESAQGEAAASAMGGRGRGGGFPGRGRGMRRR

SEQ ID NO: 7060 - protein, 562 aa, Gossypium raimondii
MASMLQPQIILLKEGTDTSQGKAQLVSNINACTAVADVVRTTLGPRGMDKLIHDDKGNVTISNDGATIMKLLDIVHPAAKILVDIAKSQDSEVGDGTTTVVLLAGEFLKEAKPFVEDGVHPQNLIRSYRTACNLAIEKIKELAVSIEGKSLEEKKSLLAKCAATTLSSKLIGGEKEFFASMVVDAVIAIGSEDRLNMIGIKKVPGGNMRDSFLVNGVAFKKTFSYAGFEQQPKKFMNPRILLLNIELELKSEKENAEIRLSDPSQYQSIVDAEWNIIYDKLDKCVKSGAKVVLSRLAIGDLATQYFADRDIFCAGRVAEEDLNRVAAATGGTIQTSVNNIIDEVLGTCEVFEEKQVGNERFNIFSGCPSGRTATIVLRGGADQFIEEAERSLHDAIMIVRRALKNSTVVAGGGAIDMEISRYLRQHARTIAGKSQLFINSYAKALEVIPRQLCDNAGFDATDVLNKLRHKHALPSGEGAPYGVDINSGGIADSFANFVWEPSVVKINAINAATEAACLILSVDETVKNPKSESAQGEAAASAMGGRGRGGGFPGRGRGMRRR

SEQ ID NO: 7061 - protein, 559 aa, Petroselinum crispum
MSTMMQPQIILLKEGTDTSQGKAQLVSNINAVMAVADVVRTTLGPRGMDKLIHDDKGNTTISNDGATIMKLLDIVHPAAKILVDIAKSQDSEVGDGTTTVVLLAGEFLKEAKPFIEDGVHPQNLIRSYRTASYLAIEKIKELAVSIEGKSLDEKRSLLAKCAATTLSSKLIGGEKEFFASMVVDSVLAIGNDDRLNMIGIKKVPGGTMRDSFLVNGVAFKKTFSYAGFEQQPKKFENPKILLLNIELELKSEKENAEIRLSDPLQYQSIVDAEWNIIYDKLDKCVKSGAKIVLSRLAIGDLGTQYFADRDIFCAGRVAEEDLQRVAAATGGTVQTSVNNVIDEVLGTCEIFEEKQVGNERFNIFSGCPSGQTATIVLRGGADQFIEEAERSLHDAIMIVRRAMKNSTVVAGGGAIDMEISRYLRQHSRTIAGKSQLFINSYAKALEVIPRQLCDNAGFDATDVLNNLRQKHALASGEGALYGVDINTGGIADSYAHFVWEPAVVKINAINAATEAACLILSVDETVKNPKSESAQGEAAASAMGRGRGGGGRGRGMRRR

SEQ ID NO: 7062 - protein, 557 aa, Arabidopsis thaliana
MASMMQPQIILLKEGTDTSQGKAQLVSNINACTAVGDVVRTTLGPRGMDKLIHDDKGSVTISNDGATIMKLLDIVHPAAKILVDIAKSQDSEVGDGTTTVVLLAAEFLKEAKPFIEDGVHAQNLIRSYRTASTLAIAKVKELAVSIEGKSVEEKKGLLAKCAATTLSSKLIGGEKEFFATMVVDAVMAIGNDDRLNLIGIKKVPGGNMRDSFLVDGVAFKKTFSYAGFEQQPKKFLNPKILLLNIELELKSEKENAEIRLSDPSQYQSIVDAEWNIIYDKLDKCVESGAKVVLSRLAIGDLATQYFADRDIFCAGRVAEEDLNRVAAAAGGTVQTSVNNIIDEVLGTCEIFEEKQVGGERFNIFSGCPSGRTATIVLRGGADQFIEEAERSLHDAIMIVRRAVKNSTVVPGGGAIDMEISKYLRQHSRTIAGKSQLFINSYAKALEVIPRQLCDNAGFDATDVLNKLRQKHAMQSGEGASYGVDINTGGIADSFANFVWEPAVVKINAINAATEAACLILSVDETVKNPKSESAQGDAAGAMGRGRGGGRGRGMRRR

SEQ ID NO: 7063 - protein, 562 aa, Cucumis sativus
MAAMLQPQIILLKEGTDTSQGKAQLVSNINACTAVADVVRTTLGPRGMDKLIHDDKGNVTISNDGATIMKLLDIVHPAAKILVDIAKSQDSEVGDGTTTVVLLAAEFLKEAKPFIEDGVHSQNLIRSYRTASYLAIEKVKELAISIEGKSLEEKKSLLAKCAATTLSSKLIGGEKDFFASMVVDSVIAIGNEDRLNMIGIKKVPGGTMRDSFLVNGVAFKKTFSYAGFEQQPKKFSNPKILLLNIELELKSEKENAEIRLSDPSQYQSIVDAEWNIIYEKLDKCVESGAKVVLSRLAIGDLGTQYFADRDIFCAGRVAEEDLQRVAAATGGTIQTSVNNVIDEVLGTCEVFEEKQVGNERYNIFSGCPSGRTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHAHPSGEGAPYGVDINTGGVADSFANFVWEPAVVKINAINAATEAACLILSVDETVKNPKSESAQGEAAASAMGGRRGGAAFRGRGRGMRRR

SEQ ID NO: 7064 - protein, 563 aa, Arachis hypogaea
MAAMLQPQIILLKEGTDTSQGKAQLVSNINACTAVADVVRSTLGPRGMDKLIHDDKGSVTISNDGATIMKLLDIVHPAAKILVDIAKSQDSEVGDGTTTVVLLAAEFLKEAKPFIEDGVHSQNLIRSYRTACTLAIEKIKELAVSIEGKSLEEKKSLLAKCASTTLSSKLIGGEKEFFASMVVDAVIAIGNDDRLNMIGIKKVPGGNMRDSFLVNGVAFKKTFSYAGFEQQPKKFLNPKILLLNVELELKSEKENAEIRLSDPSQYQSIVDAEWNIIYDKLDKCVNSGAKVVLSRLAIGDLATQYFADRDIFCAGRVAEEDLKRVAAATGGTVQTSVNNIIDEVLGTCDVFEEKQVGNERFNIFSGCPSGQTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHALPSGEGAPYGVDISTGGIANSFTNFVWEPAIVKINAINAATEAACLILSVDETVKNPKSESAQGDAAASAMGGRGRGGAFRGRGRGRGMRR

SEQ ID NO: 7065 - protein, 555 aa, Phalaenopsis aphrodite
QPHIILLKEGTDTAQGKAQVVSNINACTAVADAVRSTLGPRGMDKLIHDDKGNTTISNDGATIMKLLDIIHPAAKILVDIAKSQDSEVGDGTTTVVLLAGEFLKEGKPFIEDGVHSQNLIRSYRTASHLAINKIKELAVSIEGKSLEEKKNLLAKCAETTLSSKLIGGEKEFFASMVVDAVVAIGNDDRLNLIGIKKVPGGNMRDSFLVNGVAFKKTFSYAGFEQQPKKFVNPKILLLNIELELKSEKENAEIRLSDPAQYQSIVDAEWNIIYDKLDKCVQSGAKIILSRLAIGDLATQYFADRDIFCAGRVTEEDLQRVAAATGGTVQTSVNNVIDEVLGSCELFEEKQVGNERFNIFSGCPSGQTATIVLRGGADQFIDEAERSLHDAIMIVRRAVKNSTVVAGGGAIDMELSRYLRQHARTIAGKSQLFINSYAKALEVIPRQLCDNAGFDATDVLNKLRQKHASGEGANYGVDINTGGIADSFANFVWEPSVVKINAINAATEAACLILSVDETVKNPKSESAQGEAAASAMAGRGRPAFGGRGGRGMRRR

SEQ ID NO: 7066 - protein, 558 aa, Triphysaria pusilla
MSSMLQPQIILLKEGTDTSQGKPQLISNMNACMAVADVVRTTLGPRGMDKLIHDDKGNTTISNDGATIMKLLDIVHPAAKILVDIAKSQDSEVGDGTTTVVLLAGEFLKEAKPFVEDGVHPQNLIRSYRTASSLAIEKIKELATSIEGKSLEEKKSLLAKCAATTLSSKLIGGEKEFFATMVVDAVLAIGNEDRLNMIGIKKVPGGTMRDSFLVNGVAFKKTFSYAGFEQQPKKFVNPKLLLLNIELELKSEKENAEIRLSDPLQYQSIVDAEWNIIYDKLDKCVKSGAKVVLSRLAIGDLATQYFADRDIFCAGRVTEEDLQRVAAATGGTVQTTVNNVIDEVLGSCDLFEEKQVGNERFNIFSGCPSGRTATIVLRGGADQFIEEAERSLHDAIMIVRRAVKNSTVVAGGGAIDMEISRYLRQHARTIAGKSQLFINSYAKALEVIPRQLCDNAGFDATDVLNKLRQKHALPSGEGAPYGVDINTGGIADSFANFVWEPAVVKINAINAATEAACLVLSVDETVKNPKSESAQGEAAMGRGGGGMRGRGGRGMRRR

SEQ ID NO: 7067 - protein, 557 aa, Triphysaria pusilla
MSAMLQPQIILLKEGTDTSQGKPQLISNMNACMAVADVVRTTLGPRGMDKLIHDDKGNTTISNDGATIMKLLDIVHPAAKILVDIAKSQDSEVGDGTTTVVLLAGEFLKEAKPFVEDGVHPQNLIRSYRTASSLAIEKIKELATSIEGKSLEEKKSLLAKCAATTLSSKLIGGEKEFFATMVVDAVLAIGNEDRLNMIGIKKVPGGTMRDSFLVNGVAFKKTFSYAGFEQQPKKFVNPKLLLLNIELELKSEKENAEIRLSDPLQYQSIVDAEWNIIYDKLDKCVKSGAKVVLSRLAIGDLATQYFADRDIFCAGRVTEEDLQRVAAATGGTVQTTVNNVIDEVLGSCDLFEEKQVGNERFNIFSGCPSGKTATIVLRGGADQFIEEAERSLHDAIMIVRRAVKNSTVVAGGGAIDMEISRYLRQHARTIAGKSQLFINSYAKALEVIPRQLCDNAGFDATDVLNKLRQKHALPSGEGAPYGVDINTGGIADSFANFVWEPAVVKINAINAATEAACLVLSVDETVKNPKSESAQGEAAMGRGRGGGGRGGRGMRRR

SEQ ID NO: 7068 - protein, 562 aa, Tripterygium wilfordii
MAAMMQPQIILLKEGTDTSQGKAQLVSNINACTAVADVVRTTLGPRGMDKLIHDDKGNVTISNDGATIMKLLDIVHPAAKILVDIAKSQDSEVGDGTTTVVLLAAEFLKEAKPFIEDGVHSQNLIRSYRTAGNLAISKVRELAVSIEGKSLEEKKSLLAKCAATTLSSKLIGGEKDFFASMVVDAVIAIGNEDRLNMIGIKKVPGGNMRDSFLVNGVAFKKTFSYAGFEQQPKKFLNPKILLLNIELELKSEKENAEIRLSDPSQYQSIVDAEWNIIYDKLDKCVQSGAKVVLSRLAIGDLATQYFADRDIFCAGRVAEEDLQRVGAAAGGTVQTTVNNVIDEVLGTCELFEERQVGNERFNIFSGCPSGRTATIVLRGGADQFIEEAERSLHDAIMIVRRAMKNSTVVAGGGAIDMEISRYLRQYARDIAGKSQLFINSYAKALEIIPRQLCDNAGFDATDVLNKLRQKHAHPSGDGAPYGVDINTGGIADSFANFVWEPAVVKINALNAATEAACLVLSVDETVKNPKSESAQGEAAASAMGGRGRGGAFRGRGRGMRRR

SEQ ID NO: 7069 - protein, 562 aa, Citrullus lanatus
MAAMLQPQIILLKEGTDTSQGKAQLVSNINACTAVADVVRTTLGPRGMDKLIHDDKGNVTISNDGATIMKLLDIVHPAAKILVDIAKSQDSEVGDGTTTVVLLAAEFLREAKPFIEDGVHSQNLIRSYRTASHLAIEKVKELAISIEGKSLEEKKSLLAKCAATTLSSKLIGGEKDFFASMVVDAVIAIGNEDRLNMIGIKKVPGGTMRDSFLVNGVAFKKTFSYAGFEQQPKKFSNPKILLLNIELELKSEKENAEIRLSDPSQYQSIVDAEWNIIYEKLDKCVESGAKVVLSRLAIGDLGTQYFADRDIFCAGRVAEEDLQRVAAATGGTVQTSVNNVIDDVLGTCEVFEEKQVGNERYNIFSGCPSGRTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHAHPSGEGAPYGVDINTGGVADSFANFVWEPAVVKINAINAATEAACLILSVDETVKNPKSESAQGEAAASAMGGRRGGAAFRGRGRGMRRR

SEQ ID NO: 7070 - protein, 564 aa, Cyclamen graecum
MAAMMQPQIILLKEGTDTSQGKAQLISNINACTAVADVVRTTLGPRGMDKLIHDDKGKTTISNDGATIMKLLDIIHPAAKILVDIAKSQDSEVGDGTTTVVLFAGEFLKEAKPFIEDGVHSQNLIRSYRTACHLAIEKIKELAVSIEGKSLEEKKTLLAKCAATTLSSKLIGGEKDFFASMVVDAVIAIGNDDRLNMIGIKKVPGGTMRDSFLVNGVAFKKTFSYAGFEQQPKKFEKPQILLLNVELELKSEKENAEIRLSDPSQYQSIVDAEWNIIYDKLDKCVKSGAKIVLSRLPIGDLATQYFADRDIFCAGRVTEEDLHRVAAATGGTVQTSVNNIIDEVLGSCELFEEKQVGNERFNIFSGCPSGQTATIVLRGGADQFIEEAERSLHDAIMIVRRALKNSTVVAGGGAIDMEISRYLRQHARTIAGKSQLFINSCAKALEVIPRQLCDNAGFDATDVLNKLRQKHALQSGEGALYGVDINTGGITDSFANFVWEPAVVKLNAINAATEAACLILSVDETVKNPKSESAQGDAAANAMGGRGRGGAAFRGGRGRGMRRR

SEQ ID NO: 7071 - protein, 558 aa, Petroselinum crispum
MRKQQPQIILLKEGTDTSQGKAQLVSNINACMAVADVVRTTLGPRGMDKLIHDDKGNTTISNDGATIMKLLDIVHPAAKILVDIAKSQDSEVGDGTTTVVLLAGEFLKEAKPFIEDGVHPQNLIRSYRTASYLAIEKIKELAVSIEGKSLEEKRSLLAKCAATTLSSKLIGGEKEFFASMVVDSVLAIGNDDRLNMIGIKKVPGGTMRDSFLVNGVAFKKTFSYAGFEQQPKKFENPKILLLNIELELKSEKENAEIRLSDPLQYQSIVDAEWNIIYDKLDKCVKSGAKIVLSRLAIGDLGTQYFADRDIFCAGRVAEEDLQRVAAATGGTVQTSVNNVIDEVLGTCEIFEEKQVGNERFNIFSGCPSGQTATIVLRGGADQFIEEAERSLHDAIMIVRRAMKNSTVVAGGGAIDMEISRYLRQHSRTIAGKSQLFINSYAKALEVIPRQLCDNAGFDATDVLNNLRQKHALASGEGALYGVDINTGGIADSYAHFVWEPAVVKINAINAATEAACLILSVDETVKNPKSESAQGEAAASAMGRGRGGGGRGRGMRRR

SEQ ID NO: 7072 - protein, 558 aa, Ambrosia trifida
MASMMQPQIILLKEGTDTSQGKPQLISNINACMAVADVVRTTLGPRGMDKLIHDDKGNTTISNDGATIMKLLDIVHPAAKILVDIAKSQDSEVGDGTTTVVLLAGEFLREAKPFIEDGVHPQNLIRSYRAASNMAIEKIKELAVSIEGKSLDEKRSLLAKCAATTLSSKLIGGEKDFFAKMVVDAVIAIGNDDRLNMIGIKKVPGGTMRDSFLVNGVAFKKTFSYAGFEQQPKKFQNPKILLLNIELELKSEKENAEIRLSDPLQYQSIVDAEWNIIYDKLDKCVKSGAKIVLSRLAIGDLATQYFADRDIFCAGRVAEDDLHRVAAATGGTVQTSVNNVIDEVLGSCDVFEEKQVGNERFNIFSGCPSGQTATIVLRGGADQFIEEAERSLHDAIMIVRRAMKNSTVVAGGGAIDMEISRYLWQHARNIAGKSQLFINAFAKALEVIPRQLCDNAGFDATDVLNKLRQKHALPSGEGALYGVDINTGGICDSFANFVWEPALVKINAINAATEAACLVLSVDETVKNPKSESAQGEAAAGMGRGRGGGMRGRGMRRR

SEQ ID NO: 7073 - protein, 562 aa, Manihot esculenta
MAAMLQPQIILLKEGTDTSQGKAQLVSNINACTAVADVVRTTLGPRGMDKLIHDDKGSVTISNDGATIMKLLDIVHPAAKILADIAKSQDSEVGDGTTTVVLLAAEFLKEAKPFVEDGVHPQNLIRSYRTACYLAIEKIKELAVSIEGKSLEEKKSLLAKCAATTLSSKLIGGEKEFFAQMVVDAVIAIGNDDRLNMIGIKKVPGGNMRDSFLVNGVAFKKTFSYAGFEQQPKKFLNPKILLLNIELELKSEKENAEIRLSDPSQYQSIVDAEWNIIYEKLDKCVQSGAKVVLSRLAIGDLATQYFADRDIFCAGRVAEEDLQRVAAATGGTVQTTVNNIIEEVLGACDIFEEKQVGNERFNIFSGCPSGRTATIVLRGGADQFIEEAERSLHDAIMIVRRALKNSTVVAGGGAIDMELSRYLRQHARTIAGKSQLFINSYAKALEVIPRQLCDNAGFDATDVLNKLRQKHALPSGEGAPFGVDINTGGIADSFANFVWEPAVVKINAINAATEAACLVLSVDETVKNPKSESAQGEAAASAMGGRGRGAAFRGRGRGMRRR

SEQ ID NO: 7074 - protein, 562 aa, Eucalyptus grandis
MAAMLQPQIILLKEGTDTSQGKGQLVSNINACTVVADVVRTTLGPRGMDKLIHDDKGAVTISNDGATIMKLLDIVHPAAKILVDIAKSQDSEVGDGTTTVVLLAGEFLKEAKPFIEDGVHPQNLIRSYRTACSLAIEKVKELAISIEGKSLEEKKSLLAKCAATTLSSKLIGGEKEFFALMVVDAVIAIGTDDRLNMIGIKKVPGGSMRDSFLVDGVAFKKTFSYAGFEQQPKKFLKPKILLLNIELELKSEKENAEIRLSDPSQYQSIVDAEWNIIYDKLDKCVQSGAKVVLSRLAIGDLATQYFADRDIFCAGRVTEEDLLRVAAATGGTVQTSVNNVIDEVLGTCEIFEEKQVGNERFNIFSGCPSGLTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHALPSGEGAPYGVDINTGGIADSFANFVWEPSVVKVNAINAATEAACLVLSVDETVKNPKSESAQGDAAAMGGRGRGGAAFRGGRGRGMRRR

SEQ ID NO: 7075 - protein, 559 aa, Flaveria ramosissima
MASMMQPQIILLKEGTDTSQGKPQLISNINACMAVADVVRTTLGPRGMDKLIHDDKGNTTISNDGATIMKLLDIVHPAAKILVDIAKSQDSEVGDGTTTVVLLAGEFLREAKPFIEDGVHPQNLIRSYRSASNMAIEKIKELAVSIEGKSLDEKRSLLAKCAATTLSSKLIGGEKDFFATMVVDAVIAIGNDDRLNMIGIKKVPGGTMRDSFLVNGVAFKKTFSYAGFEQQPKKFQNPKILLLNIELELKSEKENAEIRLSDPLQYQSIVDAEWNIIYDKLDKCVKSGAKIVLSRLAIGDLATQYFADRDIFCAGRVAEDDLHRVAAATGGMVQTSVNNVIDEVLGSCEVFEEKQVGNERFNIFSGCPSGQTATIVLRGGADQFIEEAERSLHDAIMIVRRAMKNSTVVAGGGAIDMEISRYLWQHARNIAGKSQLFINAFAKALEVIPRQLCDNAGFDATDVLNKLRQKHALPSGEGALYGVDINTGGISDSFANFVWEPAVVKMNAINAATEAACLVLSVDETVKNPKSESAQGEAAAGMGRGRGGGAMRGRGMRRR

SEQ ID NO: 7076 - protein, 562 aa, Panax ginseng
MTAMMQPQIILLKEGTDTSQGKAQLISNINACMAVADVVRTTLGPRGMDKLIHDDKGNTTISNDGATIMKLLDIVHPAAKILVDIAKSQDSEVGDGTTTVVLLAGEFLKEAKPFIEDGVHPQNLIRSYRNASYLAIEKIKELAVGIEGKSLEEKKSLLANCAATTLSSKLIGGEKEFFASMVVDSVLAIGSDDRLNMIGIKKVPGGTMRDSFLVNGVAFKKTFSYAGFEQQPKKFENPKILLLNIELELKSEKENAEIRLSDPLQYQSIVDAEWNIIYDKLDKCVKSGAKIVLSRLAIGDLATQYFADRDIFCAGRVSEEDLHRVAAATGGTVQTSVNNVIDEVLGSCEIFEERQVGNERFNIFGGCPLGQTATIVLRGGADQFIEEAERSLHDAIMIVRRAVKNSTVVAGGGAIDMDISRYLRQHARTIAGKSQLFINSYAKALEVIPRQLCDNAGFDATDVLNKLRQKHALPSGEGALFGVDINTGGIADSYANFVWEPAVVKINAINAATEAACLILSVDETVKNPKSESAQGEAASSAMGRGRGGGGLRGRGRGMRRR

SEQ ID NO: 7077 - protein, 562 aa, Aquilegia formosa
MASMMQPQIILLKEGTDTSQGKAQLISNINACTALADVVRTTLGPRGMDKLIHDDKGNTTISNDGATIMKLLDVVHPAAKILVDIAKSQDSEVGDGTTTVVLFAGEFLKEAKPFMEDGVHPQNLIRSYRIACQLAIEKIKELAVSIEGKSMEEKKSLLQKCAATTLSSKLISGEKEFFASMVVEAVIAIGNDDRLNMIGIKKVPGGNMRDSFLVSGVAFKKTFSYAGFEQQPKKFLNAKILLLNIELELKSEKENAEIRLSDPLQYQSIVDAEWNIIYDKLDKCVQSGAKIVLSRLAIGDLATQYFADRDIFCAGRVTEEDLQRVAAATGGTVQTSVNNVIDEVLGTCELFEERQVGNERFNIFSGCPSGQTATIVLRGGADQFIEEAERSLHDAIMIVRRALKNSTVVAGGGAIDMEISRYLRQHARTIAGKSQLFINSYAKAFEVIPRQLCDNAGFDATDVLNKLRQKHALPSGEGALFGVDINTGGIIDTFANFVWEPAVVKINAINAATEAACLILSVDETVKNPKSESAQGDAAAGAMGRGRGMGGFRGRGRGMRRR

SEQ ID NO: 7078 - protein, 558 aa, Arabidopsis lyrata
MASSMMQPQIILLKEGTDTSQGKAQLVSNINACTAVGDVVRTTLGPRGMDKLIHDDKGSVTISNDGATIMKLLDIVHPAAKILVDIAKSQDSEVGDGTTTVVLLAAEFLKEAKPFIEDGVHSQNLIRSYRTASTLAIAKVKELAVSIEGKSVEEKKGLLAKCAATTLSSKLIGGEKEFFATMVVDAVMAIGNDDRLNLIGIKKVPGGNMRDSFLVDGVAFKKTFSYAGFEQQPKKFLNPKILLLNIELELKSEKENAEIRLSDPSQYQSIVDAEWNIIYDKLDKCVESGAKVVLSRLAIGDLATQYFADRDIFCAGRVAEEDLNRVAAAAGGTVQTSVNNIIDEVLGTCEIFEEKQVGGERFNIFSGCPSGRTATIVLRGGADQFIEEAERSLHDAIMIVRRAVKNSTVVPGGGAIDMEISKYLRQHSRTIAGKSQLFINSYAKALEVIPRQLCDNAGFDATDVLNKLRQKHAMQSGEGASYGVDINTGGISDSFANFVWEPAVVKINAINAATEAACLILSVDETVKNPKSESAQGDAAGAMGRGRGGGRGRGMRRR

SEQ ID NO: 7079 - protein, 563 aa, Tabernaemontana elegans
MATMMQPQIILLKEGTDTSQGKPQLVSNINACMAVADMVRSTLGPRGMDKLIHDEKGNTTISNDGATIMKLLDIVHPAAKILVDIAKSQDSEVGDGTTTVVLLAAEFLKEAKPFIEDGVHPQSLIRSFRTASYLAIEKVKELAVSIEGKSLEEKKSLLAKCAATTLSSKLIGGEKDFFAPMVVDAVLGIGNDDRLNMIGIKKVPGGTMRDSFLVSGVAFKKTFSYAGFEQQPKKFVNPEILLLNIELELKSEKENAEIRLSDPSQYQSIVDAEWNIIYDKLDKCVKSGAKIVLSRLAIGDLATQYFADRDIFCAGRVTEEDLHRVAAATGGTIQTTVNNVIDEVLGKCEYFEERQVGNERFNIFSGCPSGRTATIVLRGGADQFIEEAERSLHDAIMIVRRALKNSTVVPGGGAIDMEISRYLRQHARTIAGKSQLFINSYAKALEVIPRQLCDNAGFDATDVLNKLRQKHALPSGEGAPYGVDINTGGIADSFANFVWEPAVVKINAINAATEAASLILSVDETVKNPKSESAQGEAAASTMGGRGRGGPAFRGRGRGMRRR

SEQ ID NO: 7080 - protein, 242 aa, Aristolochia fimbriata
MAAMMQPQIILLKEGTDTSQGKPQLISNINACMVVADAVRSTLGPRGMDKLIHDDKGNTTISNDGATIMKLLDIVHPAAKILVDIAKSQDSEVGDGTTTVVLLAGEFLKEAKPFIEDGVHAQNLIRSYRTAAYLAINKIKELAVSIEGKSVEEKKSLLAKCAATTLSSKLIGGEKEFFATMVVDAVMAIGNDDRLNLIGIKRFQVVPCVIHFLLTALLSRRLSLMLVLSSNQRSLSTQKFFF

SEQ ID NO: 7081 - protein, 557 aa, Brassica oleracea
MASMMQPQIILLKEGTDTSQGKAQLLSNINAVTAVGDVVRTTLGPRGMDKLIHDDKGSVTISNDGATIMKLLDIVHPAAKILVDIAKSQDSEVGDGTTTVVLLAAEFLKEAKPFVEDGVHSQNLIRSYRTASTLAIEKVKELAVSIEGKSVEEKKGLLAKCAATTLSSKLIGGEKEFFATMVVDAVMAIGDDDRLNLIGIKKVPGGNMRDSFLVDGVAFKKTFSYAGFEQQPKKFLNPKILLLNIELELKSEKENAEIRLSDPSQYQSIVDAEWNIIYDKLDKCVESGAKVVLSRLAIGDLATQYFADRDIFCAGRVAEEDLNRVAAAAGGTVQTSVNNIIPEVLGTCEIFEEKQVGGERFNIFSGCPSGRTATIVLRGGADQFIEEAERSLHDAIMIVRRAVKNSTVVPGGGAIDMEISKYLRQHSRTIAGKSQLFINSYAKALEVIPRQLCDNAGFDATDVLNKLRQKHAMQSGEGASYGVDINTGGIADSFANFVWEPAVVKINAINAATEAACLILSVDETVKNPKSESAQGDAAGAMGRGRGGGRGRGMRRR

SEQ ID NO: 7082 - protein, 561 aa, Chrysanthemum coronarium
MASMMQPQIILLKEGTDTSQGKPQLISNINACMAVADVVRTTLGPRGMDKLIHDDRGVTTISNDGATIMKLLDIVHPAAKILVDIAKSQDSEVGDGTTSVVLLAGEFLREAKPFIEDGVHPQNLIRSYRTAASMAIEKVEKLAVSIEGKSLDEKKNLLAKCAATTLSSKLIGGEKDFFAKMVVDAVIAIGNDDRLNMIGIKKVPGGTMRDSFLVNGVAFKKTFSYAGFEQQPKKFLNPKILLLNIELELKSEKENAEIRLSDPLQYQSIVDAEWNIIYDKLDKCVKSGAKIVLSRLAIGDLATQYFADRDIFCAGRVAEDDLNRVTAATGGTVQTSVNNVIDEVLGSCEVFEEKQVGNERFNIFSGCPSGQTATIVLRGGADQFIEEAERSLHDAIMIVRRAMKNSTVVAGGGAIDMEISRFLRQHARNIAGKSQLFINAFAKALEVIPRQLCDNAGFDATDVLNKLRQKHALESGEGALYGVDINTGGICDSFANFVWEPAVVKINAINAAAEAACLILSVDETVKNPKSESAQGDAAAMGRGRGGGGMRGGRGRGMRRR

SEQ ID NO: 7083 - protein, 560 aa, Chrysanthemum coronarium
MASMMQPQIILLKEGTDTSQGKPQLISNINACMAVADVVRTTLGPRGMDKLIHDDRGVTTISNDGATIMKLLDIVHPAAKILVDIAKSQDSEVGDGTTSVVLLAGEFLREAKPFIEDGVHPQNLIRSYRTAAFMAIEKIKELAVSIEGKSLDEKRSLLAKCAATTLSSKLIGGEKDFFATMVVDAVVAIGNEDRLNMIGIKKVPGGTMRDSFLVNGVAFKKTFSYAGFEQQPKKFLNPKILLLNIELELKSEKENAEIRLSDPLQYQSIVDAEWNIIYDKLDKCVQSGAKIVLSRLAIGDLATQYFADRDIFCAGRVAEDDLHRVAAATGGTVQTSVNNVIDEVLGSCEVFEEKQVGNERFNIFSGCPSGQTATIVLRGGADQFIEEAERSLHDAIMIVRRAMKNSTVVAGGGAIDMEISRFLRQHARNIAGKSQLFINAFAKALEVIPRQLCDNAGFDATDVLNKLRQKHALPAGEGALYGVDINTGGICDSFANFVWEPAVVKINAINAAAEAACLILSVDETVKNPKSESAQGDAAAGIGRGGGGMRGGRGRGMRRR

SEQ ID NO: 7084 - protein, 562 aa, Cirsium arvense
MASMMQPQIILLKEGTDTSQGKPQLISNINACMAVADVVRTTLGPRGMDKLIHDDKGNTTISNDGATIMKLLDVVHPAAKILVDIAKSQDSEVGDGTTTVVLLAGEFLKEAKPFIEDGVHPQNLIRSYRTASFMAIEKIKELAVSIEGKSPEEKRSLLAKCAATTLSSKLIGGEKEFFASMVVDAVFAIGNDDRLNMIGIKKVPGGTMRDSFLVNGVAFKKTFSYAGFEQQPKKFLNPKILLLNIELELKSEKENAEIRLSDPLQYQSIVDAEWNIIYDKLDKCVQSGAKIVLSHLAIGDLATQYFADRDIFCAGRVAEDDLHRVAAATGGTVQTSVNNVIDEILGYCEVFEEKQVGGERFNIFSGCPSGQTATIVLRGGADQFIEEAERSLHDAIMIVRRATKNSTVVAGGGAIDMELSRYLWQHARNIAGKSQLFINSYAKALEVIPRQLCDNAGFDATDVLNKLRQKHALPAGEGALYGVDINTGGISDSFANFVWEPAVVKINAINAATEAACLILSVDETVKNPKSESAQGDAAGGMGRGRGGGGMRGGRGRGMRRR

SEQ ID NO: 7085 - protein, 562 aa, Euonymus alatus
MSAMMQPQIILLKEGTDTSQGKAQLVSNINACTAVADVVRTTLGPRGMDKLIHDDKGSVTISNDGATIMKLLDIVHPAAKILVDIAKSQDSEVGDGTTTVVLLAAEFLKEAKPFIEDGVHSQNLIRSYRTAGNLAISKVRELAVSIEGKSLEEKKSLLAKCAATTLSSKLIGGEKDFFASMVVDAVIAIGDEDRLNMIGIKKVPGGNMRDSFLVNGVAFKKTFSYAGFEQQPKKFVNPKILLLNIELELKSEKENAEIRLSDPSQYQSIVDAEWNIIYDKLDKCVQSGAKVVLSRLAIGDLATQYFADRDIFCAGRVAEEDLQRVAAAAGGMVQTTVNNVIDEVLGTCELFEERQVGNERFNIFSGCPSGRTATIVLRGGADQFIEEAERSLHDAIMIVRRAMKNSTVIAGGGAIDMEISRYLRQHARNIAGKSQLFINSYAKALEIIPRQLCDNAGFDATDVLNKLRQKHALPSGDGAPYGVDINTGGIADSFANFVWEPAVVKINALNAATEAACLILSVDETVKNPKSESAQGEAAASAMGGRGRGGAFGGRGRGMRRR

SEQ ID NO: 7086 - protein, 557 aa, Helianthus annuus
MTSMMQPQIILLKEGTDTSQGKPQLVSNINACMAVADVVRTTLGPRGMDKLIHDDKGNTTISNDGATIMKLLDIVHPAAKLLVDIAKSQDSEVGDGTTTVVLLAGEFLREAKPFIEDGVHPQNLIRSYRAASNMAIEKVKELAVSIEGKSLDEKRSLLAKCAATTLSSKLIGGEKDFFAKMVVDAVIAIGNDDRLNMIGIKKVPGGTMRDSFLVNGVAFKKTFSYAGFEQQPKKFHNPKILLLNIELELKSEKENAEIRLSDPLQYQSIVDAEWNIIYDKLDKCVKSGAKIVLSRLAIGDLATQYFADRDIFCAGRVAEDDLHRVAAATGGTVQTSVNNVIDEVLGTCDVFEEKQVGNERFNIFSGCPSGQTATIVLRGGADQFIEEAERSLHDAIMIVRRAMKNSTVVAGGGAIDMEISRYLWQHARNIAGKSQLFINAFAKALEVIPRQLCDNAGFDATDVLNKLRQKHALPSGEGSLYGVDINTGGICDSFANFVWEPALVKINAINAATEAACLVLSVDETVKNPKSESAQGDAAGMGRGRGGGMRGRGMRRR

SEQ ID NO: 7087 - protein, 328 aa, Vaccinium corymbosum
MPKILLLNIELELKSEKENAEIRLSDPSQYQSIVDAEWNIIYDKLDKCVKSGAKIVLSRLAIGDLGTQYFADRDIFCAGRVAEEDLQRVAAATGGTVQTSVNNVIDEVLGSCELFEERQVGNERFNIFSGCPSGQTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHALQSGEGKPYGVDINTGGIADNYANFVWEPAVVKINAINAATEAACLVLSVDETVKNPKSESAQGDAAAGAMGGRGRGGAAFRGRGGRGMRRR

SEQ ID NO: 7088 - protein, 558 aa, Brassica oleracea
MASMMQPQIILLKEGTDTSQGKAQLLSNINAVTAVGDVVRTTLGPRGMDKLIHDDKGSVTISNDGATIMKLLDIVHPAAKILVDIAKSQDSEVGDGTTTVVLLAAEFLKEAKPFVEDGVHSQNLIRSYRTASTLAIEKVKELAVSIEGKSVEEKKGLLAKCAATTLSSKLIGGEKEFFATMVVDAVMAIGDDDRLNLIGIKKVPGGNMRDSFLVDGVAFKKTFSYAGFEQQPKKFLNPKILLLNIELELKSEKENAEIRLSDPSQYQSIVDAEWNIIYDKLDKCVESGAKVVLSRLAIGDLATQYFADRDIFCAGRVAEEDLNRVAAAAGGTVQTSVNNIIPEVLGTCEIFEEKQVGGERFNIFSGCPSGRTATIVLRGGADQFIEEAERSLHDAIMIVRRAVKNSTVVPGGGAIDMEVSKYLRQHSRTIAGKSQLFINSYAKALEVIPRQLCDNAGFDATDVLNKLRQKHAMQSGEGASYGVDINTGGIADSYANFVWEPAVVKINAINAATEAACLILSVDETVKNPKSESAQGDAAAGAMGRGRGGGRGRGMRRR

SEQ ID NO: 7089 - protein, 557 aa, Cichorium intybus
MASMMQPQIILLKEGTDTSQGKPQLISNINACMAVADVVRTTLGPRGMDKLIHDDKGNTTISNDGATIMKLLDIVHPAAKILVDIAKSQDSEVGDGTTTVVLLAGEFLKEAKPFIEDGVHPQNLIRSYRSASFMAIEKIKELAVSIEGKSLDEKRSLLAKCAATTLSSKLIGGEKDFFAKMVVDAVIAIGNDDRLNMIGIKKVPGGTMRDSFLVNGVAFKKTFSYAGFEQQPKKFLNPKILLLNIELELKSEKENAEIRLSDPLQYQSIVDAEWNIIYDKLDKCVKSGAKIVLSRLAIGDLATQYFADRDIFCAGRVAEDDLHRVAAATGATVQTSVNNVIEEVLGSCEVFEEKQVGSERFNIFSGCPSGQTATIVLRGGADQFIEEAERSLHDAIMIVRRAMKNSTVVAGGGAIDMEISRYLWQHARNIAGKSQLFINAYAKALEVIPRQLCDNAGFDATDVLNKLRQKHALAAGEGALYGVDINTGGISDSFANFVWEPAVVKINAINAATEAACLILSVDETVKNPKSESAQGEAAAGMGRGRGGGRGRGMRRR

SEQ ID NO: 7090 - protein, 558 aa, Brassica rapa
MASMMQPQIILLKEGTDTSQGKAQLLSNINSVTAVGDVVRTTLGPRGMDKLIHDDKGSVTISNDGATILKLLDIVHPAAKILVDIAKSQDSEVGDGTTTVVLLAAEFLKEAKPFVEDGVHSQNLIRSYRTASTLAIEKVKELAVSIEGKSVEEKKGLLAKCAATTLSSKLIGGEKEFFATMVVDAVMAIGDDDRLNLIGIKKVPGGNMRDSFLVDGVAFKKTFSYAGFEQQPKKFLNPKILLLNIELELKSEKENAEIRLSDPSQYQSIVDAEWNIIYDKLDKCVESGAKVVLSRLAIGDLATQYFADRDIFCAGRVAEEDLNRVAAAAGGTVQTSVNNIIPEVLGTCEIFEEKQVGGERFNIFSGCPSGRTATIVLRGGADQFIEEAERSLHDAIMIVRRAVKNSTVVPGGGAIDMEISKYLRQHSRTIAGKSQLFINSYAKALEVIPRQLCDNAGFDATDVLNKLRQKHAMQSGEGASYGVDINTGGIADSFANFVWEPAVVKINAINAATEAACLILSVDETVKNPKSESAQGDAAAGAMGRGRGGGRGRGMRRR

SEQ ID NO: 7091 - protein, 206 aa, Brassica napus
MASMMQPQIILLKEGTDTSQGKAQLLSNINAVTAVGDVVRTTLGPRGMDKLIHDDKGSVTISNDGATIMKLLDIVHPAAKILVDIAKSQDSEVGDGTTTVVLLAAEFLKEAKPFVEDGVHSQNLIRSYRTASTLAIEKVKELAVSIEGKSVEEKKGLLAKCAATTLSSKLIGGEKEFFATMVVDAVMAIGDDDRLNLIGIKKVTWW

SEQ ID NO: 7092 - protein, 557 aa, Citrus sinensis
MAAMMQPQIILLKEGTDTSQGKAQLVSNINACTAVADVVRSTLGPRGMDKLIHDDKGTVTISNDGATIMKLLDIVHPAAKILVDIAKSQDSEVGDGTTTVVLLAAEFLREAKPFIEDGVHPQNLIRSFRNASYKAIQKVKELAKSIEGQSLEEKKRLLSKCAATTLSSKLIGGEKEFFASMVVDAVGAIGDGDRLNMIGIKKVPGGTMRDSFLVNGVAFKKTFSYAGFEQQPKKFLNPKILLLNIELELKSEKENAEIRLSDPSQYQSIVDAEWNIIYDKLDKCVQSGAKVVLSRLAIGDLATQYFADRDIFCAGRVAEEDLLRVAAATGGTVQTSVNNVVDEVLGTCEHFEERQVGNERFNIFSGCPSGRTATIVLRGGADQFIEEAERSLHDAIMIVRRATKNSTVVAGGGAIDMEISKYLRQESRAIAGKSQFFINSYAKALEVIPRQLCDNAGFDATDVLNKLRQKHALPTGEGAPYGVDINTGGIADSFANFVWEPAVVKINAINAATEAACLILSVDETVKNPKSESAQGEAAASAMGGRGRGRGRGMRRR

SEQ ID NO: 7093 - protein, 558 aa, Eutrema halophilum
MASMMQPQIILLKEGTDTSQGKAQLVSNINACTAVGDVVRTTLGPRGMDKLIHDDKGSVTISNDGATIMKLLDIVHPAAKILVDIAKSQDSEVGDGTTTVVLLAAEFLKEAKPFIEDGVHSQNLIRSYRTASTLAIEKVKELAVSIEGKSVEEKKGLLAKCAATTLSSKLIGGEKEFFSTMVVDAVMAIGNDDRLNLIGIKKVPGGNMRDSFLVDGVAFKKTFSYAGFEQQPKKFVNPKILLLNIELELKSEKENAEIRLSDPSQYQSIVDAEWNIIYDKLDKCVESGAKVVLSRLAIGDLATQYFADRDIFCAGRVAEEDLNRVAAAAGGTVQTSVNNIITEVLGTCEIFEEKQVGGERFNIFSGCPSGRTATIVLRGGADQFIEEAERSLHDAIMIVRRAVKNSTVVPGGGAIDMEISKYLRQHSRTIAGKSQLFINSYAKALEVIPRQLCDNAGFDATDVLNKLRQKHAMQSGEGASYGVDINTGGIADSYANFVWEPAVVKINAINAATEAACLILSVDETVKNPKSESAQGEAAAGAMGRGRGGGRGRGMRRR

SEQ ID NO: 7094 - protein, 558 aa, Brassica oleracea
MASMMQPQIILLKEGTDTSQGKAQLLSNINAVTAVGDVVRTTLGPRGMDKLIHDDKGSVTISNDGATIMKLLDIVHPAAKILVDIAKSQDSEVGDGTTTVVLLAAEFLKEAKPFVEDGVHSQNLIRSYRTASTLAIEKVKELAVSIEGKSVEEKKGLLAKCAATTLSSKLIGGEKEFFATMVVDAVMAIGDDDRLNLIGIKKVPGGNMRDSFLVDGVAFKKTFSYAGFEQQPKKFDNPKILLLNIELELKSEKENAEIRLSDPSQYQSIVDAEWNIIYDKLDKCVESGAKVVLSRLAIGDLATQYFADRDIFCAGRVAEEDLNRVAAAAGGTIQTSVNNIIPEVLGTCEIFEEKQVGGERFNIFCGCPSGRTATIVLRGGADQFIEEAERSLHDAIMIVRRAVKNSTVVPGGGAIDMEISKYLRQHSRTIAGKSQLFINSYAKALEVIPRQLCDNAGFDATDVLNKLRQKHAMQSGEGASYGVDINTGGIADSFANFVWEPAVVKINAINAATEAACLILSVDETVKNPKSESAQGDAAAGAMGRGRGGGRGRGMRRR

SEQ ID NO: 7095 - protein, 557 aa, Cichorium intybus
MASMMQPQIILLKEGTDTSQGKPQLISNINACMAVADVVRTTLGPRGMDKLIHDDKGNTTISNDGATIMKLLDIVHPAAKILVDIAKSQDSEVGDGTTTVVLLAGEFLKEAKPFIEDGVHPQNLIRSYRSASFMAIEKIKELAVSIEGKSLDEKRSLLAKCAATTLSSKLIGGEKDFFAKMVVDAVIAIGNDDRLNMIGIKKVPGGTMRDSFLVNGVAFKKTFSYAGFEQQPKKFLNPKILLLNIELELKSEKENAEIRLSDPLQYQSIVDAEWNIIYDKLDKCVKSGAKIVLSRLAIGDLATQYFADRDIFCAGRVAEDDLHRVAAATGATVQTSVNNVIEEVLGCCEIFEEKQVGSERFNIFSGCPSGQTATIVLRGGADQFIEEAERSLHDAIMIVRRAMKNSTVVAGGGAIDMEISRYLWQHARNIAGKSQLFINAFAKALEVIPRQLCDNAGFDATDVLNKLRQKHALAAGEGALYGVDINTGGISDSFANFVWEPAVVKINAINAATEAACLILSVDETVKNPKSESAQGEAAAGMGRGRGGGRGRGMRRR

SEQ ID NO: 7096 - protein, 513 aa, Echinochloa colona
MSAMLQPQVILLKEGTDTSQGKAQMVSNINACTAVVDTVRTTLGPRGMDKLIHDDKGGVTISNDGATIMRLLDIVHPAAKILVDIAKSQDSEVGDGTTTVVLLAAEFLKEAKPYVEDGVHPHSLIRSYRTAGNMAIQRVKELAVSIEGKSLEEKKSLLAKCAATTLSSKLIGGEKEFFASMVVDAVLAIGNDDRLNLIGIKKVPGGTMRDSFLVNGVAFKKTFSYAGFEQQPKKFLNPKILLLNIELELKSEKENAEIRLSDPLQYQSIVDAEWNIIYDKLDKCVKSGAKIVLSRLAIGDLATQYFADRDIFCAGRVTEEDLQRVAAATGGTVQTSVNNVIDEVLGSCEVFEEKQVGNERFNIFSGCPSGQTATIVLRGGTDQFIEEAERSLHDAIMIVRRALKNSTVVPGGGAIDMEISKYLRQHARTIAGKSQFFVNSFAKALEVIPRQLCDNAGFDATDVLNKLRQKHASGEGANYGVDINTGGITDSFANFVWEPAVVKINAINAATEA

SEQ ID NO: 7097 - protein, 560 aa, Phaseolus vulgaris
MSAMLQPQIILLKEGTDTSQGKPQLVSNINACTAVADVVRTTLGPRGMDKLIHDDKGAVTISNDGATIMKLLDIVHPAAKILVDIAKSQDSEVGDGTTTVVLLAAEFLREAKPFIEDGVHSQNLIRSYRAASTLAIEKIQELAVSIEGKSLEEKKSLLAKCASTTLSSKLIGGEKEFFASMVVDAVLAIGYEDRLNMIGIKKVPGGTMRDSFLVNGVAFKKTFSYAGFEQQPKKFLNPKILLLNVELELKSEKENAEIRLSDPSQYQSIVDAEWNIIYDKLDKCVSSGAKVVLSRLAIGDLATQYFADRDIFCAGRVAEEDLKRVAAATGGTVQTSVNNIIEEVLGTCEVFEEKQVGNERFNIFNGCPSGLTATIVLRGGADQFIEEAERSLHDAIMIVRRALKNSTVVAGGGAIDMEISRFLRQHARTIAGKSQLFINSYAKALEVIPRQLCDNAGFDATDVLNKLRQKHALPSGEGAPYGVDIATGGIADSFANFVWEPAIVKINAINAATEAACLILSVDETIKNPKSESAQGDAAASAMGRGRGGGFRGRGRGMRR

SEQ ID NO: 7098 - protein, 558 aa, Brassica napus
MASMMQPQIILLKEGTDTSQGKAQLLSNINAVTAVGDVLRTTLGPRGMDKLIHDDKGSVTISNDGATIMKLLDIVHPAAKILVDIAKSQDSEVGDGTTTVVLLAAEFLKEAKPFVEDGVHSQNLIRSYRTASTLAIEKVKELAVSIEGKSVEEKKGLLAKCAATTLSSKLIGGEKEFFATMVVDAVMAIGDDDRLNLIGIKKVPGGNMRDSFLVDGVAFKKTFSYAGFEQQPKKFDNPKILLLNIELELKSEKENAEIRLSDPSQYQSIVDAEWNIIYDKLDKCVESGAKVVLSRLAIGDLATQYFADRDIFCAGRVAEEDLNRVAAAAGGTIQTSVNNIIPEVLGTCEIFEEKQVGGERFNIFSGCPSGRTATIVLRGGADQFIEEAERSLHDAIMIVRRAVKNSTVVPGGGAIDMEISKYLRQHSRTIAGKSQLFINSYAKALEVIPRQLCDNAGFDATDVLNKLRQKHAMQSGEGASYGVDINTGGIADSFANFVWEPAVVKINAINAATEAACLILSVDETVKNPKSESAQGDAAAGAMGRGRGGGRGRGMRRR

SEQ ID NO: 7099 - protein, 562 aa, Centaurea maculosa
MASMMQPQIILLKEGTDTSQGKPQLISNINACMAVADVVRTTLGPRGMDKLIHDDKGNTTISNDGATIMKLLDVVHPAAKILVDIAKSQDSEVGDGTTTVVLLAGEFLKEAKPFIEDGVHPQNLIRSYRTASFMAIEKIKELAVSIEGKSSDEKRSLLAKCAATTLSSKLIGGEKEFFATMVVDAVFAIGNEDRLNMIGIKKVPGGTMRDSFLVNGVAFKKTFSYAGFEQQPKKFLNPKILLLNIELELKSEKENAEIRLSDPLQYQSIVDAEWNIIYDKLDKCVQSGAKIVLSRLAIGDLATQYFADRDIFCAGRVAEDDLHRVAAATGGTVQTSVNNVIDEILGSCEVFEEKQVGGERFNIFSGCPSGQTATIVLRGGADQFIEEAERSLHDAIMIVRRATKNSTVVAGGGAIDMELSRYLWQHARNIAGKSQLFINSYAKALEVIPRQLCDNAGFDATDVLNKLRQKHALPGGEGALYGVDINTGGISDSFANFVWEPAVVKINAINAATEAACLILSVDETVKNPKSESAQGEAAGGMGRGRGGGGMRGGRGRGMRRR

SEQ ID NO: 7100 - protein, 256 aa, Cirsium arvense
MASMMQPQIILLKEGTDTSQGKPQLISNINACMAVADVVRTTLGPRGMDKLIHDDKGNTTISNDGATIMKLLDVVHPAAKILVDIAKSQDSEVGDGTTTVVLLAGEFLKEAKPFIEDGVHPQNLIRSYRTASFMAIEKIKELAVSIEGKSSDEKRSLLAKCAATTLSSKLIGGEKEFFATMVVDAVFAIGNEDRLNMIGIKKVPGGTMRDSFLVNGVAFKKTFSYAGFEQQPKKFLNPKILLLNIELELKSEKENS

SEQ ID NO: 7101 - protein, 559 aa, Nicotiana benthamiana
MASMMQPQIILLKEGTDTSQGKAQLVSNINACMAVADVVRTTLGPRGMDKLIHDEKGNTTISNDGATIMKLLDIIHPAAKILVDIAKSQDSEVGDGTTTVVLLAGEFLKEAKPFIEEGVHPQNLIRSYRAASNMAIEKIKELAVSIEGKSLEEKKSLLAKCAATTLSSKLIGGEKEFFAPMVVDSVLAIGNDDRLNMIGIKKVPGGNIRDSFLVNGVAFKKTFSYAGFEQQPKKFVDPKILLLNIELELKSEKENAEIRLSDPAQYQSIVDAEWNIIYDKLDKCVKSGAKVVLSRLAIGDLATQYFADRDIFCAGRVAEEDLHRVAAATGGTIQTTVNNVIDEILGSCELFEEKQVGNERFNIFSGCPSGKTATIVLRGGADQFIEESERSLHDAIMIVRRALKNSTVVPGGGAIDMEISRFLRHHARTIQGKSQLFINSYAKALEIIPRQLCDNAGFDATDVLNKLRQKHALPSGEGAPYGVDISTGGIADAFANFVWEPAVVKINAINAATEAACLILSVDETVKNPKSESAQGDAAASAMGGRGRGGGRGRGMRRR

SEQ ID NO: 7102 - protein, 513 aa, Panicum virgatum
MDKLIHDDKGSVTISNDGATIMRLLDIVHPASKILVDIAKSQDSEVGDGTTTVVLLAAEFLKEAKPYVEDGVHPHSLIRSYRAAGNMAIQRVKELAVSIEGKSLEEKKSLLAKCAATTLSSKLIGGEKEFFASMVVDAVLAIGNDDRLNLIGIKKVPGGTMRDSFLVNGVAFKKTFSYAGFEQQPKKFLNPKILLLNIELELKSEKENAEIRLSDPLQYQSIVDAEWNIIYDKLDNCVKSGAKIVLSRLAIGDLATQYFADRDIFCAGRVTEEDLQRVAAATGEMVQTSVNNVIDEVLGSCEVFEEKQVGNERFNIFSGCPSGQTATIVLRGGADQFIEEAERSLHDAIMIVRRALKNSTVVPGGGAIDMEISKYLRQHARTIAGKSQFFVNSFAKALEVIPKQLCDNAGFDATDVLNKLRQKHASGECANYGVDINTGGITDSFANFVWEPAVVKINAINAATEASCLILSVDETVKNPKSESAQGEAAAGAMAGRGGGAMRGRGGRGMRRR

SEQ ID NO: 7103 - protein, 562 aa, Vinca minor
MASMMQPQIILLKEGTDTSQGKPQLLSNINACTAVADVVRSTLGPRGMDKLIHDEKGNTTISNDGATIMKLLDIIHPAAKILVDIAKSQDSEVGDGTTTVVLLAAEFLKEAKPFIEDGVHSQNLIRSYRTASYLAIEKVKQLAVSIEGKSLEEKKGLLAKCAATTLSSKLIGGEKDFFAPMVVDAVLSIGNGDRLNMIGIKKVPGGTMRDSFLVNGVAFKKTFSYAGFEQQPKKFLNPKILLLNIELELKSEKENAEIRLSDPSQYQSIVDAEWNIIYDKLDKCVKSGAKIVLSRLAIGDLGTQYFADRDIFCAGRVTEEDLHRVAAATGGTVQTTVNNIIDEVLGTCECFEERQVGNERFNIFSGCPSGQTATIVLRGGADQFIEEAERSLHDAIMIVRRTLKNSTVVPGGGAIDMEISRYLRQHARTIAGKSQLFINSYAKALEVIPRQLCDNAGFDATDVLNKLRQKHALPSGEGAPYGVDINTGGIADSFANFVWEPAVVKINAINAATEAACLVLSVDETVKNPKSESAQGEAAASAMGGRGRGGSAFRGRGRGMRR

SEQ ID NO: 7104 - protein, 561 aa, Chrysanthemum coronarium
MASMMQPQIILLKEGTDTSQGKPQLISNINACMAVADVVRTTLGPRGMDKLIHDDRGVTTISNDGATIMKLLDIVHPAAKILVDIAKSQDSEVGDGTTSVVLLAGEFLREAKPFIEDGVHPQNLIRSYRTAASMAIEKVEKLAVSIEGKSLDEKKNLLAKCAATTLSSKLIGGEKDFFAKMVVDAVIAIGNDDRLNMIGIKKVPGGTMRDSFLVNGVAFKKTFSYAGFEQQPKKFLNPKILLLNIELELKSEKENAEIRLSDPLQYQSIVDAEWNIIYDKLDKCVKSGAKIVLSRLAIGDLATQYFADRDIFCAGRVAEDDLNRVTAATGGTVQTSVNNVIDEVLGTCEVFEEKQVGNERFNIFSGCPSGLTATIVLRGGADQFIEEAERSLHDAIMIVRRAMKNSTVVAGGGAIDMEISRHLWQHARKIAGKSQLFINAFAKALEVIPRQLCDNAGFDATDVLNKLRQKHALESGEGALYGVDINTGGICDSFANFVWEPAVVKINAINAAAEAACLILSVDETVKNPKSESAQGDAAAMGRGRGGGGMRGGRGRGMRRR

SEQ ID NO: 7105 - protein, 557 aa, Cichorium intybus
MASMMQPQIILLKEGTDTSQGKPQLISNINACMAVADVVRTTLGPRGMDKLIHDDKGNTTISNDGATIMKLLDIVHPAAKILVDIAKSQDSEVGDGTTTVVLLAGEFLKEAKPFIEDGVHPQNLIRSYRTASFMAIEKIKELAVSIEGKSLDEKRRLLAKCAATTLSSKLIGGEKDFFAKMVVDSVIAIGNDDRLNMIGIKKVPGGTMRDSFLVNGVAFKKTFSYAGFEQQPKKFLNPKILLLNIELELKSEKENAEIRLSDPLQYQSIVDAEWNIIYDKLDKCVKSGAKIVLSRLAIGDLATQYFADRDIFCAGRVAEDDLHRVAAATGATVQTSVNNVIEEVLGSCEVFEEKQVGSERFNIFSGCPSGQTATIVLRGGADQFIEEAERSLHDAIMIVRRAMKNSTVVAGGGAIDMEISRYLWQHARNIAGKSQLFINAYAKALEVIPRQLCDNAGFDATDVLNKLRQKHALAAGEGALYGVDINTGGISDSFANFVWEPAVVKINAINAATEAACLILSVDETVKNPKSESAQGEAAAGMGRGRGGGRGRGMRRR

SEQ ID NO: 7106 - protein, 556 aa, Brassica rapa
MASMMQPQIILLKEGTDTSQGKAQLLSNINAVTAVGDVVRTTLGPRGMDKLIHDDKGSVTISNDGATIMKLLDIVHPAAKILVDIAKSQDSEVGDGTTTVVLLAAEFLKEAKPFVEDGVHSQNLIRSYRTASTLAIEKVKELAVSIEGKSVEEKKGLLAKCAATTLSSKLIGGEKEFFATMVVDAVMAIGDDDRLNLIGIKKVPGGNMRDSFLVDGVAFKKTFSYAGFEQQPKKFDNPKILLLNIELELKSEKENAEIRLSDPSQYQSIVDAEWNIIYDKLDKCVESGAKVVLSRLAIGDLATQYFADRDIFCAGRVAEQDLNRVAAAAGGTVQTSVNNIIPEVLGTCEIFEEKQVGGERFNIFRGCPSGRTASIVLRGGADQFIEEAERSLHDAIMIVRRAVKNSTVVPGGGAIDMEISKYLRQHSRTIAGKSQLFINSYAKALEVIPRQLCDNAGFDATDVLNKLRQKHAMQSGEGASYGVDINTGGIADSFANFVWEPAVVKINAINAATEAACLILSVDETVKNPKSESAQGDAAAGAMGRGRGGGRGMRRR

SEQ ID NO: 7107 - protein, 559 aa, Brassica napus
MASMMQPQIILLKEGTDTSQGKAQLLSNINAVTAVGDVLRTTLGPRGMDKLIHDDKGSVTISNDGATIMKLLDIVHPAAKILVDIAKSQDSEVGDGTTTVVLLAAEFLKEAKPFVEDGVHSQNLIRSYRTASTLAIEKVKELAVSIEGKSVEEKKGMLAKCAATTLSSKLIGGEKEFFATMVVDAVMAIGDDDRLNLIGIKKVPGGNMRDSFLVDGVAFKKTFSYAGFEQQPKKFLNPKILLLNIELELKSEKENAEIRLSDPSQYQSIVDAEWNIIYDKLDKCVESGAKVVLSRLAIGDLATQYFADRDIFCAGRVAEEDLNRVAAAAGGTVQTSVNNIIPEVLGTCEIFEEKQVGGERFNIFSGCPSGRTATIVLRGGADQFIEEAERSLHDAIMIVRRAVKNSTVVPGGGAIDMEVSKYLRQHSRTIAGKSQLFINSYAKALEVIPRQLCDNAGFDATDVLNKLRQKHAMQSGEGASYGVDINTGGIADSYANFVWEPAVVKINAINAATEAACLILSVDETVKNPKSESAQGDAAAGAMGRGRGGGGRGRGMRRR

SEQ ID NO: 7108 - protein, 557 aa, Citrus clementina
MAAMMQPQIILLKEGTDTSQGKAQLVSNINACTAVADVVRSTLGPRGMDKLIHDDKGTVTISNDGATIMKLLDIVHPAAKILVDIAKSQDSEVGDGTTTVVLLAAEFLREAKPFIEDGVHPQNLIRSFRNASYKAIQKIKELAKSIEGQSLEEKKRLLSKCAATTLSSKLIGGEKEFFASMVVDAVGAIGDGDRLNMIGIKKVPGGTMRDSFLVNGVAFKKTFSYAGFEQQPKKFLNPKILLLNIELELKSEKENAEIRLSDPSQYQSIVDAEWNIIYEKLDKCVQSGAKVVLSRLAIGDLATQYFADRDIFCAGRVAEEDLLRVAAATGGTVQTSVNNVVDEVLGTCEHFEERQVGNERFNIFSGCPSGRTATIVLRGGADQFIEEAERSLHDAIMIVRRATKNSTVVAGGGAIDMEISKYLRQESRAIAGKSQFFINSYAKALEVIPRQLCDNAGFDATDVLNKLRQKHALPTGEGAPYGVDINTGGIADSFANFVWEPAVVKINAINAATEAACLILSVDETVKNPKSESAQGEAAASAMGGRGRGRGRGMRRR

SEQ ID NO: 7109 - protein, 561 aa, Medicago truncatula
MSSMLQPQIILLKEGTDTSQGKPQLVSNINACTAVADVVRTTLGPRGMDKLIHDDKGSVTISNDGATIMKLLDIVHPAAKILVDIAKSQDSEVGDGTTTVVLLAAEFLREAKPFIEDGVHSQNLIRSYRTAGSLAIEKVKELAVSIEGKSLEEKKSLLGKCAATTLSSKLIGGEKEFFASMVVDAVIAIGTDDRLNMIGIKKVPGGNMRDSFLVNGVAFKKTFSYAGFEQQPKKFLDPKILLLNVELELKSEKENAEIRLSDPSQYQSIVDAEWNIIYDKLDKCVQSGAKVVLSRLAIGDLATQYFADRDIFCAGRVAEEDLKRVAAATGGTVQTSVNNIIDEVLGTCEIFEEKQVGNERFNIFNGCPSGQTATIVLRGGADQFIEEAERSLHDAIMIVRRAMKNSTVVAGGGAIDMEISRYLRQHARTIAGKSQLFINSYAKALEVIPRQLCDNAGFDATDVLNKLRQKHALPSGEGAPFGVDIATGGIADSFANFVWEPAVVKINAINAATEAACLVLSVDETVKNPKSESAQGEAAASAMGGRGRGGGFRGRGRGMRR

SEQ ID NO: 7110 - protein, 560 aa, Cajanus cajan
MSAMLQPQIILLKEGTDTSQGKPQLVSNINACTAVADVVRTTLGPRGMDKLIHDDKGTVTISNDGATIMKLLDIVHPAAKILVDIAKSQDSEVGDGTTTVVLLAAEFLREAKPFIEDGVHSQNLIRSYRTASSLAIEKIKELAVSIEGKSLEEKKSLLAKCAATTLSSKLIGGEKEFFASMVVDAVIAIGTEDRLNMIGIKKVPGGTMRDSFLVNGVAFKKTFSYAGFEQQPKKFLSPKILLLNVELELKSEKENAEIRLSDPAQYQSIVDAEWNIIYDKLDKCVNSGAKVVLSRLAIGDLATQYFADRDIFCAGRVAEEDLKRVAAATGGTVQTSVNNIIDEILGTCEIFEERQVGNERFNIFNGCPSGQTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHALPSGEGAPYGVDIATGGIADSFANFVWEPAIVKINAINAATEAACLILSVDETIKNPKSESAQGEAAASAMGRGRGGAFRGRGRGMRR

SEQ ID NO: 7111 - protein, 560 aa, Glycine max
MSAMLQPQIILLKEGTDTSQGKPQVVSNINACTAVADVVRTTLGPRGMDKLIHDDKGTVTISNDGATIMKLLDIVHPAARILVDIAKSQDSEVGDGTTTVVLLAAEFLREAKPFIEDGVHSQNLIRSYRTACSLAIEKIKDLAVSIEGKSLEEKKNLLAKCASTTLSSKLIGGEKEFFAPMVVDAVISIGNEDRLNMIGIKKVPGGTMRDSFLVNGVAFKKTFSYAGFEQQPKKFLNPKILLLNVELELKSEKENAEIRLSDPAQYQSIVDAEWNIIYDKLDKCVISGAKVVLSRLAIGDLATQYFADRDIFCAGRVAEEDLKRVAAATGGTVQTSVNNVIDEVLGTCEVFEERQVGNERFNIFSGCSSGQTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHALPSGEGGPYGVDIATGGIADSFANFVWEPAIVKINAINAATEAACLILSVDETIKNPKSESAQGDAAASAMGRGRGGAFRGRGRGMRR

SEQ ID NO: 7112 - protein, 563 aa, Ricinus communis
MAAMLQPQIILLKEGTDTSQGKAQLVSNINACTAVADVVRTTLGPRGMDKLIHDDKGNVTISNDGATIMKLLDIVHPAAKILVDIAKSQDSEVGDGTTTVVLLAAEFLKEAKPFIEDGVHSQNLIRSYRTACNLALEKIRELAFSIEGKSIEEKKSLLAKCASTTLSSKLIGGEKEFFAQMVVDAVIAIGNEDRLNMIGIKKVPGGNMRDSFLVNGVAFKKTFSYAGFEQQPKKFVNPKLLLLNIELELKSEKENAEIRLSDPSEYQSIVDAEWNIIYDKLDKCVQSGAKVVLSRLAIGDLATQYFADRDIFCAGRVAEEDLQRVAAATGGTVQTTVNNIIDEVLGTCEIFEEKQVGNERFNIFSGCPSGKTATIVLRGGADQFIEEAERSLHDAIMIVRRAMKNSTVVAGGGAIDMEISRFLRQHARTIAGKSQLFINSYAKALEVIPRQLCDNAGFDATDVLNKLRQKHALPSGEGAPFGVDINTGGIADSFANFVWEPAVVKINAINAATEAACLILSVDETVKNPKSESAQGEAAAGAMGGRGRGGAAFRGRGRGMRRR

SEQ ID NO: 7113 - protein, 560 aa, Glycine max
MSAMLQPQIILLKEGTDTSQGKPQLVSNINACTAVADVVRTTLGPRGMDKLIHDDKGTVTISNDGATIMKLLDIVHPAAKILADIAKSQDSEVGDGTTTVVLLAAEFLREAKPFIEDGVHSQNLIRSYRTACSLAIEKIKDLAVSIEGKSLEEKKSLLAKCASTTLSSKLIGGEKEFFAPMVVDAVISIGNEDRLNMIGIKKVPGGTMRDSFLVNGVAFKKTFSYAGFEQQPKKFLNPKILLLNVELELKSEKENAEIRLSDPAQYQSIVDAEWNIIYDKLDKCVSSGAKVVLSRLAIGDLATQYFADRDIFCAGRVAEEDLKRVAAATGGTVQTSVNNIIDEVLGTCEIFEERQVGNERFNIFNGCPSGQTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHALPSGEGAPYGVDIATGGIADSFANFVWEPAVVKINAINAATEAACLILSVDETIKNPKSESAQGDAAASAMGRGRGGGFRGRGRGMRR

SEQ ID NO: 7114 - protein, 194 aa, Echinacea purpurea
MASMMQPQIILLKEGTDTSQGKPQLISNINACMAVADVVRTTLGPRGMDKLIHDDKGNTTISNDGATIMKLLDVIHPAAKILVDIAKSQDSEVGDGTTTVVLLAGEFLREAKPFIEDGVHPQNLIRSYRTAANMAIQKIKELAVSIEGKSLDEKRSLLAKCAATTLSSKLIGGEKDFLQKWLWMLSLLLEVMID

SEQ ID NO: 7115 - protein, 561 aa, Chrysanthemum coronarium
MTSMMQPQIILLKEGTDTSQGKPQLISNINACMAVADVVRTTLGPRGMDKLIHDDRGVTTISNDGATIMKLLDIVHPAAKILVDIAKSQDSEVGDGTTSVVLLAGEFLREAKPFIEDGVHPQNLIRSYRTAAFMAIEKIKELAVSIEGKSLDEKRSLLAKCAATTLSSKLIGGEKDFFATMVVDAVVAIGNEDRLNMIGIKKVPGGTMRDSFLVNGVAFKKTFSYAGFEQQPKKFLNPKILLLNIELELKSEKENAEIRLSDPLQYQSIVDAEWNIIYDKLDKCVKSGAKIVLSRLAIGDLATQYFADRDIFCAGRVAEDDLNRVTAATGGTVQTSVNNVIDEVLGSCEVFEEKQVGNERFNIFSGCPSGLTATIVLRGGADQFIEEAERSLHDAIMIVRRAMKNSTVVAGGGAIDMEISRHLWLHARKIAGKSQLFINAFAKALEVIPRQLCDNAGFDATDVLNKLRQKHALESGEGALYGVDINTGGICDSFANFVWEPAVVKINAINAAAEAACLILSVDETVKNPKSESAQGDAAAMGRGRGGGGMRGGRGRGMRRR

SEQ ID NO: 7116 - protein, 557 aa, Cichorium intybus
MASMMQPQIILLKEGTDTSQGKPQLISNINACMAVADVVRTTLGPRGMDKLIHDDKGNTTISNDGATIMKLLDIVHPAAKILVDIAKSQDSEVGDGTTTVVLLAGEFLKEAKPFIEDGVHPQNLIRSYRTASFMAIEKVKELAVSIEGKSLDEKRSLLAKCAATTLSSKLIGGEKDFFAKMVVDAVIAIGNDDRLNMIGIKKVPGGTMRDSFLVNGVAFKKTFSYAGFEQQPKKFLNPKILLLNIELELKSEKENAEIRLSDPLQYQSIVDAEWNIIYDKLDKCVKSGAKIVLSRLAIGDLATQYFADRDIFCAGRVAEDDLHRVAAATGATVQTSVNNVIEEVLGCCEIFEEKQVGSERFNIFSGCPSGQTATIVLRGGADQFIEEAERSLHDAIMLVGRAMKNSTVVAGGGAIDMEISRYLWQHARNIAGKSQLFINAYAKALEVIPRQLCDNAGFDATDVLNKLRQKHALAAGEGALYGVDINTGGISDSFANFVWEPAVVKINAINAATEAACLILSVDETVKNPKSESAQGEAAAGMGRGRGGGRGRGMRRR

SEQ ID NO: 7117 - protein, 561 aa, Chenopodium quinoa
MAAMMQPQIILLKEGTDTSQGKAQLISNINACTGIADVVRTTLGPRGMDKLIHDDKGNTTISNDGATIMKLLDIIHPAAKILVDIARSQDSEVGDGTTTVVLLAGEFLKEAKPFVEDGVHPQNLIRSYRIASQLAIEKVKDLAVSIEGKSLEEKKGLLAKCAATTLSSKLIGGEKDFFANMVVDAVLAVGVDDRLSMIGIKKVPGGNMRDSFLVNGVAFKKTFSYAGFEQQPKKFVSPKILLLNIELELKSEKENAEIRLSDPSQYQSIVDAEWNIIYDKLDKCVQTGAKIVLSRLAIGDLATQYFADRDIFCAGRVAEEDLQRVAAATGGTVQTSVNNIIDEVLGTCEIFEEKQVGNERFNIFSGCPSGHTATIVLRGGADQFIEEAERSLHDAIMIVRRAVKNSTVVAGGGAIDMEISRHLRQHARTIAGKSQLFINSYAKALEVIPRQLCDNAGFDATDVLNKLRQKHALPSGEGANYGVDINTGGIADSFANFVWEPAVVKINAINAATEAACLVLSVDETVKNPKSESAQGDAAAMGGRGRGAGGFGGRGRGMRRR

SEQ ID NO: 7118 - protein, 557 aa, Mimulus guttatus
MSAMMQPQIILLKEGTDASQGKPQLISNINACMAVADVVRTTLGPRGMDKLIHNEKGNTTISNDGATIMKLLDIIHPAAKILVDIAKSQDSEVGDGTTTVVLLAGEFLKEAKPFVDDGVHPQNLIRSYRTASNLAIEKIKELASSIEGKSLEEKKKLLAKCAATTLSSKLIGGEKEFFATMVVDAVLAIGNEDRLNMIGIKKVPGGTMRDSFLVNGVAFKKTFSYAGFEQQPKKFVNPKILLLNIELELKSEKENAEIRLSDPLQYQSIVDAEWNIIYDKLDKCAKSGAKVVLSRLAIGDLATQYFADRDIFCAGRVSEEDLQRVAAASGGTVQTTVNNVVDEVLGTCDLFEERQVGNERFNIFSGCPSGRTATFVLRGGADQFIEEAERSLHDAIMIVRRAMKNSTVVPGGGAIDMEISRYLRQHARTIAGKSQLFINSYAKALEVIPRQLCDNAGFDATDVLNKLRQKHALPSGDGAAYGVDINTGGIADSFANFVWEPSVVKINAINAATEAACLVLSVDETVKNPKSESAQGEAAASAMGGRGRGRGRGMRRR

SEQ ID NO: 7119 - protein, 381 aa, Trifolium pratense
MVVDAVIAIGTDDRLNMIGIKKVPGGNMRDSFLVNGVAFKKTFSYAGFEQQPKKFLNPKLLLLNVELELKSEKENAEIRLSDPSQYQSIVDAEWNIIYDKLDKCVQSGAKVVLSRLAIGDLATQYFADRDIFCAGRVAEEDLKRVAAATGGTVQTSVNNIIDEVLGTCEIFEEKQVGNERFNIFNGCPSGQTATIVLRGGADQFIEEAERSLHDAIMIVRRAMKNSTVVAGGGAIDMEISRYLRQHARTIAGKSQLFINSYAKALEVIPRQLCDNAGFDATDVLNKLRQKHALPSGEGAPYGVDIATGGIADSFANFVWEPAVVKINAINAATEAACLVLSVDETVKNPKSESAQGEAAASAMGGRGRGGGFRGRGRGMRR

SEQ ID NO: 7120 - protein, 561 aa, Trifolium pratense
MSSMLQPQIILLKEGTDTSQGKPQLVSNINACTAVADVVRTTLGPRGMDKLIHDDKGSVTISNDGATIMKLLDIVHPAAKILVDIAKSQDSEVGDGTTTVVLLAAEFLREAKPFIEDGVHSQNLIRSYRTACTLAIEKIKELAVSIEGKSLEEKKTLLGKCAATTLSSKLIGGEKEFFASMVVDAVIAIGTDDRLNMIGIKKVPGGNMRDSFLVNGVAFKKTFSYAGFEQQPKKFLNPKLLLLNVELELKSEKENAEIRLSDPSQYQSIVDAEWNIIYDKLDKCVQSGAKVVLSRLAIGDLATQYFADRDIFCAGRVAEEDLKRVAAATGGTVQTSVNNIIDEVLGTCEIFEEKQVGNERFNIFNGCPSGHTATIVLRGGADQFIEEAERSLHDAIMIVRRAMKNSTVVAGGGAIDMEISRYLRQHARTIAGKSQLFINSYAKALEVIPRQLCDNAGFDATDVLNKLRQKHALPSGEGAPYGVDIATGGIADSFANFVWEPAVVKINAINAATEAACLVLSVDETVKNPKSESAQGEAAASAMGGRGRGGGFRGRGRGMRR

SEQ ID NO: 7121 - protein, 561 aa, Trifolium pratense
MSSMLQPQIILLKEGTDTSQGKPQLVSNINACTAVADVVRTTLGPRGMDKLIHDDKGSVTISNDGATIMKLLDIVHPAAKILVDIAKSQDSEVGDGTTTVVLLAAEFLREAKPFIEDGVHSQNLIRSYRTACTLAIEKIKELAVSIEGKSIEEKKTLLGKCAATTLSSKLIGGEKEFFASMVVDAVIAIGTDDRLNMIGIKKVPGGNMRDSFLVNGVAFKKTFSYAGFEQQPKKFLNPKLLLLNVELELKSEKENAEIRLSDPSQYQSIVDAEWNIIYDKLDKCVQSGAKVVLSRLAIGDLATQYFADRDIFCAGRVAEEDLKRVAAATGGTVQTSVNNIIDEVLGTCEIFEEKQVGNERFNIFNGCPSGQTATIVLRGGADQFIEEAERSLHDAIMIVRRAMKNSTVVAGGGAIDMEISRYLRQHARTIAGKSQLFINSYAKALEVIPRQLCDNAGFDATDVLNKLRQKHALPSGEGAPYGVDIATGGIADSFANFVWEPAVVKINAINAATEAACLVLSVDETVKNPKSESAQGEAAASAMGGRGRGGGFRGRGRGMRR

SEQ ID NO: 7122 - protein, 562 aa, Centaurea maculosa
MASMMQPQIILLKEGTDTSQGKPQLISNINACMAVADVVRTTLGPRGMDKLIHDDKGNTTISNDGATIMKLLDVVHPAAKILVDIAKSQDSEVGDGTTTVVLLAGEFLKEAKPFIEDGVHPQNLIRSYRTASFMAIEKIKELAVSIEGKSSDEKRSLLVKCAATTLSSKLIGGEKEFFATMVVDAVFAIGNEDRLNMIGIKKVPGGTMRDSFLVNGVAFKKTFSYAGFEQQPKKFLNPRILLLNIELELKSEKENAEIRLSDPLQYQSIVDAEWNIIYDKLDKCVQSGAKIVLSRLAIGDLATQYFADRDIFCAGRVAEDDLHRVAAATGGTVQTSVNNVIDEILGSCEVFEEKQVGGERFNIFSGCPSGQTATIVLRGGADQFIEEAERSLHDAIMIVRRATKNSTVVAGGGAIDMELSRFLWQHARNIAGKSQLFINSYAKALEVIPRQLCDNAGFDATDVLNKLRQKHALPGGEGALYGVDINTGGISDSFANFVWEPAVVKINAINAATEAACLILSVDETVKNPKSESAQGEAAGGMGRGRGGGGMRGGRGRGMQRR

SEQ ID NO: 7123 - protein, 561 aa, Cicer arietinum
MSAMLQPQIILLKEGTDTSQGKPQLVSNINACTAVADVVRTTLGPRGMDKLIHDDKGSVTISNDGATIMKLLDIVHPAAKILVDIAKSQDSEVGDGTTTVVLLAAEFLREAKPFIEDGVHSQNLIRSYRTACTLAIEKIKELAVSIEGKSLEEKKNLLGKCAATTLSSKLIGGEKEFFASMVVDAVIAIGTDDRLNMIGIKKVPGGNMRDSFLVNGVAFKKTFSYAGFEQQPKKFLDPKILLLNVELELKSEKENAEIRLSDPSQYQSIVDAEWNIIYDKLDKCVQSGAKVVLSRLAIGDLATQYFADRDIFCAGRVAEEDLKRVAAATGGTVQTSVNNIIDEVLGTCEIFEERQVGNERFNIFNGCPSGQTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHALATGEGAPFGVDIATGGIADSFANFVWEPAVVKINAINAATEAACLVLSVDETVKNPKSESAQGEAAASAMGGRGRGGGFRGRGRGMRR

SEQ ID NO: 7124 - protein, 552 aa, Arachis hypogaea
LKEGTDTSQGKAQLVSNINACTAVADVVRSTLGPRGMDKLIHDDKGSVTISNDGATIMKLLDIVHPAAKILVDIAKSQDSEVGDGTTTVVLLAAEFLKEAKPFIEDGVHSQNLIRSYRTACTLAIEKIKELAVSIEGKSLEEKKSLLAKCASTTLSSKLIGGEKEFFASMVVDAVIAIGNDDRLNMIGIKKVPGGNMRDSFLVNGVAFKKTFSYAGFEQQPKKFLNPKILLLNVELELKSEKENAEIRLSDPSQYQSIVDAEWNIIYDKLDKCVNSGAKVVLSRLAIGDLATQYFADRDIFCAGRVAEEDLKRVAAATGGTVQTSVNNIIDEVLGTCEVFEEKQVGNERFNIFNGCPSGQTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHALPSGEGAPYGVDISTGGIANSFTNFVWEPAIVKINAINAATEAACLILSVDETVKNPKSESAQGDAAASAMGGRGRGGAFRGRGRGRGMRR

SEQ ID NO: 7125 - protein, 379 aa, Trigonella foenum-graecum
MVVDAVIAIGTDDRLNMIGIKKVPGGNMRDSFLVNGVAFKKTFSYAGFEQQPKKFLDPKILLLNVELELKSEKENAEIRLSDPSQYQSIVDAEWNIIYDKLDKCVQSGAKVVLSRLAIGDLATQYFADRDIFCAGRVAEEDLKRVAAASGGTVQTSVNNIIDEVLGTCEIFEERQVGNERFNIFNGCPSGQTATIVLRGGADQFIEEAERSLHDAIMIVRRAMKNSTVVAGGGAIDMEISRYLRQHARTIAGKSQLFINSYAKALEVIPRQLCDNAGFDATDVLNKLRQKHALPSGEGAPYGVDIATGGIADSFANFVWEPAVVKINAINAATEAACLVLSVDETVKNPKSESAQGEAAASAMGGRGRGGRGRGRGMRR

SEQ ID NO: 7126 - protein, 560 aa, Brassica rapa
MASMMQPQIILLKEGTDTSQGKAQLLSNINAVTAVGDVLRTTLGPRGMDKLIHDDKGSVTISNDGATIMKLLDIVHPAAKILVDIAKSQDSEVGDGTTTVVLLAAEFLKEAKPFVEDGVHSQNLIRSYRTASTLAIEKVKELVVSIEGKSVEEKKGMLAKCAATTLSSKLIGGEKEFFATMVVDAVMAIGDDDRLNLIGIKKVPGGNMRDSFLVDGVDLKKTFSYAGFEQQPKKFLNPKILLLNIELELKSEKENAEIRLSDPSQYQSIVDAEWNIIYDKLDKCVESGAKVVLSRLAIGDLATQYFADRDIFCAGRVAEEDLNRVAAAAGGTVQTSVNNIIPEVLGTCEIFEEKQVGGERLNIFSGCPSGRTATIVLRGGADQFIEEAERSLHDAIMIVRRAVKNSTVVPGGGAIDMEVSKYLRQHSRTIAGKSQLFINSYAKALEVIPRQLCDNAGFDATDVLNKLRQKHAMQSGEGASYGVDINTGGIADSYANFVWEPAVVKINAINAATEAACLILSVDETVKNPKSESAQGDAAAGAMGRGRGGGGGRGRGMRRR

SEQ ID NO: 7127 - protein, 555 aa, Mimulus guttatus
MSSMMQPQIILLKEGTDTSQGKPQLISNMNACMAVADVVRTTLGPRGMDKLIHDDKGTTISNDGATIMKLLDIIHPAAKILVDIAKSQDSEVGDGTTSVVLFAGEFLKEAKPFIEDGVHPQNLIRSYRTASNLAIAKIKDLAVSIEGKSMEEKKSLLAKCAATTLSSKLIGGEKEFFATMVVDAVIAIGNGDRLNMIGIKKVPGGTMRDSFLVNGVAFKKTFSYAGFEQQPKKFVNPKILLLNIELELKSEKENAEIRLSDPLQYQSIVDAEWNIIYDKLDKCVESGAKIVLSRLAIGDLATQYFADRDIFCAGRVTEEDLLRVAAATGGTLQTTVNNVIDEVLGTCDLFEERQVGNERFNIFSGCPSGQTATIVLRGGADQFIEEAERSLHDAIMIVRRAMRNSTVVAGGGAIDMEISRYLRQHARTIAGKSQLFINAYAKALEVIPRQLCDNAGFDATDVLNKLRQKHALASGEGASYGVDINTGGISDSFANFVWEPAVVKINAINAATEAACLVLSVDETVKNPKSESAQGDAGAMGGGRGRGRGRGMRRR

SEQ ID NO: 7128 - protein, 555 aa, Papaver somniferum
MSNMMQPQIILLKEGTDTSQGKAQLISNINACTAVADVVRTTLGPRGMDKLIHDDKGNTTISNDGATIMKLLDIVHPAAKILVDIAKSQDSEVGDGTTTVVLLCGEFLKEAKPFIEDGVHPRNLIRSFRTAADLAIEKIKDLAVSIEGKSMEEKKLLLAKCASTTLSSKLIGGEKEFFSTMVVDAVTAIGNDDRLNLIGIKKVPGGTMRDSFLVNGVAFKKTFSYAGFEQQPKQFSNPKILILNIELELKSEKENAEIRLSDPLQYQSIVDAEWNIIYDKLDKCAQSGAKIVLSRLAIGDLATQYFADRDIFCAGRVTEEDLQRVSAATGAMVQTSVNNVIDEILGTCEVFEEKQVGNERFNIFSGCPSGLTATIVLRGGADQFIEEAERSLHDAIMIVRRAMKNSTVVAGGGAIDMEISRYLRQHARTIAGKSQLFINSYAKALEVIPRQLCDNAGFDATDVLNKLRQKHALPSGEGSLYGVDINTGGIVDSYANFVWEPAVVKINAINAATEAACLVLSIDETVKNPKSESAQGDAAASAMGRGRGRGRGMRR

SEQ ID NO: 7129 - protein, 553 aa, Chrysanthemum coronarium
MASMMQPQIILLKEGTDTSQGKPQLISNINACMAVADVVRTTLGPRGMDKLIHDDRGVTTISNDGATIMKLLDIVHPAAKILVDIAKSQDSEVGDGTTSVVLLAGEFLREAKPFIEDGVHPQNLIRSYRTAAFMAIEKIKELAVSIEGKSLDEKRSLLAKCAATTLSSKLIGGEKDFFATMVVDAVVAIGNEDRLNMIGIKKVPGGTMRDSFLVNGVAFKKTFSYAGFEQQPKKFLNPKILLLNIELELKSEKENAEIRLSDPLQYQSIVDAEWNIIYDKLDKCVQSGAKIVLSRLAIGDLATQYFADRDIFCAGRVAEDDLHRVAAATGGTVQTSVNNVIDEVLGSCEVFEEKQVGNERFNIFSGCPSGQTATIVLRGGADQFIEEAERSLHDAIMIVRRAMKNSTVVAGGGAIDMEISRHLWQHARKIAGKSQLFINAFAKALEVIPRQLCDNAGFDATDVLNKLRQKHALESGEGALYGVDINTGGICDSFANFVWEPAVVKINAINAAAEAACLILSVDETVKNPKSESAQGDATAMGRGRGGGGMRGG

SEQ ID NO: 7130 - protein, 561 aa, Fragaria vesca
MAGMLQPQIILLKEGTDTSQGKAQLVSNINACTAVADVVRTTLGPRGMDKLIHDDKGNVTISNDGATIMKLLDIVHPAAKILVDIAKSQDSEVGDGTTTVVLLAGEFLKEAKPFVEDGVHPQNLIRSYRTASYLAIERIKQLASSIEGKSLEEKKELLANCAATTLSSKLIGGEKVFFSKMVVDAVIAIGDEDRLNMIGIKKVAGGNMRDSFLVKGVAFKKTFSYAGFEQQPKKFLNPKILILNIELELKSEKENAEIRLSDPSQYQSIVDAEWNIIYDKLDKCVQSGARVVLSRLAIGDLATQYFADRDIFCAGRVAEEDLQRVAAATGGTVQTSINDVIDEVLGTCECFEEKQVGNERFNIFSGCPSGRTATIVLRGGADQFIEEAERSLHDAIMIVRRALKNSTVVPGGGAIDMELSRYLRDKAREIAGRSQFFINSYAKALEVIPRQLCDNAGFDATDMLNKLRQKHSTGEGAPYGVDINTGGIADSYANFVWEPAVVKINAINAATEAACLVLSVDETVKNPKSESAQGDAAASAMGGRGRGGAAFRGRGRGTRRR

SEQ ID NO: 7131 - protein, 158 aa, Papaver somniferum
MSNMMQPQIILLKEGTDTSQGKAQLISNINACTAVADVVRTTLGPRGMDKLIHDDKGNTTISNDGATIMKLLDIVHPAAKILVDIAKSQDSEVGDGTTTVVLLCGEFLKEAKPFIEDGVHPRNLIRSFRTAADLAIEKIKDLAVSIEVKYGRKEVVIG

SEQ ID NO: 7132 - protein, 544 aa, Panax ginseng
MAAMMQPQIILLKEGTDTSQGKAQLISNINACMAVADVVRTTLGPRGMDKLIHDDKGNTTISNDGATIMKLLDIVHPAAKILVDIAKSQDSEVGDGTTTVVLLAGEFLKEAKPFIEDGVHPQNLIRSYRNASYLAIEKIKELAVGIEGKSLEEKKSLLANCAATTLSSKLIGGEKEFFASMVVDSVLAIGSDDRLNMIGIKKVPGGTMRDSFLVNGVAFKKTFSYAGFEQQPKKFENPKILLLNIELELKSEKENAEIRLSDPLQYQSIVDAEWNIIYDKLDKCVKSGAKIVLSRLAIGDLATQYFADRDIFCAGRVSEEDLHRVAAATGGTVQTSVNNVIDEVLGSCEIFEERQVGNERFNIFGGCPLGQTATIVLRGGADQFIEEAERSLHDAIMIVRRAVKNSTVVAGGGAIDMEISRYLRQHARTIAGKSQLFINSYAKALEIIPRQLCDNAGFDATDVLNKLRQKHALPSGEGALFGVDINTGGIADSYANFVWEPAVVKINAINAATEAACLILSVDETVKNPKSESAQGEAASSAMG

SEQ ID NO: 7133 - protein, 141 aa, Plantago ovata
MASMMQPQIILLREGTDTSQGKPQLISNINACTAVADVVRTTLGPRGMDKLIHDDKGNTTISNDGATIMKLLDIIHPAAKILVDIAKSQDSEVGDGTTTVVLLAGEFLKAAKPFIEEGVHPQNLIRSYRTASLWHFRGSKN

SEQ ID NO: 7134 - protein, 562 aa, Chrysanthemum coronarium
MASMMQPQIILLKEGTDTSQGKPQLISNINACMAIADVVRTTLGPRGMDKLIHDDRGVTTISNDGATIMKLLDIVHPAAKILVDIAKSQDSEVGDGTTSVVLLAGEFLREAKPFIEDGVHPQNLIRSYRTAAFMAIEKVKELAESIEGKSLDEKRTLLAKCAATTLSSKLIGGEKDFFAKMVVDAVIAIGNDDRLNMIGIKKVPGGTMRDSFLVNGVAFKKTFSYAGFEQQPKKFLNPKILLLNIELELKSEKENAEIRLSDPLQYQSIVDAEWNIIYDKLDKCVKSGAKIILSRLAIGDLATQYFADRDIFCAGRVAEDDLNRVMAATGGAVQTSVNNVIDEVLGSCEIFEEKQVGNERFNIFSGCPSGLTATIVLRGGADQFIEEAERSLHDAIMIVRRAMKNSTVVAGGGAIDMEVSRHLWKHARNIAGKSQLFINAFAKALEVIPRQLCDNAGFDATDVLNKLRQKHALPSDEGARYGVDINTGGICDTFANFVWEPAVVKINAINAAAEAACLILSVDETVKNPKSESAQGDAAAMGRGRGGGGGMRGGRGRGMRRR

SEQ ID NO: 7135 - protein, 526 aa, Echinochloa colona
TRRLCAPRWGPRQWTSSFHDDKGGVTISNDGATIMRLLDIVHPAAKILVDIARSQDSEVGDGTTTVVLLAGEFLKEAKPYIEDGVHPHSLIRSYRTAGYLATEKVKELAVSIEGKSLEEKKSLLAKCAATTLSSKLIGGEKEFFATMVVDAVLAIGNDDRLNMIGIKKVPGGTMRDSFLVNGVAFKKTFSYAGFEQQPKKFLTPKILLLNIELELKSEKENAEIRLSDPLQYQSIVDAEWNIIYDKLDKCVKSGAKIVLSRLAIGDLATQYFADRDIFCAGRVTEEDLQRVAAATGGTVQTSVNNVIDEVLGSCEVFEERQVGNERFNIFSGCPSGQTATIVLRGGADQFIEEAERSLHDAIMIVRRALKNSTVVPGGGAIDMEVSKYLRQHARTIAGKSQFFVNSFAKALEVIPRQLCDNAGFDATDVLNKLRQKHASGEGANYGVDINTGGIADSFANFVWEPAVVKINAINAATEAACLILSVDETVKNPKSESAQGDAAAMAGRGRGGGAMRGRGGRGMRRR

SEQ ID NO: 7136 - protein, 562 aa, Taxus baccata
MASMLQPQIILLKEGTDTSQGKPQLISNINACTVVVDTVRTTLGPRGMDKLIHDDRGSITISNDGATIMKLLDIVHPAAKILVDIAKSQDSEVGDGTTTVVLLAGEFLKEAKPFIEEGVHPQNLIRSYRTAAYLAINKVKDLSISIEGKSLEEKKSLLEKCAATTLSSKLIGGEKEFFAKMVVDAVIAIGHEDRLNMIGIKKVQGGNMRDSFLVKGVAFKKTFSYAGFEQQPKKFSNPKLLLLNVELELKSEKENAEVRLSDPTKYQSIVDAEWNIIYDKLDKCVKSGAKIVLSRLAIGDLATQYFADRDVFCAGRVTEEDLQRVAAATGGAVQTSVNNIVPEVLGTCEVFEEKQVGNERFNLFSGCPSGLTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHALPSGEGAPYGVDINTGGIADSFTNFVWEPAVVKINAINAATEAACLILSVDETIKNPKSESAQGEGAANAMAGRGRGGGFRGRGRGMRRR

SEQ ID NO: 7137 - protein, 556 aa, Cephalotaxus harringtonia
PQIILLKEGTDTSQGKPQLISNINACTVVMDTVRTTLGPRGMDKLIHDDRGSITISNDGATIMKLLDIVHPAAKILVDIAKSQDSEVGDGTTTVVLLAGEFLKEAKPYIEEGVHPQNLIRSYRTAAYLAINKVKELSKSIEGKSREEKKHLLEKCAATTLSSKLIGGEKEFFAKMVVDAVIAIGQEDRLNMIGIKKVQGGNMRDSFLVEGVAFKKTFSYAGFEQQPKKFLNPKLLLLNVELELKSEKENAEVRLSDPTKYQSIVDAEWNIIYDKLDKCVKSEAKIVLSRLAIGDLATQYFADRDVFCAGRVTEEDLQRVAAATGGVVQTSVNNIVPEVLGTCEVFEEKQVGNERFNVFSGCPSGLTATIVLRGGADQFIEEAERSLHDAIMIVRRALKNSTVVPGGGAIDMEISRYLRQHARTIAGKSQLFINSYAKALEVIPRQLCDNAGFDATDVLNKLRQKHALSSGEGAPYGVDINTGGIADSFANFVWEPAVVKINAINAATEAACLILSVDETIKNPKSESAQGEGAANAMAGRGRGGGFRGRGRGMRRR

SEQ ID NO: 7138 - protein, 575 aa, Amborella trichopoda
MAAMMQPQIILLKEGTDTSQGKPQLISNINACTAVVDSVRTTLGPRGMDKLIHDDKGNTTISNDGATIMKLLDIVHPAAKILVAIANSQDSEVGDGTTTVVLLAGEFLKEAKPFIEDGVHPRNLIRSYRIASYLAINKIKELAVSIEGRSFEEKKDLLQKCAATTLSSKLIGGEKEFFASMVVDAVMAIGQGDRLNLIGVKKVPGGNMRDSFLVKGVAFKKTFSYAGFEQQPKAFSDPKILLLNIELELKSEKENAEIRLTDPLQYQSIVDAEWNIIYDKLDKCVKSGAKIVLSRLAIGDLATQYFADRDIFCAGRVTEEDLQRVAAATGGTVQTSVNNIIDESPDSKLLQVTGKVLGSCELFEEKQVGNERFNIFSGCPSGQTATIVLRGGADQFIEEAERSLHDAIMIVRRALRNSTVVAGGGAIDMEISRYLRQHARTIAGKSQLFINSYAKALEIIPRQLCDNAGFDATDVLNKLRQKHALPSGEGARYGVDINTGGITDTFANFVWEPAVVKINAINAATEAACLVLSVDETVKNPKSESAQGEAAASAMGRGRGGGPAFRGRGRGMRRR

SEQ ID NO: 7139 - protein, 562 aa, Picea glauca
MSTMMQPQIILLKEGTDTSQGKAQLISNINACTAIVDAVRSTLGPRGMDKLIHDDKGTTTISNDGATIMKLLDIVHPAAKILVDIAKSQDSEVGDGTTTVVLFAGEFLKEAKPFIEDGVHPQNLIRSFRTAAYLAINKVKELAVSIEGKSLEEKKGLLEKCAATTLSSKLIGGEKDFFAKMVVEAVISIGQEDRLNMIGIKKVQGGNMRDSFLVKGVAFKKTFSYAGFEQQPKKFLNAKILLLNVELELKSEKENAEVRLSDPTKYQSIVDAEWNIIYDKLDKCVKGGAKIVLSRLAIGDLATQYFADRDIFAAGRVAEEDLQRVAAATGGSVQTSVNNIVPEVLGTCELFEERQVGNERFNIFSGCPSGQTATIVLRGGADQFIDEAERSLHDAIMIVRRAMKNSTIVSGGGAIDMEISRYLRQHARTIAGKSQLFINSYAKALEVIPRQLCENAGFDATDVLNKLRQKHALPSGEGAPYGVDINTGGIADSFANFVWEPAVVKINAINAATEAACLILSVDETVKNPKSESAQGEGAANAMAGRGRGGGFRGRGRGMRRR

SEQ ID NO: 7140 - protein, 562 aa, Sequoia sempervirens
MATMLQPQIILLKEGTDTSQGKAQLISNINACTAVVDTVRTTLGPRGMDKLIHDDRGSITISNDGATIMKLLDIVHPAAKILVDIAKSQDSEVGDGTTTVVLLAGEFLKEAKPFIEEGVHPQNLIRSYRTAAYLAINKVREFSISIEGKSIEEKKGLLEKCAATTLSSKLIGGEKEFFAKMVVDAVISIGQEDRLNMIGIKKVQGGNMRDSFLVKGVAFKKTFSYAGFEQQPKKFLHPKLLLLNVELELKSEKENAEVRLSDPTKYQSIVDAEWNIIYDKLDKCVKSGAKIILSRLAIGDLATQYFADQDVFCAGRVTEEDLQRVAAATGGSVQTSVNNIVPEVLGTCEIFEEKQVGNERFNVFSGCPSGLTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHALPSGEGAPYGVDINTGGIADSLANFVWEPAVVKINAINAATEAACLILSVDETIKNPKSESAQGEGAANAMAGRGRGGGFPGRGRGMRRR

SEQ ID NO: 7141 - protein, 562 aa, Pinus pinaster
MSTMLQPQIILLKEGTDTSQGKAQLISNINACMAIVDAVRSTLGPRGMDKLIHDDKGTTTISNDGATIMKLLDIVHPAAKILVDIAKSQDSEVGDGTTTVVLFAGEFLKEAKPFIEDGVHPQNLIRSFRTAAYLAINKVKELAVSIEGKSIEEKKGLLERCAATTLSSKLIGGEKEFFAKMVVEAVISIGQEDRLNMIGIKKVQGGNMRDSFLVKGVAFKKTFSYAGFEQQPKKFLNVKILLLNVELELKSEKENAEVRLSDPTKYQSIVDAEWNIIYDKLDKCVKSGAKIVLSRLAIGDLATQYFADRDIFCAGRVTEEDLQRVAAATGGSVQTSVNNIVPEVLGSCELFEERQVGNERFNIFSGCPSGLTATIVLRGGADQFIDEAERSLHDAIMIVRRAMKNSTIVSGGGAIDMEISRYLRQHARTIAGKSQLFINSYAKALEVIPRQLSENAGFDATDVLNKLRQKHALPSGEGAPYGVDINTGGITDSFANFVWEPAVVKINAINAATEAACLILSVDETVKNPKSESAQGEGAANAMAGRGRGGGFRGRGRGMRRR

SEQ ID NO: 7142 - protein, 130 aa, Sciadopitys verticillata
ILLKEGTDTSQGKPQLISNINACTAIVDTVRTTLGPRGMDKLIHDDRGSITISNDGATIMKLLDIVHPAAKILVDIAKSQDSEVGDGTTTVVLLAGEFLKEAKPFIEEGVHPQKPYSELSYSSLFGYQQS

SEQ ID NO: 7143 - protein, 545 aa, Euphorbia peplus
GTDTSQGKAQLISNINACTAVADVVRTTLGPRGMDKLIHDDKGNVTISNDGATIMKLLDIVHPASKILVDIAKSQDSEVGDGTTTVVLLAAEFLKEAKPFIEDGVHPQNLIRSYRTACNLAIDKIRELAVSIEGKSLEEKKSLLAKCAATTLSSKLIGGEKDFFAQMVVDAVIAIGDEDRLNMIGIKKVPGGNMRDSFLVNGVAFKKTFSYAGFEQQPKKFLNPKLLLLNIELELKSEKENAEIRLSDPSQYQSIVDAEWNIIYDKLDKCVQSGAKVVLSRLAIGDLATQYFADRDIFCAGRVAEEDLQRVAAATGGTVQTTVNNIIDEVLGTCEVFEEKQVGNERFNIFSGCPSGRTATIVLRGGADQFIEEAERSLHDAIMIVRRAMKNSTVVAGGGAIDMEISRYLRQHARTIAGKSQLFINSYAKALEVIPRQLCDNAGFDATDVLNKLRQKHSSPSGEGASFGVDINAGVVADSFANFVWEPAVVKINAITAASEAACLVLSVDETVKNPKSESAQGEAAASAMGGRGRGGGRGRGMRRR

SEQ ID NO: 7144 - protein, 536 aa, Flaveria ramosissima
QLISNINACMAVADVVRTTLGPRGMDKLIHDDKGNTTISNDGATIMKLLDIVHPAAKILVDIAKSQDSEVGDGTTTVVLLAGEFLREAKPFIEDGVHPQNLIRSYRSASNMAIEKIKELAVSIEGKSLDEKRSLLAKCAATTLSSKLIGGEKDFFATMVVDAVIAIGYDDRLNMIGIKKVPGGTMRDSFLVNGVAFKKTFSYAGFEQQPKKFQNPKILLLNIELELKSEKENAEIRLSDPLQYQSIVDAEWNIIYDKLDKCVKSGAKIVLSRLAIGDLATQYFADRDIFCAGRVAEDDLHRVAAATGGMVQTSVNNVIDEVLGSCEVFEEKQVGNERFNIFSGCPSGQTATIVLRGGADQFIEEAERSLHDAIMIVRRAMKNSTVVAGGGAIDMEISRYLWQHARNIAGKSQLFINAFAKALEVIPRQLCDNAGFDATDVLNKLRQKHALPSGEGALYGVDINTGGISDSFANFVWEPAVVKMNAINAATEAACLVLSVDETVKNPKSESAQGEAAAGMGRGRGGGGMRGRGMRRR

SEQ ID NO: 7145 - protein, 537 aa, Cucumis melo
VSNINACTAVADVVRTTLGPRGMDKLIHDDKGNVTISNDGATIMKLLDIVHPAAKILVDIAKSQDSEVGDGTTTVVLLAAEFLKEAKPFIEDGVHSQNLIRSYRTASYLAIEKVKELAISIEGKSLEEKKSLLAKCAATTLSSKLIGGEKDFFASMVVDSVIAIGNEDRLNMIGIKKVPGGTMRDSFLVNGVAFKKTFSYAGFEQQPKKFSNPKILLLNIELELKSEKENAEIRLSDPSQYQSIVDAEWNIIYEKLDKCVESGAKVVLSRLAIGDLGTQYFADRDIFCAGRVAEEDLQRVAAATGGTIQTSVNNVIDEVLGTCEVFEEKQVGNERYNIFSGCPSGRTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHAHPSGEGAPFGVDINTGGVADSFANFVWEPAVVKINAINAATEAACLILSVDETVKNPKSESAQGEAAASAMGGRRGGAAFRGRGRGMRRR

SEQ ID NO: 7146 - protein, 562 aa, Pinus taeda
MSTMLQPQIILLKEGTDTSQGKAQLISNINACMAIVDAVRSTLGPRGMDKLIHDDKGTTTISNDGATIMKLLDIVHPAAKILVDIAKSQDSEVGDGTTTVVLFAGEFLKEAKPFIEDGVHPQNLIRSFRTAAYLAINKVKELAVSIEGKSIEEKKGLLERCAATTLSSKLIGGEKEFFAKMVVEAVISIGQEDRLNMIGIKKVQGGNMRDSFLVKGVAFKKTFSYAGFEQQPKKFLNVKILLLNVELELKSEKENAEVRLSDPTKYQSIVDAEWNIIYDKLDKCVKSGAKIVLSRLAIGDLATQYFADRDIFCAGRVTEEDLQRVAAATGGSVQTSVNNIVPEVLGTCELFEERQVGNERFNIFSGCPSGLTATIVLRGGADQFIDEAERSLHDAIMIVRRAMKNSTIVSGGGAIDMEISRYLRQHARTIAGKSQLFINSYAKALEVIPRQLSENAGFDATDVLNKLRQKHALPSGEGAPYGVDINTGGITDSFANFVWEPAVVKINAINAATEAACLILSVDETVKNPKSESAQGEGAANAMAGRGRGGGFRGRGRGMRRR

SEQ ID NO: 7147 - protein, 557 aa, Podocarpus macrophillus
QPQIILLKEGTDSSQGKPQLISNINACTAIVDTVRTTLGPRGMDKLIHDDRGSITISNDGATIMKLLDIVHPAAKILVDIAKSQDSEVGDGTTTVVILAGEFLKEAKPFIEEGVHPQNLIRSYRTAAYLAINKVKELSVSIEGKSLEEKKGLLEKCAETTLSSKLIGGEKEFFAKMVVDAVIAISQEDRLNMIGIKKVQGGNMRDSFLVKGVAFKKTFSYAGFEQQPKKFLNPTILLLNIELELKSEKENAEIRLSDPTKYQSIVDAEWNIIYDKLDKCVKSGAKIVLSRLAIGDLGTQYFADRDVFCAGRVAEEDLQRVAAATGGSVQTSVNNIVPEVLGTCECFEEKQVGNERFNIFSGCPSGLTATIVLRGGADQFIDEAERSLHDAIMIVRRALKNSTIVAGGGAIDMEISRYLRQHARTIAGKSQLFINSYAKALEIIPRQLCDNAGFDATDVLNKLRQKHALPSGEGAPYGVDINTGGIADSLANFVWEPAVVKINAINAATEAACLVLSVDETIKNPKSESAQGEGAANAMAGRGRGAGFRGRGRGMRRR

SEQ ID NO: 7148 - protein, 396 aa, Cedrus atlantica
MSAMLQPQIILLKEGTDTSQGKAQLISNINACMAIVDAVRSTLGPRGMDKLIHDDKGTTTISNDGATIMKLLDIVHPGAKILVDIAKSQDSEVGDGTTTVVLFAGEFLKEAKPFIEDGVHPQNLIRSFRTAAYLAINKVKELAVSIEGKSLEEKKGLLEKCAATTLSSKLIGGEKDFFAKMVVDSVISIGQEDRLNMIGIKKVQGGNMRDSFLVRGVAFKKTFSYAGFEQQPKKFLNPKILLLNVELELKSEKENAEVRLSDPTKYQSIVDAEWNIIYDKLDKCVKSGAKIVLSRLAVGDLATQYFADRDIFCAGRVAEEDLQRVSAATGGSVQTSVNNIVPEVLGTCELFEERQVGNERFNIFSGCPSGLTATIVYEVVRISSLMRQRGACMMPS

SEQ ID NO: 7149 - protein, 562 aa, Abies balsamea
MAGMLQPQIILLKEGTDTSQGKSQLISNINACTAIVDAVRTTLGPRGMDKLIHDDKGNTTISNDGATIMKLLDIVHPAAKILVDIAKSQDSEVGDGTTTVVLFAGEFLKEAKPFIEDGVHPQNLIRSFRTAAYLAINKVRELAVSIEGKSLDEKKGLLEKCAATTLSSKLIGGEKDFFAKMVVEAVISIGQEDRLNMIGIKKVQGGNMRDSFLVKGVAFKKTFSYAGFEQQPKKFLNPKILLLNVELELKSEKENAEVRLSDPTKYQSIVDAEWNIIYDKLDRCVKSGALIVLSRLAIGDLATQYFADRDIFSAGRVAEEDLQRVAAATGGSVQTSVNNIVPEVLGTCELFEERQVGNERFNIFSGCPSGQTATIVLRGGADQFIDEAERSLHDAIMIVRRAMKNSTIVSGGGAIDMEISRYLRQHARTIAGKSQLFINSYAKALEVIPRQLCENAGFDATDVLNKLRQKHALPANEGGPYGVDINTGGIADSFANFVWEPAVVKINAINAATEAACLILSVDETVKNPKSESAQGEGAANAMAGRGRGGGFRGRGRGMRRR

SEQ ID NO: 7150 - protein, 559 aa, Olea europaea
MAAMMQPQIILLKEGTDSSQGKPQLVSNINACMAVADVVRTTLGPRGMDKLIHDEKGNTTISNDGATIMKLLDIVHPAAKILVDIAKSQDSEVGDGTTTVVLLAGECLKEAKPFIEDGVHPQNLIRSYRTASQLAIEKIKELAFSIEGKSLEEKKSLLGKCAATTLSSKLIGGEKEFFASMVVDAVITIGNDDRLNMIGIKKVPGGNMRDSFLVNGVAFKKTFSYAGFEQQPKKFVNPKILLLNIELELKSEKENAEIRLSDPLQYQSIVDAEWNIIYDKLDKCVKSGAKIVLSRLAIGDLATQYFADRDIFCAGRVTEEDLQRVAAATGGTVQTTVNNIIDEILGSCELFEERQVGNERFNIFSGCPSGQTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHALPSGEGAPYGVDINTGGIADSFANFVWEPAVVKINAVNAATEAACLVLSVDETVKTQSLRVHKEKLLQALWAAEGVVELLFGGVGVG

SEQ ID NO: 7151 - protein, 213 aa, Nicotiana benthamiana
MASMMQPQIILLKEGTDTSQGKAQLVSNINACMAVADVVRTTLGPRGMDKLIHDEKGNTTISNDGATIMKLLDIIHPAAKILVDIAKSQDSEVGDGTTTVVLLAGEFLKEAKPFIEEGVHPQNLIRSYRAASNMAIEKVKELAVSIEGKSLEEKKSLLAKCAATTLSSKLIGGEKEFFAPMVVDAVLAIGNDDRLNMIGIKRWPEVICGILSL

SEQ ID NO: 7152 - protein, 355 aa, Gnetum gnemon
MRDSFLVKGVAFKKTFSYAGFEQQPKKFVDPKILLLNVELELKSEKENAEVRLSDPTKYQSIVDAEWNIIYDKLEKCVKSGAEIVLSRLAIGDLATQYFADRDIFCAGRVTEEDLQRVAAATGGAVQTTVNNIIPEVLGSCELFEEKQVGNERFNIFSGCPSGQTATIVLRGGADQFIDEAERSLHDAIMIVRRALKNSTIVPGGGAIDMEISRYLRQHARTIAGKSQLFINSYAKALEVIPRQLCENAGFDATDVLNKLRQKHALPSGEGESFGVDINAGGICDSLMSFVWEPAVVKINAINAATEAACLILSVDETVKNPKSESAQGEGAANALAGRGRGGGFRGRGRGMRRR

SEQ ID NO: 7153 - protein, 532 aa, Prunus persica
MSSMLQPQIILLKEGTDTSQGKAQLVSNINACTAVADVVRTTLGPRGMDKLIHDDKGSVTISNDGATIMKLLDIVHPAAKILVDIAKSQDSEVGDGTTTVVLLAGEFLKEAKPFIEDGVHPQNLIRSYRTASYLAIEKIKELAVSIEGKSLEEKKTLLAKCAATTLSSKLIGGEKDFFASIVVDAVIAIGDEDRLNMIGIKKVSGGNMRDSFLVSGVAFKKTFSYAGFEQQPKKFLNPKILLLNIELELKSEKENAEIRLSDPSQYQSIVDAEWNIIYDKLDKCVQSGAKVVLSRLAIGDLATQYFADRDIFCAGRVTEEDLQRVAAATGGTVQTSINNVIDEVLGTCECFEEKQVGNERFNIFSGCPSGRTATIVLRGGADQFIEEAERSLHDAIMIVRRALKNSTVVAGGGAIDVIPRQLCDNAGFDATDVLNKLRQKHALPSGEGALYGVDINTGGIADSFANFVWEPAVVKINAINAATEAACLVLSVDETVKNPKSESAQGEAAASAMGGRGRGGGLRGRGRGMRRR

SEQ ID NO: 7154 - protein, 562 aa, Pseudotsuga menziesii
MSTMMQPQIILLKEGTDTTQGKAQLISNINACTAIVDAVRSTLGPRGMDKLIHDDKGTTTISNDGATIMKLLDIVHPAAKILVDIAKSQDSEVGDGTTTVVLFAGEFLKEAKPFIEDGVHPQNLIRSFRTAAYLAINKVKELAISIEGKSLEEKKGLLEKCAATTLSSKLIGGEKDFFAKMVVDAVISIGQEDRLNMIGIKKVQGGNMRDSFLVKGVAFKKTFSYAGFEQQPKKFLNAKILLLNVELELKSEKENAEVRLSDPTKYQSIVDAEWNIIYDKLDNCVKSGAEIVLSRLAIGDLATQYFADRDIFSAGRVAEEDLQRVAAATGGSVQTSVNNIVPEVLGTCEVFEEKQVGNERFNIFSGCSSGQTTTIVLRGGADQFIDEAERSLHDAIMIVRRAMKNSTIVAGGGAIDMEISRYLRQHARTIAGKSLLFINSYAKALEVIPRQLCENAGFDATDVLNKLRQKHALPSGEGAPYGVDINTGGIANTIASFVWEPAVVKINAINAATEAACLILSVDETVKNPKSESAQGEGAANAMAGRGRGGGFRGRGRGMRRR

SEQ ID NO: 7155 - protein, 526 aa, Ambrosia trifida
MAVADVVRTTLGPRGMDKLIHDDKGNTTISNDGATIMKLLDIVHPAAKILVDIAKSQDSEVGDGTTTVVLLAGEFLREAKPFIEDGVHPQNLIRSYRAASNMAIEKIKELAVSIEGKSLDEKRSLLAKCAATTLSSKLIGGEKDFFAKMVVDAVIAIGNDDRLNMIGIKKVPGGTMRDSFLVNGVAFKKTFSYAGFEQQPKKFENPKILLLNIELELKSEKENAEIRLSDPLQYQSIVDAEWNIIYDKLDKCVKSGAKIVLSRLAIGDLATQYFADRDIFCAGRVAEDDLHRVAAATGGTVQTSVNNVIDEVLGSCDVFEEKQVGNERFNIFSGCPSGQTATIVLRGGADQFIEEAERSLHDAIMIVRRAMKNSTVVAGGGAIDMEISRYLWQHARSIAGKSQLFINAFAKALEVIPRQLCDNAGFDATDVLNKLRQKHALPSGEGALYGVDINTGGICDSFANFVWEPALVKINAINAATEAACLVLSVDETVKNPKSESAQGEAAAGMGRGRGGGMRGRGMRRR

SEQ ID NO: 7156 - protein, 495 aa, Festuca arundinacea
DGATIMRLLDIIHPAAKVLVNIAKSQDSEVGDGTTTVVLLASEFMKEAKPYVEDGVHPHSLIRSYRIAGNMAIQRVKELAVSIEGKSLEEKKSLLAKCAATTLSSKLIGGEKEFFASMVVDAVLAIGHDDRLNLIGIKKVPGGTMRDSFLVNGVAFKKTFSYAGFEQQPKKFLNPKILLLNIELELKSEKENAEIRLSDPLQYQSIVDAEWNIIYDKLDKCVQSGAKIVLSRLAIGDLATQYFADRDIFCAGRVTEEDLQRVSSASGGTVQTSVNNVIDEVLGTCEVFEEKQVGNERFNIFSGCPSGQTATIVLRGGADQFIEEAERSLHDAIMIVRRAVKNSTVVPGGGAIDMEISKYLRQHARTIAGKSQFFVNSFAKSLEVIPRQLCDNAGFDATDVLNKLRQKHASGDGANYGVDINTGGIADSFANFVWEPAVVKINAINAATEAACLILSVDETVKNPKSESAQGDAAAMGGRGGGGMRGRGGRGMRRR

SEQ ID NO: 7157 - protein, 511 aa, Allium cepa
MSSMLQPQIILLKEGTDTSQGKAQVISNINACTGVADCVRTTLGPRGMDKLIHDDKGNTTISNDGATIMKLLDIVHPAAKILVDIAKSQDSEVGDGTTTVVLLAGEFLKEAKPFIEDGVHPQNLIRSYRAASNLAINKVKELAVSIEGKSLEEKKSLLAKCAATTLSSKLIGGEKEFFATMVVDAVLAIGNDDRLNLIGIKKVPGGTMRDSFLVNGVAFKKTFSYAGFEQQPKKFLSPKILLLNVELELKSEKENAEIRLSDPLQYQSIVDAEWNIIYDKLDKCVQSGAKIVLSRLAIGDLATQYFADRDIFCAGRVAEEDLKRVAAATGGTVQTSVNNIIDEVMGCCEVFEERQVGNERFNIFSGCPSGQTATIVLRGGADQFIEEAERSLHDAIMIVRRAVKNSTVVAGGGAIDMEISGYLRQHARTIAGKSQLFINSFAKALEVIPRQLCDNAGFDATDVLNKLRQKHASGQGANYGVDINTGGITDSFANFVWEPSVVKINAINAAA

SEQ ID NO: 7158 - protein, 517 aa, Brassica napus
TLGPRGMDKLIHDDKGSVTISNDGATIMKLLDIVHPAAKILVDIAKSQDSEVGDGTTTVVLLAAEFLKEAKPFVEDGVHSQNLIRSYRTASTLAIEKVKELAVSIEGKSVEEKKGLLAKCAATTLSSKLIGGEKEFFATMVVDAVMAIGDDDRLNLIGIKKVPGGNMRDSFLVDGVAFKKTFSYAGFEQQPKKFLNPKILLLNIELELKSEKENAEIRLSDPSQYQSIVDAEWNIIYDKLDKCVESGAKVVLSRLAIGDLATQYFADRDIFCAGRVAEEDLNRVAAAAGGTVQTSVNNIIPEVLGTCEIFEEKQVGGERFNIFSGCPSGRTATIVLRGGADQFIEEAERSLHDAIMIVRRAVKNSTVVPGGGAIDMEISKYLRQHSRTIAGKSQLFINSYAKALEVIPRQLCDNAGFDATDVLNKLRQKHAMQSGEGASYGVDINTGGIADSFANFVWEPAVVKINAINAATEAACLILSVDETVKNPKSESAQGDAAAGAMGRGRGGGRGRGMRRR

SEQ ID NO: 7159 - protein, 531 aa, Beta vulgaris
MSAMMQPQIILLKEGTDTSQGKAQLISNINACSAIADVVRTTLGPRGMDKLIHDDKGNTTISNDGATIMKLLDIIHPAAKILVDIARSQDSEVGDGTTTVVILAGEFLKEAKPFIEDGVHPQNLIRSYRIAAHLAIEKVKDLATSIEGHSLEEKKSLLAKCAATTLSSKLIGGEKDFFAQMVVDAVLAVGIDDRLSMIGIKKVPGGNMRDSFLVNGVAFKKTFSYAGFEQQPKMFLQPKILLLNIELELKSEKENAEIRLSDPSQYQSIVDAEWNIIYDKLEKCVQTGAKIVLSRLAIGDLGTQYFADRDIFCAGRVAEEDLQRVAAATGGTVQTSVNNIIDEVLGTCEVFEEKQVGNERFNIFSGCPTGHTATIVLRGGADQFIEEAERSLHDAIMIVRRAVKNSTVVAGGGAIDMEVSRHLRQHARTIAGKSQLFINSYAKALEVIPRQLCDNAGFDATDVLNKLRQKHALPSGEGANYGVDINTGGISDSFANFVWEPAVVKINAINAATEAACLVLSVDETVKNPKS

SEQ ID NO: 7160 - protein, 564 aa, Selaginella moellendorffii
MAAMLQPSIILLKEGTDTSQGKPQLISNINACIAVVDVVRTTLGPRGMDKLIHDDKGTTISNDGATIMKLLDVVHPGAKVLVDIAKSQDAEVGDGTTTVVVLAGELLREAKPFVEENVHPQLIIRSFRTAADLAVQKIKEIAVSIEGKSIEEKKSLLEKCASTTLSSKLVGGEKEFFAKMVVEAVTDMGEDRGLKMIGVKKVPGGTMRDSFLVNGVAFKKTFSYAGFEQQPKKFDNPSILLLNIELELKSEKENAEIRLSDPSQYQSIVDAEWNIIYDKLDKCVKSGAKVVLSRLAIGDLATQYFADRDIFCAGRVVEEDLQRVARATGGAVQTSVNNLIPDVLGSCERFEEKQVGNERFNIFTGCPTGETATIVLRGGADQFIDEAERSLHDAIMIVRRALKNSTVVAGGGAIDMEISRYLRQHARTIPGKAQLFINAFAKALEVIPRQLCDNAGFDATDVLNKLRQKHALPSGEGALYGVDINTGGITDTYANFVWEPAVVKINAITAAAEAAALVLSVDETIRNPKSESAQGEAAANAMAGRGRGMGGMMGRGRGRGMRRR

SEQ ID NO: 7161 - protein, 515 aa, Ocimum basilicum
PRGMDKLVHDDKGNTTISNDGATIMKLLDIVHPAAKILVDIAKSQDSEVGDGTTTVVLLAGEFLKEAKPFIEDGVHPQNLIRSFRTASNLAIAKIKELAVSIEGKSLEEKKSLLAKCAATTLSSKLIGGEKEFFATMVVDSVLAIGDEDRLNMIGIKKVPGGTMRDSFFVNGVAFKKTFSYAGFEQQPKKFLNPKILLLNIELELKSEKENAEIRLSDPLQYQSIVDAEWNIIYDKLDKCVKSGAKVVLSRLAIGDLGTQYFADRDIFCAGRVSEEDLHRVAAATGGTVQTTVNNVIDEVLGTCEIFEEKQVGNERFNIFSGCPSGRTATIVLRGGADQFIEEAERSLHDAIMIVRRAMKNSTVVAGGGAIDMEISRYLRQHARTIAGKSQLFINSYAKALEIIPRQLCDNAGFDATDVLNKLRQKHALSSGEGAPYGVDINTGGIADSFANFVWEPAVVKINAINAATEAACLVLSVDETVKNPKSESAQGDAAAMGGRGRGRGGFGGRGMRRR

SEQ ID NO: 7162 - protein, 516 aa, Cannabis sativa
MDKLIHDDKGSVTISNDGATIMKLLDIVHPAAKILVDIAKSQDSEVGDGTTTVVLLAGEFLKEAKPFIEDGVHPQLLIRSYRAASTLAIERVKELATSIEGKSLEEKKGLLAKCAATTLSSKLIGGEKEFFASMVVDSVIAIGSEDRLNMIGIKKVPGGNMRDSFLVNGVAFKKTFSYAGFEQQPKKFLNPKLLLLNIELELKSEKENAEIRLTDPSQYQSIVDAEWNIIYDKLDKCVQSGAKVVLSRLAIGDLATQYFADRDIFCAGRVTEEDLNRVAAATGGTVQTSVNNVIDEVLGTCELFEERQVGNERFNIFSGCPSGRTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHALPSGEGAPYGVDINTGGITDSFANFVWEPAVVKINAINAATEAACLVLSVDETVKNPKSESAQGEAAASAMGRGRGGAAFRGGRGRGMRRR

SEQ ID NO: 7163 - protein, 557 aa, Ceratodon purpureus
MQPQIILLKEGTDVSQGKAQLISNINACIAVVDVVRTTLGPRGMDKLVHDDKGTTISNDGATIMKLLDIVHPAAKILVDIAKSQDSEVGDGTTTVVLLAGEFLREAKPFIEDGVHPQLIIRAFRTAANLVVRKVKELAISIEGKSMTEKKSLLEKCAATTLSSKLVGGEKEFFAKMVVDAVTSLGADSRLNMIGIKKVQGGTMRDSFLVNGVAFKKTFSYAGFEQQPKKFDNPKILLLNLELELKSEKENAEVRLSDPTQYQSIVDAEWNIIYDKLDKCVKSGAKIVLSRLAIGDLGTQYFADRDIFCAGRVMEEDLHRVATATGASVQTTVNNVIPDVLGQCELFEERQVGNERFNIFTGCPGGETATIVLRGGADQFIEEAERSLHDAIMIVRRALKNSNVVAGGGAIDMELSRFLRQHARTIAGKSQLFINSYAKALEVIPRQLCDNAGFDATDVLNKLRQKHALASGEGALYGVDINSGGIIDTFASFVWEPSVVKINALTAATEAACIVLSVDETIKNPKSEAAQAEGMGGGRGRGMGGMRGGRGGRGMRRR

SEQ ID NO: 7164 - protein, 552 aa, Brassica juncea
LSNINAVTAVGDVLRTTLGPRGMDKLIHDDKGSVTISNDGATIMKLLDIVHPAAKILVDIAKSQDSEVGDGTTTVVLLAAEFLKEAKPFVEDGVHSQNLIRSYRTASTLAIEKVKELAVSIEGKSVEEKKGLLAKCAATTLSSKLIGGEKEFFATMVVDAVMAIGDDDRLNLIGIKKVPGGNMRDSFLVDGVAFKKTFSYAGFEQQPKKFLNPKILLLNIELELKSEKENAEIRLSDPSQYQSIVDAEWNIIYDKLDKCVESGAKVVLSRLAIGDLATQYFADRDIFCAGRVAEQDLNRVAAAAGGTVQTSVNNIIPEVLGTCEIFEEKQVGGERFNIFSGCPSGRTATIVLRGGADQFIEEAERSLHDAIMIVRRAVKNSTVVPGGGAIDMEISKYLRQHSRTIAGKSQLFINSYAKALEVIPRQLCDNAGFDATDVLNKLRQKHAMQSGEGASYGVDINTGGIADSYANFVWEPAVVKINAINAATEAACLILSVDETVKNPKSESAQGDAAGAMGRGRGGGRGRGMRRRLSFFSLMANLQIFSLNFSLV

SEQ ID NO: 7165 - protein, 558 aa, Physcomitrella patens
MQPQIILLKEGTDVSQGKAQLISNINACIAVVDVVRSTLGPRGMDKLVHDDKGTTISNDGATIMKLLDIVHPAAKILVDIAKSQDSEVGDGTTTVVLLAGEFLREAKPFVEDGVHPQLIIRAFRTAAELVVKKVKELAVSIEGKSMDEKKSLLEKCAATTLSSKLVGGEKDFFAKMVVDAVASLGPDSRLNMIGIKKVQGGTMRDSFLVNGVAFKKTFSYAGFEQQPKKFDNPKILLLNLELELKSEKENAEVRLSDPTQYQTIVDAEWNIIYEKLDKCVKSGAKIVLSRLAIGDLGTQYFADRDIFCAGRVMEEDLQRVASATGASVQTTVNNVIPDVLGQCEFFEERQVGNERFNIFTGCPGGETATIVLRGGADQFIEEAERSLHDAIMIVRRALKNSNVVAGGGAIDMELSRYLRQHARTIAGKSQLFINSYAKALEVIPRQLCDNAGFDATDVLNKLRQKHALASGEGALYGVDINNGGIIDTFSSFVWEPSVVKINALTAATEAASIVLSVDETIKNPKSEAAQGEAMGGRGMGRGMGGMRGGRGGRGMRRR

SEQ ID NO: 7166 - protein, 426 aa, Flaveria ramosissima
MAIEKIKELAVSIEGKSLDEKRSLLAKCAATTLSSKLIGGEKDFFATMVVDAVIAIGNDDRLNMIGIKKVPGGTMRDSFLVNGVAFKKTFSYAGFEQQPKKFQNPKILLLNIELELKSEKENAEIRLSDPLQYQSIVDAEWNIIYDKLDKCVKSGAKIVLSRLAIGDLATQYFADRDIFCAGRVAEDDLHRVAAATGGMVQTSVNNVIDEVLGSCEVFEEKQVGNERFNIFSGCPSGQTATIVLRGGADQFIEEAERSLHDAIMIVRRAMKNSTVVAGGGAIDMEISRYLWQHARNIAGKSQLFINAFAKALEVIPRQLCDNAGFDATDVLNKLRQKHALPSGEGALYGVDINTGGISDSFANFVWEPAVVKMNAINAATEAACLVLSVDETVKNPKSESAQGEAAAGMGRGRGGGGMRGRGMRRR

SEQ ID NO: 7167 - protein, 382 aa, Vinca minor
MVVDAVFAIGNDDRLNMIGIKKVPGGTMRDSFLVDGVAFKKTFSYAGFEQQPKKFENPKILLLNIELELKSEKENAEIRLSDPSQYQSIVDAEWNIIYDKLDKCVKSGAKIVLSRLAIGDLATQYFADRDIFCAGRVTEEDLHRVAAATGGAVQTTVNNIIDEVLGTCEIFEERQVGNERFNIFSGCPSGRTATIVLRGGADQFIEEAERSLHDAIMIVRRALKNSTVVPGGGAIDMEISRYLRQHARTIDGKSQLFINSYAKALEVIPRQLCDNAGFDATDVLNKLRQKHALLSGEGAPYGVDINTGGIADSFANFVWEPAVVKINAINAATEAACLILSVDETVKNPKSESAQGEAAASAMGGRGRGGPAFRGRGRGMRR

SEQ ID NO: 7168 - protein, 502 aa, Arnica chamissonis
QPQIILLKEGTDTSQGKPQLVSNINACMAVADVVRTTLGPRGMDKLIHDDKGNTTISNDGATIMKLLDVVHPAAKILVDIAKSQDLEVGDGTTTVVLLAGEFLREAKPFIEDGVHPQNLIRSYRTASNMAIEKIKELAVSIEGKSLDEKRSLLAKCAATTLSSKLIGGEKDFFAAMVVDAVIAIGSDDRLNMIGIKKVPGGTMRDSFLVNGVAFKKTFSYAGFEQQPKKFLNPKILLLNIELELKSEKENAEIRLSDPLQYQSIVDAEWNIIYDKLDKCVKSGAKIVLSRLAIGDLATQYFADRDIFCAGRVAEDDLHRVAAATGGTVQTSVNNVIDEVLGSCEVFEEKQVGNERFNIFKGCPSGQTATIVLRGGADQFIEEAERSLHDAIMIVRRAMKNSTVVAGGGAIDMEISRYLWQHARNIAGKSQLFINSFAKALEVIPRQLCDNAGFDATDVLNKLRQKHALPSGEGALYGVDINTGGISDSFANFVWEPAVVKMN

SEQ ID NO: 7169 - protein, 509 aa, Fagopyrum esculentum
MDKLIHDERGNTTISNDGATIMKLLDIVHPAAKILVDIAKSQDSEVGDGTTTVVLLAGEFLKEAKPFIEDGVHPQNLIRSYRTASLLAIEKIKELAVSIEGKSLEDKKELLAKCAATTLSSKLIGGEKDFFATMVVEAVLAIGADDRMNLIGIKKVPGGTMRDSFLVDGVAFKKTFSYAGFEQQPKKFKNPKILLLNIELELKSEKENAEIRLTDPSQYQSIVDAEWNIIYDKLDKCVQSGAKIVLSRLAIGDLATQYFADRDIFCAGRVTEEDLQRVAAATGGTVQTSVNNIIEEVLGSCEVFEEKQVGNERFNLFNGCPCGRTATIVLRGGADQFIDEAERSLHDAIMIVRRAVKNSTIVPGGGAIDMEISRHLRQHARTIAGKSQLFINSYAKALEVIPRQLCDNAGFDATDVLNKLRQKHALPSGEGANYGVDINTGGIADSYASFVWEPAVVKLNALNAATEASCLVLSVDETVKNPKSESAQGDAAASAMGRGRGRGRGMRRR

SEQ ID NO: 7170 - protein, 516 aa, Distylium racemosum
MDKLIHDERGSVTISNDGATIMKLLDIVHPAAKILVDIAKSQDSEVGDGTTTVVLFAGEFLKEAKPFIEEGVHPQNLIRSYRTAAYLAINKVKELAISIEGKSLEEKKYLLEKCAATTLSSKLIGGEKEFFAKMVVDSVLAIGQDDRLNMIGIKKVPGGNMRDSFLVKGVAFKKTFSYAGFEQQPKNFLNPKLLLLNVELELKSEKENAEVRLSDPTKYQSIVDAEWNIIYDKLDKCVKSGAKIVLSRLAIGDLATQYFADRDVFCAGRVTEEDLQRVAAATGGAVQTSVNNIVPEVLGTCECFEEKQVGNERFNIFSGCPSGKTATIVLRGGADQFIDEAERSLHDAIMIVRRALKNSTVVAGGGAIDMEISRYLRQHARTIAGKSQLFINSYAKALEVIPRQLCDNAGFDATDVLNKLRQKHALSSGEGASYGVDINTGGIADSLANFVWEPAVVKINAINAATEAACLILSVDETVKNPKSESAQGEGAANAMAGRGRGGGGFRGRGRGMRRR

SEQ ID NO: 7171 - protein, 569 aa, Physcomitrella patens
MMSFLRVLVLEQQPQIILLKEGTDVSQGKAQLISNINACIAVVDVVRSTLGPRGMDKLVHDDKGTTISNDGATIMKLLDIVHPAAKVLVDIAKSQDSEVGDGTTTVVLLAGEFLREAKPFIEDGVHPQLIIRAFRTAVNLVVKKVKELAVSIEGKSMVEKKNLLEKCAATTLSSKLVGGEKEFFSKIVVDAVTSLGADSRLSMIGIKKVQGGTMRDSFLVNGVAFKKTFSYAGFEQQPKKFDNPKILLLNLELELKSEKENAEVRLSDPTQYQTIVDAEWNIIYEKLDKCVKSGAKIVLSRLAIGDLGTQYFADRDIFCAGRVMEEDLQRVATATGASVQTTVNNVIPDVLGQCELFEERQVGNERFNIFTGCPGGETATIVLRGGADQFIEEAERSLHDAIMIVRRALKNSNVVAGGGAIDMELSRYLRQHARTIAGKSQLFINSYAKALEVIPRQLCDNAGFDATDVLNKLRQKHALASGEGALYGVDINSGGIIDTFSNFVWEPSVVKINALTAATEAACIVLSVDETIKNPKSEAAQGEAMGGRGMGRGMGGMRGGRGGRGMRRR

SEQ ID NO: 7172 - protein, 507 aa, Lactuca sativa
MASMMQPQIILLKEGTDTSQGKPQLISNINACMAVADVVRTTLGPRGMDKLIHDDKGNTTISNDGATIMKLLDIVHPAAKILVDIAKSQDSEVGDGTTTVVLLAGEFLKEAKPFIEDGVHPQNLIRSYRTASFMAIEKIKELAVSIEGKSLDEKRSLLAKCAATTLSSKLIGGEKDFFAKMVVDAVIAIGNEDRLNMIGIKKVQGGTMRDSFLVNGVAFKKTFSYAGFEQQPKKFLNPKILLLNIELELKSEKENAEIRLSDPLQYQSIVDAEWNIIYDKLDKCVKSGAKIVLSRLAIGDLATQYFADRDIFCAGRVAEDDLHRVAAATGATVQTSVNNVIDEVLGSCEIFEEKQVGSERFNIFSGCPLGQTATIVLRGGADQFIEEAERSLHDAIMIVRRAMKNSTVVAGGGAIDMEISRYLWQHARNIAGKSQLFINAYAKALEVIPRQLCDNAGFDAIDVLNKLRQKHALAAGEGALYGVDINTGGISDSFANFVWEPAVVKVN

SEQ ID NO: 7173 - protein, 495 aa, Catharanthus roseus
MKLLDIIHPAAKILVDIAKSQDSEVGDGTTTVVLLAAEFLKEAKPFIEDGVHPQNLIRSYRTASYLAIEKVKELAVSIEGKSLEEKKSLLAKCAATTLSSKLIGGEKDFFAPMVVDAVLAIGNDDRLNMIGIKKVPGGTMRDSFLVNGVAFKKTFSYAGFEQQPKKFVNPQILLLNIELELKSEKENAEIRLSDPSQYQSIVDAEWNIIYDKLDKCVKSGAKIVLSRLAIGDLATQYFADRDIFCAGRVTEEDLQRVAAATGGTVQTTVNNIIDEVLGTCECFEEKQVGNERFNIFSGCPSGQTATIVLRGGADQFIEEAERSLHDAIMIVRRALKNSTVVPGGGAIDMEISRYLRQHARTIAGKSQLFINSYAKALEVIPRQLCDNAGFDATDVLNKLRQKHALPSGEGAPYGVDINTGGISDSFANFVWEPAVVKINAINAATEAACLILSVDETVKNPKSESAQGEAAASAMGGRGRGGPAFRGRGRGMRRR

SEQ ID NO: 7174 - protein, 502 aa, Olea europaea
MATMMQPQIILLKEGTDTSQGKPQLISNINACMAVADVVRTTLGPRGMDKLIHDEKGNTTISNDGATIMKLLDIVHPAAKILVDIAKSQDSEVGDGTTTVVLLAGEFLKEAKPFIEDGVHSQNLIRSYRTASHLAIEKVKELAISIEGKSLEEKKNLLAKCAATTLSSKLIGGEKEFFASMVVDAVIAIGYEDRLNMIGIKKVPGGNMRDSFLVNGVAFKKTFSYAGFEQQPKKFENPKILLLNIELELKSEKENAEIRLSDPLQYQSIVDAEWNIIYDKLDKCVKSGAKVVLSRLAIGDLATQYFADRDIFCAGRVTEEDLQRVAAATGGTVQTTVNNVIDEVLGFCELFEENQVGNERFNIFSGCPSGLTATIVLRGGADQFIEEAERSLHDAIMIVRRALKNSTIVAGGGAIDMEVSRYLRQHARTIAGKSQLFINSYAKALEVIPRQLCDNAGFDATDVLNKLRQKHALPSGEGAPYGVDINTGGVADSFANFVWEPA

SEQ ID NO: 7175 - protein, 494 aa, Cichorium intybus
DGATIMKLLDIVHPAAKILVDIAKSQDSEVGDGTTTVVLLAGEFLKEAKPFIEDGVHPQNLIRSYRSASFMAIEKIKELAVSIEGKSLDEKRSLLAKCAATTLSSKLIGGEKDFFAKMVVDAVIAIGNDDRLNMIGIKKVPGGTMRDSFLVNGVAFKKTFSYAGFEQQPKKFLNPKILLLNIELELKSEKENAEIRLSDPLQYQSIVDAEWNIIYDKLDKCVKSGAKIVLSRLAIGDLATQYFADRDIFCAGRVAEDDLHRVAAATGATVQTSVNNVIDEVLGSCEVFEEKQVGSERFNIFSGCPSGQTATIVLRGGADQFIEEAERSLHDAIMIVRRAMKNSTVVAGGGAIDMEISRYLWQHARNIAGKSQLFINAYAKALEVIPRQLCDNAGFDATDVLNKLRQKHALAAGEGALYGVDINTGGISDSFANFVWEPAVVKINAINAATEAACLILSVDETVKNPKSESAQGEAAAGMGRGRGGGRGRGMRRR

SEQ ID NO: 7176 - protein, 352 aa, Sorghum bicolor
MELQLLVRPAATAPSSARARPSLRLPAPAAGPSRPRRPGFPTLRAAAAAAAAIAAEPETKEQQQNSIMETEVFACPVCYEPLMRKGPPGINLPAIYRSGFKCSKCNKSFTSKDIFLDLTVTAGTKEYSEQKPARTELFRSPLVSFLYERGWRQNFNRSGFPGLDEEFEMAQDYFQPVAGGILLDVSCGSGLFTRKFAKSGTYSAVIALDFSENMLRQCYEFIKQDDTLLNANLALVRADISRLPFASCSVDAIHAGAAIHCWPSPSNAVAEISRVLRPGGVFVGTTFLSSPRNNPFSVEALRPLRQIVGPVNTSYNYFTEGELEDLCKSCGLVNYSSKVQRSFIMFSGQKPY

SEQ ID NO: 7177 - protein, 346 aa, Zea mays
MELLARPAAAASSSCARPSLQLPAPGTSRPRRPGFPTLRAAAAAAAAIAAEPQSNEQQNIIMETEVFACPVCYEPLMRKGPPGINLPAIYRSGFKCSKCNKSFTSKDIFLDLTVTAGTKEYSEQKPARTELFRSPLVSFLYERGWRQNFNRSGFPGLDEEFQMAQDYFQPIAGGILLDVSCGSGLFTRKFAKSGTYSAVIALDFSENMLRQCYEFIKQDDSLLNVNLALVRADISRLPFASCSVDAIHAGAAIHCWPSPSNAVAEISRVLRPGGVFVGTTFLSSPRNNPFSVEALRPLRQIVGPVNTSYNYFTEGELEDLCKSCGLVNYSSNVQRSFIMFSGQKPY

SEQ ID NO: 7178 - protein, 345 aa, Oryza sativa
MELAVRAAAAASCSSGASLQLPRARAPLRLLGHRRLPARRVAVEAAAIAVEPENKVPQSNNSEAEVFACPVCYEPLIRKGPSGINLPSIYRSGFKCSKCNKSFTSKDIFLDLTVTSGTKEYSELKPARTELFRSPLVSFLYERGWRQNFNRSGFPGLDEEFQMAQDYFQSVAGGVLLDVSCGSGLFTRKFAKSGSYSAVIALDFSENMLCQCYEFIQQDDTLVNTNLALVRADISRLPFASSSIDAIHAGAAIHCWPSPSNAVAEISRVLRPGGVFVATTFLSSPRNNPFSVEALRPLRQIVGPVNTSYNYFTEGELEDLCKSCGLVNYSSKVQRSFIMFSGQKP

SEQ ID NO: 7179 - protein, 356 aa, Brachypodium distachyon
MDLAVRASAAAASSCSPYPTSLQHQQPPRARATHHLRRRRPGLTLPARRVVAAAAASIAVDPETNAERNDISEAEVFACPVCYEPLIRKGPPGINLPAIYRSGFKCSKCKKSFTSKDIFLDLTVTSGTKEYSELKPARTELFRSPLVSFLYERGWRQNFNRSGFPGLDEEFQMAQDYFQPVAGGILIDVSCGSGLFTRKFAKSGAYSAVVALDFSENMLRQCYEYIKQDDTPLNTNLALVRADISRLPFASCSIDAIHAGAAIHCWPSPSNAVAEISRVLRPGGVFVATTFLSTPTNSGPFSVGPLRPLRQIVGPVNSSYNFFTEAELEDLCKSCGLVNYSSKVQRSFIMFSGQKP

SEQ ID NO: 7180 - protein, 348 aa, Avena sativa
MELAVRAAAASCSSYPSLQRAGVPRRLRRSPGLPPLPARRVAVAAAIAVDPVQDIKTEQNDVPETEVFACPVCYEPLIRKGPPGMNLSAIYRSGFKCLKCKKSFTSKDIFLDLTVTSGTKEYSELKPARTELFRSPLVSFLYERGWRQNFNRSGFPGRDEEFQMAQDYFEPVAGGILVDVSCGSGLFARKFATSGAYSSVIALDFSENMLRQCYDYIKQDDTPLNTNLALVRADISRLPFASCSIDAIHAGAAIHCWPSPSNAVAEISRVLRPGGVFVGTTFLSSPTNSGPFSSGALRPLRQIVGPVNSSYNFFTEGELEDLCRSCGLVNYSSKVQRSFIMFSGQKPS

SEQ ID NO: 7181 - protein, 484 aa, Sorghum bicolor
MASAGFPSRIAGISVRPDSSSACLIHKVGAPSNSLPGAVAVQVQGHQNRVRNGQAIRCAMATGKEQGAISTASSGDQTKGGLRGKLNKVVLAYSGGLDTSVIVPWLRENYGCEVVCFTADVGQGAIELEGLEKKAKASGACQLVVKDLREEFVSEYIYPCLRAGAVYERKYLLGTSMARPVIAKAMVDVAKEVGADAVAHGCTGKGNDQVRFELTFYALNPELKVVAPWREWDITGREDAIEYAKKHNVPVPVSKKSIYSRDRNLWHLSHEGDILEDPANEPKEDMYMMSVAPENAPSEPEYLEIGIIAGVPVSINGRDLSPASLLSELNEIGGKHGIGRIDMVENRLVGMKSRGVYETPGGTIMAAAVRELESLTLDRETMQWKDIIALKYAELVYAGRWFDPLRQSFDAFMEKITATTTGSVTLKLYKGSVNVASRKSPYSLYREDISSFENGEIYNQADAEGFIRLYGLPTRVRAMLEKGI

SEQ ID NO: 7182 - protein, 484 aa, Saccharum officinarum
MASAGFPSRITGISARPDSSSACLIHKVGAPSNSLPGAVAVQVHRHQNKVRNGQAIRCAMATGKEQGAISTASSGDQTKGGLRGKLNKVVLAYSGGLDTSVIVPWLRENYGCEVVCFTADVGQGAIELEGLEKKAKASGACQLVVKDLKEEFVSEYIYPCLRAGAVYERKYLLGTSMARPVIAKAMVDVAKEVGADAVAHGCTGKGNDQVRFELTFYALNPELKVVAPWREWDITGREDAIEYAKKHNVPVPVSKKSIYSRDRNLWHLSHEGDILEDPANEPKEDMYMMSVAPENAPSKPEYLEIGIIAGVPVSINGRDLSPASLLSELNEIGGKHGIGRIDMVENRLVGMKSRGVYETPGGTIMAAAVRELESLTLDRETMQWKDIIALKYAELVYAGRWFDPLRQSFDAFMEKITATTTGSVTLKLYKGSVNVASRKSPYSLYREDISSFENGEIYNQADAEGFIRLYGLPTRVRAMLEKGI

SEQ ID NO: 7183 - protein, 474 aa, Panicum virgatum
AGISVRPNTNVACLVQKGGALSNSLPTGAAVQVRRRHNKARNGQAIRCATATGKEQGAVTPASSGDQNKGGLRGKLNKVVLAYSGGLDTSVIVPWLRENYGCEVVCFTADVGQGAIELEGLEKKAKASGACQLVVKDLREEFVSEYIYPCLRAGAVYERKYLLGTSMARPVIAKAMVDVAKEVGADAVAHGCTGKGNDQVRFELTFYALNPELKVVAPWREWDITGREDAIEYAKKHNVPVPVSKKSIYSRDRNLWHLSHEGDILEDPANEPKEDMYMMSVAPENAPSEPEYLEIGIVAGVPVSINGRELSPASLLAELNEIGGKHGIGRIDMVENRLVGMKSRGVYETPGGTIMAAAVRELEALTLDRETMQWKDMVALKYAELVYAGRWFDPLRQSFDAFMEKITATTTGSVTLKLYKGSVNVASRKSPYSLYREDISSFENREIYNQADAEGFIRLYGLPTRVRAMLEKGI

SEQ ID NO: 7184 - protein, 481 aa, Zea mays
MASARGPCGISVRSDFSSACLIHKAGAPSNSVSGVMAVQVHRHRNKVRNGQAIRCAMATGKEQGAISTASSGDQTKGGLRGKLNKVVLAYSGGLDTSVIVPWLRENYGCEVVCFTADVGQGAIELEGLEKKAKASGACQLVVKDLKEEFVSEYIYPCLRAGAVYERKYLLGTSMARPVIAKAMVDVAKEVGADAVAHGCTGKGNDQVRFELTFYALNPELKVVAPWREWDITGREDAIEYAKKHNVPVPVSKKSIYSRDRNLWHLSHEGDILEDPANEPKEDMYMMSIAPENAPSKPEYLEIGIIAGVPVSINGRDLSPASLLAELNEIGGKHGIGRIDMVENRLVGMKSRGVYETPGGTIMAAAVRELESLTLDRETMQWKDIIALKYAELVYAGRWFDPLRQSFDAFMEKVTATTTGSVTLKLYKGSVNVASRKSPYSLYREDISSFENGEIYNQADAEGFIRLYGLPTRVRAMLEKGI

SEQ ID NO: 7185 - protein, 481 aa, Oryza sativa
MAHALGCGAATAPAGVGLLHHHEKAGALFSAAGSIVRVQQLSGKGSKSQAIRCAMPSASEHGGISTATANSSDQKKGGLRGKLNKVVLAYSGGLDTSVIVPWLRENYGCEVVCFTADVGQGDIELEGLEKKAKASGASQLVVKDLKEEFVSEYIYPCLRAGAVYERKYLLGTSMARPVIAKAMVDVAKEVGADAVAHGCTGKGNDQVRFELTFYALNPELKVVAPWREWDITGREDAIEYAKKHNVPIPVTKKSIYSRDRNLWHLSHEGDILEDPANEPKEDMYMMSVAPENAPSKPEYLEIGIIAGVPVSINGKDLSPASLLAKLNEIGGKHGIGRIDMVENRLVGMKSRGVYETPGGTIMAAAVRELESLTLDRETMQWKDMLALKYAELVYAGRWFDPLRQSIDAFMENITATTTGSVTLKLYKGSVNVASRKSPYSLYREDISSFENGEIYNQADAEGFIRLYGLPTRVRAMLEKGI

SEQ ID NO: 7186 - protein, 435 aa, Echinochloa colona
MAFAGDASRLAGISVRPDSSAARLVQKVGALSNSLPGAAAVQVRRRQNQARNGQAIRCSMATGKAQGSVTTASSGDQNKGGLRGKLNKVVLAYSGGLDTSVIVPWLRENYGCEVVCFTADVGQGAIELEGLEKKAKASGACQLVVKDLKEEFVGEYIYPCLRAGAVYERKYLLGTSMARPVIAKAMVDVAKEVGADAVAHGCTGKGNDQVRFELTFYALNPELKVVAPWREWDITGREDAIEYAKKHNVPVPVSKKSIYSRDRNLWHLSHEGDILEDPANEPKEDMYMMSVAPENAPSEPEYLEIGIVAGVPVSINGRDLSPASLLAELNEIGGKHGIGRIDMVENRLVGMKSRGVYETPGGTIMAAAVRELESLTLDRETMQWKDMVALKYAELVYAGRWFDPLRQSFDAFMEKITATTTGSVTLKLYKGSVNV

SEQ ID NO: 7187 - protein, 475 aa, Secale cereale
  Sequence also found in Organisms: Triticum aestivum
MPLPMRRLAAAPSLPAVHPHDSPAPPSVRLRRQHGRVSMERSSTTTARGVSCVMASGKEHAATTSGDEKKGGLRGKLKKVVLAYSGGLDTSVIVPWLRENYGCEVVCFTADVGQGDIELEGLEKKAKASGASQLVVKDLTEEFVGEYIYPCLRAGAVYERKYLLGTSMARPVIAKAMVDVAKEVGADAVAHGCTGKGNDQVRFELTFYALNPELKVVAPWREWDITGREDAIEYAKKHNVPIPVSKKSIYSRDRNLWHLSHEGDILEDPANEPKEDMYMMSVSPENAPSKPEYLEIGIVAGVPTSINGKDLSPATLLAKLNEIGGKHGIGRIDMVENRLVGMKSRGVYETPGGTIMAAAVRELESLTLDRETMQWKDMLALKYAELVYAGRWFDPLRLSMDAFMETITATTTGSVTLKLYKGSVTVASRKSPYSLYREDISSFENGEIYDQADAEGFIRLYGLPTRVRAMLEKGI

SEQ ID NO: 7188 - protein, 422 aa, Brachypodium distachyon
MASGKEHATTASADQKKGGLLGKLNKVVLAYSGGLDTSVIVPWLRENYGCEVVCFTADVGQGAIEMEGLEKKAKASGASQLVVKDLTEEFVGQYIYPCLRAGAVYERKYLLGTSMARPVIAKAMVDVAKEVGADAVAHGCTGKGNDQVRFELTFYALNPELKVVAPWREWDITGREDAIEYAKKHNVPVPVSKKSIYSRDRNLWHLSHEGDILEDPANEPKEDMYMMSVSPENAPSKPEYLEIGIVAGVPTSINGKDLSPASLLTKLNEIGGKHGIGRIDMVENRLVGMKSRGVYETPGGTIMSAAVRELEALTLDRETMQWKDMLALKYAELVYAGRWFDPLRQSMDAFMETITATTTGSVTLKLYKGSVTVASRKSPYSLYREDISSFENGEIYNQADAEGFIRLYGLPTRVRAMLEKGI

SEQ ID NO: 7189 - protein, 471 aa, Festuca arundinacea
MRRLAAAPSLPAVHPHDSAAPPSVRLRRQHGRVAMERTSTTTARGVSCVVASGKEHAATTSGDEKKGGLRGKLKKVVLAYSGGLDTSVIVPWLRENYGCEVVCFTADVGQGDIEMEGLEKKAKASGASQLVVKNLQEEFVGEYIFPCLRAGAVYERKYLLGTSMARPVIAKAMVDVAKEVGADAVAHGCTGKGNDQVRFELTFYALNPELKVVAPWREWDITGREDAIEYAKKHNVPVPVSKKSIYSRDRNLWHLSHEGDILEDPANEPKEDMYMMSVSPENAPSKPEYLEIGIVAGVPTSINGKDLSPASLLAKLNEIGGKHGIGRIDMVENRLVGMKSRGVYETPGGTIMAAAVRELESLTLDRETMQWKDMLALKYAELVYAGRWFDPLRQSMDAFMETITATTTGSVTLKLYKGSVNVASRKSPYSLYREDISSFENGEIYNQADAEGFIRLYGLPTRVRAMLEKGI

SEQ ID NO: 7190 - protein, 471 aa, Lolium multiflorum
MRRLAAAPSLPAVHPHDSAAPPSVRLRRQHGRVAMERTSTTTARGVSCVVASGKEHAATTTGDEKKGGLRGKLKKVVLAYSGGLDTSVIVPWLRENYGCEVVCFTADVGQGDIEMEGLEKKAKASGASQLVVKNLQEEFVGEYIFPCLRAGAVYERKYLLGTSMARPVIAKAMVDVAKEVGADAVAHGCTGKGNDQVRFELTFYALNPELKVVAPWREWDITGREDAIEYAKKHNVPVPVSKKSIYSRDRNLWHLSHEGDILEDPANEPKEDMYMMSVSPENAPSKPEYLEIGIVAGVPTSINGKDLSPASLLAKLNEIGGKHGIGRIDMVENRLVGMKSRGVYETPGGTIMAAAVRELESLTLDRETMQWKDMLALKYAELVYAGRWFDPLRQSMDAFMETITATTTGSVTLKLYKGSVNVASRKSPYSLYREDISSFENGEIYNQADAEGFIRLYGLPTRVRAMLEKGI

SEQ ID NO: 7191 - protein, 422 aa, Avena sativa
MASGKEHASTTTGDEKKGGLRGKLKKVVLAYSGGLDTSVIVPWLRENYGCEVVCFTADVGQGDIEMEGLEKKAKASGASQLVVKNLQEEFVGEYIYPCLRAGAVYERKYLLGTSMARPVIAKAMVDVAKEVGADAVAHGCTGKGNDQVRFELTFYALNPELKVVAPWREWDITGREDAIEYAKKHNVPVPVSKKSIYSRDRNLWHLSHEGDILEDPANEPKEDMYMMSVSPENAPSKPEYLEIGIVGGVPTSINGKDLSPASLLAKLNEIGGKHGIGRIDMVENRLVGMKSRGVYETPGGTIMAAAVRELESLTLDRETMQWKDMLALKYAELVYAGRWFDPLRQSMDAFMETITATTTGSVTLKLYKGSVNVASRKSSYSLYREDISSFENGEIYNQADAEGFIRLYGLPTRVRAMLEKGI

SEQ ID NO: 7192 - protein, 465 aa, Secale cereale
APSLPAVHPHDSPAPPSVRLRRQHGRVSMERTSTTTARGVSCVMASGKEHAATTSGDEKKGGLRGKLKKVVLAYSGGLDTSVIVPWLRENYGCEVVCFTADVGQGDIELEGLEKKAKASGASQLVVKDLTEEFVGEYIYPCLRAGAVYERKYLLGTSMARPVIAKAMVDVAKEVGADAVAHGCTGKGNDQVRFELTFYALNPELKVVAPWREWDITGREDAIEYAKKHNVPIPVSKKSIYSRDRNLWHLSHEGDILEDPANEPKEDMYMMSVSPENAPSKPEYLEIGIVAGVPTSINGKDLSPATLLAKLNEIGGKHGIGRIDMVENRLVGMKSRGVYETPGGTIMAAAVRELESLTLDRETMQWKDMLALKYAELVYAGRWFDPLRLSMDAFMETITATTTGSVTLKLYKGSVTVASRKSPYSLYREDISSFENGEIYDQADAEGFIRLYGLPTRVRAMLEKGI

SEQ ID NO: 7193 - protein, 422 aa, Avena sativa
MASGKEHASTTTGDEKKGGLRGKLKKVVLAYSGGLDTSVIVPWLRENYGCEVVCFTADVGQGDIEMEGLEKKAKASGASQLVVKNLQEEFVGEYIYPCLRAGAVYERKYLLGTSMARPVIAKAMVDVAKEVGADAVAHGCTGKGNDQVRFELTFYALNPELKVVAPWREWDITGREDAIEYAKKHNVPVPVSKKSIYSRDRNLWHLSHEGDILEDPANEPKEDMYMMSVSPENAPSKPEYLEIGIVGGVPTSINGKDLSPASLLAKLNEIGGKHSIGRIDMVENRLVGMKSRGVYETPGGTIMAAAVRELESLTLDRETMQWKDMLALKYAELVYAGRWFDPLRQSMDVFMETITATTTGSVTLKLYKGSVNVASRKSSYSLYREDISSFENGEIYNQADAEGFIRLYGLPTRVRAMLEKGI

SEQ ID NO: 7194 - protein, 471 aa, Hordeum vulgare
MRRLAAAPSLPAVHPHDSHAPPSVRLRRQHGRVSMERTSTTTGRGVSCVMASGKEHATTTTADEKKGGLRGKLKKVVLAYSGGLDTSVIVPWLRENYGCEVVCFTADVGQGDIELEGLEKKAKASGASQLVVKDLTEEFVGEYIYPCLRAGAVYERKYLLGTSMARPVIAKAMVDVAKEVGADAVAHGCTGKGNDQVRFELTFYALNPELKVVAPWREWDITGREDAIEYAKKHNVPIPVSKKSIYSRDRNLWHLSHEGDILEDPANEPKEDMYMMSVSPESAPSKPEYLEIGIVAGVPTSINGKDLSPATLLAKLNEIGGKHGIGRIDMVENRLVGMKSRGVYETPGGTVMAAAVRELESLTLDRETMQWKDMLALKYAELVYAGRWFDPLRLSMDAFMEKITATTTGSVTLKLYKGSVTVASRKSPYSLYREDISSFENGEIYDQADAEGFIRLYGLPTRVRAMLEKGI

SEQ ID NO: 7195 - protein, 403 aa, Pennisetum glaucum
ATQSTFLLITTSSGGLDTSVIVPWLRENYGCEVVCFTADVGQGAIELEGLEKKAKASGACQLVVKDLREEFVSEYIYPCLRAGAVYERKYLLGTSMARPVIAKAMVDVAKEVGADAVAHGCTGKGNDQVRFELTFYALNPELKVVAPWREWDITGREDAIEYAKKHNVPVPVSKKSIYSRDRNLWHLSHEGDILEDPANEPKEDMYMMSVAPENAPSEPEYLEIGIIAGVPVSINGRDLSPASLLAELNEIGGKHGIGRIDMVENRLVGMKSRGVYETPGGTIMAAAVRELEALTLDRETMQWKDMIALKYAELVYAGRWFDPLRQSFDSFMENITATTTGSVTLKLYKGSVNVASRKSPYSLYREDISSFENGEIYNQADAEGFIRLYGLPTRVRAMLEKGI

SEQ ID NO: 7196 - protein, 588 aa, Sorghum bicolor
MVVARKQQQHPPPLHAGGARRRGGCGVRVGPARLEGLPAAWPGAAAVKVKWPAPGGALSQMLTGKWARGVTAVEAVGAGGTVRWEPRDGNRFRLDVVDPAGSRGRPERGVFFSVLYGFQEQGRGKELVRLEEIGTAMISLEECCWEMQLQQQRQQLVVVPIRVRKDGWASDAMLYVNVELVDANTRSDIERAVSFREKPRTNMAPRPTMRDSRKSLEAAAYDVLDLKQLLDLAEKEGRVAVYGNKRNSDTSSVSSISSSSSSSSSSSTISISSASTSGGASPEPASTSKRRFLPWMRRSRDFDKRSTESLSQELSMKCMDDDPIGSWEMREFTSRDAETKLKTPVFFASIDQRDDSAGGESACTALVAVLAAALHANHPTMPTRPELDALIRDGSSEWRKLCDDEAHMAQFPNRHFDLDTVLASRTRPIAVQHDRAFVGFFQPESFASLSGAMSFDDIWREISGGEREPGRADVYIVSWNDHFFVLKVESDCYYIIDTLGERLHEGCDKAYMLRFDGSSEMQAEGTQEVIVTGKECCREFIKRFLAAIPLREELEMEKRGAGSIDGGGAPHRRLQIEFHFTVLRDDDR

SEQ ID NO: 7197 - protein, 584 aa, Zea mays
MVVARKPQQQPAGVARRRGGGVRVGPARLEGLPAAWAGAAAAAVKVKWPAPGGALSQMLTGRWARGVTAVEAVGAGGTVRWEPRDGNRFRLDDVVGPAGRPERGVFFSVLYGFQEQGRGNKELVRLEEIGTAMISLEECCWEMQLQQHHHQLVAVPVRVRKDGWASDAMLYVDVELVDANTRPDVDRAVSFREKPRTYMAPPPTMRGSRKSLESATCHDVLDLKQLLDLAEKEGRVAVYGNIRSSDTSSVSSTSSSSSTISVSSASTSGGASPEPASTSKRRFLPWTRRSRDFDKRTAESLSQELPTKCTDDGPGPAGGWETREFTSRDAETRLRTPVFFASIDQRDGSAGGEGACAALAAVLAAALHAGHPAMPTRPELDALIRDGSSEWRRLCDDEARAARFPNRHLDLDTVLASRAWPIAVRHDRAFVGFFQPESFASLSGAMSFDDIWREIAGGGGRGRGPGGRADVYIVSWNDHFFALKVESDCYYVVDTLGERLHEGCDKAYMLRFDGSSEMRAEGTEEVVVAGKECCREFIKRFLAAIPLREELEIEKKGGSGIDGGGAPHQRLQIEFHFTAFTRRQ

SEQ ID NO: 7198 - protein, 483 aa, Zea mays
MSVASSHRLRPSPSGPARRPGSAAPRVAFWPAGASPPYRGRCTVVAAAAAAGAGGEASSAPVAVSAVAPAGAARDKVRRHTISVFVGDESGMINRIAGVFARRGYNIESLAVGLNKDKALFTIVVSGTDRVLNQVIEQLNKLVNVLSVEDLSKEPQVERELMLIKLNVEPDQRPEVMVLVDIFRAKVVDISEKTLTMEVAGDPGKIAAVQRNLWKFGIKEICRTGKIALRRERIGATARFWRFSAASYPDLIDALPKNPLTSVNRTVNGSFGQPSNAGGDVYPVESYESLSVNHVLDAHWGVLDDDDATGLRSHTLSILVNDCPGVLNIVTGVFARRGYNIQSLAVGPAEKEGISRITTVVPGTVESIEKLVQQLYKLIDVHEVHDITHSPFAERELMLIKVSVNTAARKEILDIAEIFRAKPVDVSDHTVTLQLTGDLDKMVALQRLLEPYGICEVARTGRVALVRESKVDSKYLRGYSLPL

SEQ ID NO: 7199 - protein, 492 aa, Sorghum bicolor
MSVASSHHLRPSPSPAAAGPARRPGCAAAPRVSLWPAGASPPYRGRCTVVAAAAPAAGAGGGEAASAPAAVSAVAPAAAAARDKVRRHTISVFVGDESGMINRIAGVFARRGYNIESLAVGLNKDKALFTIVVSGTDRVLNQVIEQLNKLVNVLSVEDLSKEPQVERELMLIKLNVEPDQRPEVMVLVDIFRAKVVDISEKTLTIEVAGDPGKIAAVQRNLRKFGIKEICRTGKIALRREKIGATARFWQFSAASYPDLIEALPKNPITSVNKTVNGSFDQSSNAGGDVYPVESYESLTANHVLDAHWGVLDDDDDATGLRSHTLSILVNDCPGVLNIVTGVFARRGYNIQSLAVGPAEKEGISRITTVVPGTVESIEKLVQQLYKLVDVHEVHDITPSPFAERELMLIKVSVNTAARREILDIAEIFRAKPVDVSDHTVTLQLTGDFDKMVALQRLLEPYGICEVARTGRVALVRESKVDSKYLRGYSLPL

SEQ ID NO: 7200 - protein, 486 aa, Zea mays
MSLASSHHLRPSPAGPARRPGCPAPRVALCRPPGASPPYRGRCCTIVAAAAPAAGAGGEAASAPAAAVPAVAPGAAARDKVRRHTISVFVGDESGMINRIAGVFARRGYNIESLAVGLNKDKALFTIVVSGTDMVLNQVIEQLNKLVNVHSVEDLSKEPQVERELMLIKLNVEPDQRPEVMVLVDIFRAKVVDISEKTLTIEVAGDPGKIAAVQRNLRKFGIKEICRTGKIALRREKIGATARFWRFSAASYPDLIEALPKKPLTSVNKTVNGSFVRPSNAGGDVYPVESYESSANQVLDAHWGVLDDDDATGLCSHTLSILVNDCPGVLNIVTGVFARRGYNIQSLAVGSAEKEGISRITTVVPGTVESIGKLVQQLYKLIDVHEVHDITHSPFAERELMLIKVSVNTAARREILDIAEIFRAKPIDVSDHTVTLQLTGDLDKMVALQRLLEPYGICEVARTGRVALVRESKVDSKYLRGYSLPL

SEQ ID NO: 7201 - protein, 439 aa, Echinochloa colona
VASAAAGAGGEAASAPATVTAVAPAAAARDKVRRHTISVFVGDESGMINRIAGVFARRGYNIESLAVGLNKDKALFTIVVSGTDRVLNQVIEQLNKLVNVLSVEDLSKEPQVERELMLIKLNVQPDQRPEVMVLVDIFRAKVVDISDNTLTLEVAGDPGKIAAVQRNLKKFGIKEICRTGKIALRREKIGATARFWRFSAASYPDLIEALPKNPLTSVNRTVNGSFDQPSNAGGDVYPVEPYDSSSMDRVLDAHWGVLDDDDDSTGLRSHTLSILVNDCPGVLNIVTGVFARRGYNIQSLAVGPAAKEGISRITTVVPGTDESIEKLVQQLYKLVDVHEVHDITRLPFAERELMLIKVSVNTAARRDILDIAEIFRAKPVDVSDHTVTLQLTGDLDKMVALQRLLEPYGICEVARTGRVALVRESGVDSKYLRGYSLPL

SEQ ID NO: 7202 - protein, 481 aa, Oryza sativa
MSVASPHHLRPSPLAPACRAGGVPARAAAAHRPWCPRVRRAVAAASSGGGGGEAVTAVSAAAVGAPASAARDTVRRHTISVFVGDESGMINRIAGVFARRGYNIESLAVGLNKDKAMFTIVVSGTDRVLNQVIEQLNKLVNVLNVEDLSKEPQVERELMLIKINVEPDQRPEVMVLVDIFRAKVVDISENTLTIEVTGDPGKIVAVQRNLSKFGIKEICRTGKIALRREKIGATARFWGFSAASYPDLIEALPKNSLLTSVNKTVNGSFDQPSNAGGDVYPVEPYEGSSMNQVLDAHWGVLDDEDSSGLRSHTLSILVNDCPGVLNIVTGVFARRGYNIQSLAVGPAEKSGLSRITTVAPGTDESIEKLVQQLNKLVDVHEVQDITHLPFAERELMLIKVSVNTAARRDILDIAEIFRAKSVDVSDHTVTLQLTGDLDKMVALQRLLEPYGICEVARTGRVALVRESGVDSKYLRGYSFPL

SEQ ID NO: 7203 - protein, 438 aa, Panicum virgatum
AGAGGEAASAHAAVAASAVSPAAAAARDRVRRHTISVFVGDESGMINRIAGVFARRGYNIESLAVGLNKDKALFTIVVSGTDRVLNQVIEQLNKLVNVLSVEDLSKEPQVERELMLIKLNVKPDQRPEVMVLVDIFRAKVVDISDSTLTMEVAGDPGKIAAVERNLRKFGIKEICRTGKIALRREKIGATARFWRFSAASYPDLIEALPKNPITSVNKTVNGSFVQPSSAGGDVYPVEPYESSSMNQVLDAHWGVLDDDDDDSTGLRSHTLSILVNDCPGVLNIVTGVFARRGYNIQSLAVGPAEKAGISRITTVVPGTDESIEKLVQQLYKLIDVHEVHDITHSPFAERELMLIKVSVNTAARREILDIAEIFRAKPVDISDHTVTLQLTGDLDKMVALQRLLEPYGICEVARTGRVALVRESRVDSKYLRGYSLPL

SEQ ID NO: 7204 - protein, 392 aa, Saccharum officinarum
MINRIAGVFARRGYNIESLAVGLNKDKALFTIVVSGTDRVLNQVIEQLNKLVNVLSVEDLSKEPQVERELMLIKLNVEPDQRPEVMVLVDIFRAKVVDISEKTLTIEVAGDPGKIAAVQRNLRKFGIKEICRTGKIALRREKIGATARFWQFSAASYPDLIEALPKNPITSVNRTVNGSFDQPSNAGGDVYPVESYESLSANHVLDAHWGVLDDDDATGLSSHTLSILVNDCPGVLNIVTGVFARRGYNIQSLAVGPAEKEGISRITTVVPGTVESIEKLVQQLYKLVDVHEVHDITPSPFAERELMLIKVSVNTAARREILDIAEIFRAKPVDVSDHTVTLQLTGDFDKMVALQRLLEPYGICEVARTGRVALVRESKVDSKYLRGYSLPL

SEQ ID NO: 7205 - protein, 481 aa, Brachypodium distachyon
MLSSSHSLRPSPPAAAAAGPDSRPGCAARVSLRPWAQAPLRRAVAAGASAGGEAAAAVSAVSAGSTAAAKRDTVRRHTISVFVGDESGMINRIAGVFARRGYNIESLAVGLNKDKALFTIVVSGTDRVLKQVIEQLNKLVNVLNVEDLSKEPQVERELMLIKLNVGPDQRADVMFVADVFRARVVDISENSLTLEVTGDPGKIVAAQRNLSKFGIEEICRTGKIALTREKLGATARFWGFSAASYPDLIEALPKNPLLTSVKKTVNGSFDQPSSAGGDVYPVEPYESLSMNQVLDAHWGVLDDEDSSGLCSHTLSILVNDCPGVLNIITGVFARRGYSIQSLAVGRAEKEGISRITTVVPGTDESIEKLVQQLYKLIDVHKVHDLTHLPFAERELMLIKVSGNTAARREILDIGEIFRAKCVDLSDHTVTLQLTGDFAKMVALQGLLEPYGICEVARTGRVALVRESGVDSKYLRGYSHPL

SEQ ID NO: 7206 - protein, 512 aa, Brachypodium distachyon
MSDAQRHLSRATEAQTRWPLERPEASPSLLLMLSSSHSLRPSPPAAAAAGPDSRPGCAARVSLRPWAQAPLRRAVAAGASAGGEAAAAVSAVSAGSTAAAKRDTVRRHTISVFVGDESGMINRIAGVFARRGYNIESLAVGLNKDKALFTIVVSGTDRVLKQVIEQLNKLVNVLNVEDLSKEPQVERELMLIKLNVGPDQRADVMFVADVFRARVVDISENSLTLEVTGDPGKIVAAQRNLSKFGIEEICRTGKIALTREKLGATARFWGFSAASYPDLIEALPKNPLLTSVKKTVNGSFDQPSSAGGDVYPVEPYESLSMNQVLDAHWGVLDDEDSSGLCSHTLSILVNDCPGVLNIITGVFARRGYSIQSLAVGRAEKEGISRITTVVPGTDESIEKLVQQLYKLIDVHKVHDLTHLPFAERELMLIKVSGNTAARREILDIGEIFRAKCVDLSDHTVTLQLTGDFAKMVALQGLLEPYGICEVARTGRVALVRESGVDSKYLRGYSHPL

SEQ ID NO: 7207 - protein, 393 aa, Pennisetum glaucum
MINRIAGVFARRGYNIESLAVGLNKDKALFTIVVSGTDRVLNQVIEQLNKLVNVHSVEDLSKEPQVERELMLIKLNVKPDQRPEVMVLVDIFRAKVVDISDTTLTLEVAGDPGKIAAVQRNLRKFGIKEICRTGKIALRRERIGATARFWRFSAASYPDLIEALPKNPLTSVNRTVNGSLDQSSDAGGDVYPVEPYESSSMNQVLDAHWGVLDDDDDLTGLRSHTLSILVNDCPGVLNIVTGVFARRGYNIQSLAVGPAEKEGISRITTVVPGTDESIEKLVQQLYKLIDVHEVQDITHLPFAERELMLIKISVNTAARREILDIAEIFRAKPVDVSDHTVTLQLTGDLNKMVALQRLLEPYGICEVARTGRVALVRESGVDSKYLRGFSLPL

SEQ ID NO: 7208 - protein, 469 aa, Secale cereale
MSVATAHHLRPSPPAARDRLPLCAARASFRPLRRRGVAAGASAGGEATAAVSAVTASAKRDPVRRHTISVFVGDESGMINRIAGVFARRGYNIESLAVGLNKDKALFTIVVSGTDRVLKQVIEQLNKLVNVLNVEDLSKEPQVERELMLIKLNVEPDQRADVMFVANVFRAKVVDISENSLTLEVTGDPGKIVAAQRNLRKFGIEEICRTGKIALRREKIGATARFWGFSAASYPDLVEASRKNPLTSVNKTVNGSFDQPSSSGGDVYPVEPYESLSMNQVLDAHWGVLDDEDSSGLRSHTLSILVNDCPGVLNIITGVFARRGYSIQSLAVGPAEKEGISRITTVVPGTDESIEKLVQQLYKLIDVHKVDDLTDLPFAERELMVIKVSGNTAARREILDIGNIFRAECVDLSDHTVTLQLTGDLDKMVALQRLLEPYGICEVARTGRAALLRESRVDSKYLRGYSLPL

SEQ ID NO: 7209 - protein, 416 aa, Panicum virgatum
AGRVSGGKCRVRRHTISVFVGDESGMINRIAGVFARRGYNIESLAVGLNKDKALFTIVVSGTDRVLNQVIEQLNKLVNVLSVEDLSKEPQVERELMLIKLNVKPDQRPEVMVLVDIFRAKVVDISDSTLTMEVAGDPGKIAAVERNLRKFGIKEICRTGKIALRREKIGATARFWRFSAASYPDLIEALPKNPITSVNKTVNGIFVQPSSAGGDVYPVEPYESSSMNQVLDAHWGVLDDDSTGLRSHTLSILVNDCPGVLNIVTGVFARRGYNIQSLAVGPAEKEGISRITTVVPGTDESIEKLVQQLYKLIDVHEVHDITHSPFAERELMLIKVSVNTAARREILDIAEIFRAKPVDVSDHTVTLQLTGDLDKMVALQRLLEPYGICEVARTGRVALVRESRVDSKYLRGYSLPL

SEQ ID NO: 7210 - protein, 438 aa, Zea mays
MDPEPFVRLSVGQLGLKLPGGNASKAAGRLCDCEIRLGGFPVQTAPVPLVHSPAFNLDPFTNAAVFSLEESDLKALAAPGCFRAPRSSCLEVAVYYLARFGASRCGVLACGRKRLVGVFRVELASSEWRDGKPVLLHHGWAGIGKGAARPELHLRVKLEADPRYIFQFDDEIALNPQVVQLHGSIRQPVFSCKFIRDRRPSQSDPLGGGQYWSSSSSEEQDMEMVRRERKAWKVVIHDLSGSAVAAAFMATPFVPAPGGDTVARSNPGAWLIVRADTTGSSDSWQPWGRLEAWREAAAAAASSGKDTVRLRLHLLPDRHDDCVLVSEAPLSSDKGGEFFIDMDRQAPSATAAEHCAASLGAACAGGGFVMSCRVEGEARSSRPFVQLAMRHVTCMEDAAMFVALAAAVDLSVKACRPFRRKPNKKAASPSPDHLELDT

SEQ ID NO: 7211 - protein, 443 aa, Sorghum bicolor
MDPEPFVRLSVGQLGLKLPGGNACKAAGRLCDCEIRLGGFPVQTAPVPLIHSPAFNLDPFTNAAVFSLDESDLRALAAPGCFRAPRTSCLEVAVYYLARFGASSRCGGVVAAACRRKRLVGVFRVELASSEWRDGKPVLLHHGWAGIGKGEASARPELHLRVKLEADPRYIFQFDDDIALNPQVVQLHGSIRQPVFSCKFIRDRRPSQSDPLGGGGQYWSSSSSEEKDMEMVRRERKGWKVVIHDLSGSAVAAAFMATPFVPAPGGDTVARSNPGAWLIVRADTTGSSDSWQPWGRLEAWRDAAAASGGKDTVRLRLHLLPDRHDDCVLVSEAPLSSDKGGEFFIDMDRQAPSATAAEHCAASLGAACAGGGFVMSCRVEGEARSSRPFVQLAMRHVTCMEDAAMFVALAAAVDLSVKACRPFRRKPNKKAGSPSPDLLELDT

SEQ ID NO: 7212 - protein, 541 aa, Sorghum bicolor
MAALPPRWRPLLLLLVALLHVLLIGGAAAPFRARDVLPLLPRRLAWQLMGATAHSAVDLLPSFVAAVAPGGPAAAWRGACFEENQAVLSLTTPGSSGGRNGTAAGGLNSTTSGLGGAVIHLKTASPQSWTCMDLYVFATPYRIAWDYYMRSNENHTFEIKAWEEAAELEYVKQHGIAVFLMPSGMLGTLLSLVDVVPLFSNTGWGQDANLAFLQKHMGTSFQKRSAPWSANIRREDVHSGDFLALSKIRGRWGGFQTLEKWVTGAFAGHTAVFLKDENGTLWVAESGYENKKGDEIISMTPWDEWWGMALKDDSNPQIALLPLHPDVRARFNESAAWEFARSMYGKPYGYHNMIFSWIDTMSDNYPPPLDANLVMAIMSMWTRLQPHYASNMWNEALNKRLGTEKLDLHGVISETEKRGLSFNQLLTIPERDDWEYSDGKSTTCVAFILSMYKAAGVFAPFTESIQVTEFTIRDAYMLKIFEDNQTRLPSWCNAAADRLPFCQILGEYKMDLPEYNTIEPYANMNENCPSAPPTYNRPSRC

SEQ ID NO: 7213 - protein, 551 aa, Panicum virgatum
ARAGAARGQLGQLASASDGGFAAAAAGAAPLPALLLHALAAAAAPFRARDALPLLPRRLAWQLMGATAHSAVDLLPSFVGAVAPGGAPAAWRGACFAENEAVLSLTPGAGRSGAGGNTSSSSSLGGAVLRLKTASPESWTCMDLYVFATPYRMAWDYYMRSNENHTFEIKAWEEAAELEYVKQHGIAVFLMPSGMLGTLLSLIDVIPLFSNTGWGQDANLAFLKKHMGTSFQKRSQPWSANIRKEDVHSGDFLALSKIRGRWGGFQTLEKWVTGAFAGHTAVFLKDENGTLWVAESGYENKKGDEIISMTPWDEWWGMALKDDSNPQIALLPLHPDVRARFNESAAWDFARSMYGKPYGYHNMIFSWIDTMSDNYPPPLDANLVMAIMSMWTRLQPHYASNMWNEALNKRLGTEKLDLHGIITETERRGLSFNQLLTIPERDDWEYSDGKSTTCVAFILSMYKAAGVFAPFTESIQVTEFTIRDAYMLKIFEDNRTRLPGWCNAAADGLPFCQILGEYKMDLPEYNTIEPYANMNENCPSAPPAYSRPARC

SEQ ID NO: 7214 - protein, 522 aa, Zea mays
MAALPRRRLLLFLALLRVLICGAAPFRARDLLPLLPRRMAWQLMGATAHSAVDLLPSFVGAVAPGGPAAAWRGACFDENQAVLDLTPGRNGTAGGLGGAVLRLKTASPQSWTCMDLYVFATPYRVAWDYYMRSNENHTFEIKAWEDAAEMEYVKQHGIAVFLMPSGMLGTLLSLADVAPLFSNTGWGQDANLAFLGKHMGASFERRRSANTIIRREDVRSGDFLALSKIRGRWGGFQTLEKWVTGAFAGHTAVVLKDGDANLWVAESGYENNKGDEIISMTPWDEWWGMALKDESNPQIALLPLHPDVRARFDESAAWEFARSMCGKPYGYHNMIFSWIDTASDNYPPPLDANLVMAIMSMWTRLQPRYASNMWNEALNKRLGTEKLDLHGIIRETERRGLSFNQLLTVPERDDWEYSDGKSTTCVAFILSMYKAAGVFAPYTESIQVTEFTIRDAYMLKIFEDNQTRLPSWCNAAADGLPFCQILGEYKMGLPEYNTIEPYANMNENCPSAPPTYSRPSRC

SEQ ID NO: 7215 - protein, 343 aa, Sorghum bicolor
MADELDELIGFLSDRNPQVRGAAVDIVRGLTGGEDGLRALTARADRALPALLRLLASAAGSGAGEAAADSLVNLSQDADLAARLVALGAVDAAMDVVAKRGGAQPALARSLVMLLVNLTHVESGVAAFLQVGDEKVQGLYVAKLVRSFCRSSSDSEEEDIFEYVASILVNISKVEAGRRILMEPKRGLLKQIIRQFDSTNQLRKKGVAGTIRNCCFEADTQLQSLLSLAEYLWPALLLPVAGKKIYSEEDRSKMPLELSSALSHEREAVDDSEIRQQALEAIYMIVLQDDGRRSFWSVNGPRILQVGYEDEEDPKVMEAYELIGSLLVGKGEGEQEQEQGEKP

SEQ ID NO: 7216 - protein, 343 aa, Brachypodium distachyon
MADELNELIDFLSNSSPQVRGAAADIVRGLTGDGEGLRSLTARADRALPALLRLLASVGGGAGEAAADSLVNLSQDGALAARLVALGAVAAAMDVMVKRSGEQPKLARSLVMLLVNLTQVESGIAALLQVGDEKVQGLYVAKLVRSFCRSSSESEDEDIFEHIASILVNISKVEAGRRILMEPKRGLLKQIIRQFDSTNQLRKKGVAGTIRNCCFEADTLIQNLLSIAEYLWPALLLPVAGKKIYSEEDRSKMPLELANALSHEREAVEDSEIRERALEAIYMIVMQDDGRRAFWSVNGPRILQVGYEEEEDLKVMGAYELIGSLLVGKGEIEQDQEQGQDKP

SEQ ID NO: 7217 - protein, 344 aa, Leymus cinereus x Leymus triticoides
MADELDELIDFLSNSSPQVRGAAADIVRGLTGDSDGLRSLTSRADRALPALLRLLASVGGGAGEAAADSLVNLSQDGELAARLVALGAVAAAMDVMVKRGGEQPKLARSLVMLLVNLTQVESGISALLQVGDEKVQGLYVAKLVRSFCRSSSDSEDEDIFEHIASILVNISKVEAGRRILMEPKRGLLKQIIGQFDSTNQLRKKGVAGTIRNCCFEADTQIQNLLSIAEYLWPALLLPVAGKKIYSEEDRSKMPPELANALSHEREAVDDSEIRERALEAIYMIVMQDDGRKAFWSVNGPRILQVGYEDEEDLKVMGAYELIGSLLVGKGEIEQDQEQGEDKPQ

SEQ ID NO: 7218 - protein, 345 aa, Oryza sativa
MADELDELLGFLSSPQPNVRGAAAGIVRGLTGDADGLRALSARADRALPALLRLLASAGGELGTGGAAADSLVNLSQDGALSARLVSLGAVVAAMDVVAKRGGEQPGLARSLVMLLANLTQVDSGVAALLQVGDEKMQGLYVAKLVRSFCRSSSESEEEDIFEHVASILVNISKVEAGRRILMEPKRGLLKQIIRQSDSTNQLRKKGVVSTIRNCCFEADTQIQNLLSLAEYIWPALLLPVAGKKIYSEEDRSKMPPELANALSHEREAVENSEIRQQALEAIYMIVLQDEGRRAFWSVNGPRILQVGYEDEEDPKVMEAYELIGSLLVGKGDDEQDQEQGGQKP

SEQ ID NO: 7219 - protein, 345 aa, Secale cereale
MADELDELIDFLSNGSPQVRGAAADIVRGLTGDSDGLRSLAARADRALPALLRLLASVGAGGAGEAAADSLVNLSQDGDLAARLVVLGAVAAAMDVMVKRGGEQPKLARSLVMLLVNLTQVESGISALLQVGDEKVQGLYVAKLVRSFCRSSSDSEDEDIFEHIASILVNISKVEAGRRVLMEPKRGLLKQIIGQFDSTNQLRKKGVAGTIRNCCFEADTQIQNLLSIAEYLWPALLLPVAGKKIYSEEDRSKMPPELANALSHEREAVDDSEIRERALEAIYMIVMQDDGRKAFWSVNGPRILQLGYEDEEDLKVMGAYELIGSLLVGKGEIEQDQDQGEDKPQ

SEQ ID NO: 7220 - protein, 341 aa, Secale cereale
AGRAHRLPLQRLPAGARRRGGHRAGAHRGQRRAALPRGPRRPRAAGAAPAARVRGGRGAGEAAADSLVNLSQDGELAARLVVLGAVAAAMDVMVKRGGEQPKLARSLVMLLVNLTQVESGISALLQVGDEKVQGLYVAKLVRSFCRSSSDSEDEDIFEHIASILVNISKVEAGRRILMEPKRGLLKQIIGQFDSTNQLRKKGVAGTIRNCCFEADTQIQNLLSIAEYLWPALLLPVAGKKIYSEEDRSKMPPELANALSHEREAVDDSEIRERALEAIYMIVMQDNGRKAFWSVNGPRILQLGYEDEEDLKVMGAYELIGSLLVGKGEIEQDQEQGEDKPQ

SEQ ID NO: 7221 - protein, 345 aa, Secale cereale
GRGRLDELIDFLSNGSPQVRGAAADIVRGLTGDSDGLRSLAARADRALPALLRLLASVGAGGAGEAAADSLVNLSQDGELAARLVVLGAVAAAMDVMVKRGGEQPKLARSLVMLLVNLTQVESGISALLQVGDEKVQGLYVAKLVRSFCRSSSDSEDEDIFEHIASILVNISKVEAGRRILMEPKRGLLKQIIGQFDSTNQLRKKGVAGTIRNCCFEADTQIQNLLSIAEYLWPALLLPVAGKKIYSEEDRSKMPPELANALSHEREAVDDSEIRERALEAIYMIVMQDNGRKAFWSVNGPRILQLGYEDEEDLKVMGAYELIGSLLVGKGEIEQDQEQGEDKPQ

SEQ ID NO: 7222 - protein, 554 aa, Panicum virgatum
MSLRGDPAAAGDETAEELLKRVRGMVPPALAAAGPAAGFPGRWKAIAAKLEALPACLSDLSSHPCFAKNALCRELLQSLAATLAEAADLAGRCRGPPPDGKLRTQSAIDALSGKLDLNLRDCALLVRTGVLSDASGPSPPAEAPAHADVRELLARLQIGHTEAKNRAMDGLLEALRNDEKSVLSVLGRANVSAMVQLLTASAPVVREKAATVICQVAESGSCEVLLVSEGVLPPLIRLAESGSLVGREKAAITLQRLSAVSPDVARAIVGHGGAGPLIEICQTGDSISQPAAAGALKNLSAVPEVRQALADQGIVRVMVHLLDCGAVAGSKEHAAECLQNLTSSNDGLRRAVVSEGGLRSLLLYLDGPPPPESAVGALRNLVGAVSPDSLVSLGVLPRLAHVLRVGSVGAQQAAAAAICRMSSSAEMKRVVGEHGCVPLLVRLLEAKSNAAREVAAQALASLASWPPNAREVRKDDKGVPSLVQLLDPSPANTANKYAIGCLLTLAASKRCKKLMISHGAIGYLKKLSDMDVAGARKLLERLERGSLRSLFSRN

SEQ ID NO: 7223 - protein, 550 aa, Panicum virgatum
MSLRGDPAAAGDETAEELLERVRGMVPPALAAAGAAAGFPGRWKAIAAKLEALPACLSDLSSHPCFAKNALCRELLQSVAATLAEAADLAGRCRGPPPDGKLRTQSAIDALSGKLDLNIRDCALLVRTGVLSDASGPSPPAHADVRELLARLQIGHTEAKNRAVDGLLEALRSDEKSVLSVLGRANVAAMVQLLTAPAPVVREKAATVICQVAESGACDGLLVSEGVLPPLIRLAESGSLVGREKAAITLQRLSAVSPDAARAIVGHGGAGPLIEICQTGDSISQPAAAGALRNLSAVAEVREALADQGIVRIMVNLLDCGTVAGSKEHAAECLQNLTSGGDSLRRAVVSEGGLRSLLLYLDGPLPPEPAAGALRNLVGAVSPDSLVSLGVLPRLAHVLRVGSIGAQQAAAAAICRMSSSAEMKRAVGEHGCVPLLVRLLEAKSKAAREVAAQALASLVSWPPNAREVRRDDKGVPSLVQLLDPSPANTANKYAIACLLTLAAAKRCRKLMISHGAIGYLKKLSDMDVAGARKLLERLERGSLRSLFSRN

SEQ ID NO: 7224 - protein, 565 aa, Sorghum bicolor
MSFRGGDPAAAGEEEEEELLERVRGMVPAVAAAARAAGGFPGRWKAIAAKLDTLPACLSDLSSHPCFARNALCRELLQSVAATLADAAELAARCREPPADGKLRTQSAIDALSGRLDLGLRDCALLVKTGVLSDAAGPSPSPSPPTAEAPSAAVQADVRELLARLQIGHAEAKSRAVDGLLDALRRDERSVLAALGRASVSAMVQLLTASAPVVREKAATVVCQVAESGGAACEALLVSEGVLPPLVRLAESGSLVAREKAVVTLQRLSASSPDVARAVVGHGGAGALVEICQTGDSVSQSAAAGALRNLSAVPEVRLALADEGIVRVMVSLLDRGAVAGAKEHAAECLQNLTSGNDDLRHAVVAEGGLRSLLLYLDGPLPQEPAVSALRNLVGAVSPDSLVALGVLPRLVHVLRVGPSGAQQAAAAAVCRISSSAEMKRAVGEHGCIPLLVRLLEAKSNGAREVAAQALASLVSCPANAREMKKDDKCVPNLVQLLDPSPANTAKKYAIACLLTLSGAKRCKKMMVSHGAIGYLKKLSDMDVAGAKKLHERLEGGRLRSMFSRH

SEQ ID NO: 7225 - protein, 563 aa, Oryza sativa
MSLWKHPAAAGDGEVVETVVELLARVRGMVPPALGAAGAAEGFPGRWKAIAAKLEGLPACLSDLSSHPCFAKNALCRELLQSVAATLAEAAELAARCREPPAAGKLQMQSAIDALAGKLDLNLRDCALLVKTGVLSDAFTPPPPTDEATSTATAAQADVRELLARLQIGHTEAKSLAVDGLLEALNKDEKSVLSVLGRANVAALVQLLTAPATKVREKAATVICQLAESGGCEGLLVSEGALPPLIRLAESGSLLGREKAVITLQRLSMSSDTARAIAGHGGARPLIEMCQTGDSISQSAAAGALKNLSAVPEVRQALADEGIVRVMVGLLDCGTVLGSKEHAADCLQNLTSSSDSFRRAVVSDGGLRSLLVYLDGPLPQESAVSALRNLVSAVSPDSLVSLGVLPRLAHVLRVGSTGAQQAAAAAICRISTTTDMKRVVGEHGCVPLLVRMLDAKSNGAREVAAQAMASLVGYPPNAREVRRDGKSVPCLVQLLDPSPANTAKKYAIACLLSLAAAKRCKKLMISHGAIGYLKKLSDMDVAGAKKLLERLERGKLRSLFSRD

SEQ ID NO: 7226 - protein, 556 aa, Zea mays
MSSRGPDPAPPGEEQETAEELLERVRGMVPAAAAAARAAGGFPGRWKAIAAKLDALPACLSDLSSHPCFARNSLCRELLQSVAATLADAAELAARCREPPADGKLRAQSAVDALSGRLDLGLRDCALLVKTGVLSDAAGPSPPPEEAPDVRELLARLQIGHAEARGRAVDALLDALRRDERGVLAALGRASVAALVQLLTASAPAVREKAATAVCQVAGSGAASEALLVSEGVLPPLVRLAESGSAVGREKAAATLHRLSASPDVARAVVGHGGAGPLVEICRTGDSVSQPAAAGALRNLSAVPEVRQALADEGVVRVMVGLLDRGAVVAGATKEHAAECLQNLTSGSDGLRRAVVSEGGLRSLLLYLDGPVPKEPAVGALRNLVGAVSPDSLVALGVLPRLVHVLKIGSVGAQQAAAAAVCRISSSAEMKRAVGEHGCVALLVRMLEAKSNGAREVAAQALAALASCPANAREMKKDDKCVPSLVQLLDPSPANTAKKYAIACLLTLSGTKRCRKVMVSHGAIGYLKKLSDMDVAGAKKLHERLERGSLRSMFSR

SEQ ID NO: 7227 - protein, 942 aa, Sorghum bicolor
MAVQLAPSVESNNIWTAEIKVPYGVHFKYNYFVREEMGSSSDIIWRPGPVYSLSIPSVGQKKQVIVVKDLWMKASLAGLPTPSWGSWLMEAGSLEGELFDGGNNQSIVKDHSARDTSNQGLSVGDHIIFKLGNGTPLHAKLLDNQSSIMHNSVTEIPNASYISQHGRSQIVEEPWILESIVAAKKPVAKVKDKKGQKKFVNYKHTLSGVSKNMHQQDQPVEEPWLFQSMFELNETIVHANGKTEARDIIGKLRKIEKPPTPLDESKPSGGEPSSRVILMNSSVCTIQRIAVLEDGKLVELLLEPIKNNVQCDSIYLGVVTKLVPHMGGAFVDIGISRPSLMSIKQNRDPFVYPQVFKNRGTDPIDDSYCNEENLPTYENDDDMSDDEFANEETHDGSSFPVENITDNEEAVVLASDAKINNVDGDEFDSISVYDEDKDEENDHMEDEYSEDILQGDQSEISNDLKTLSSIQHALRESNDDTNGSRWSQVRKGTKVMVQVVKEGLGTKGPTLSPFPCLRSRFWILVSRGNKVGVSKKITGIERTRLKGITKLLRPPGFTLTARTVAAGHSWEELQKDLDGLLSTWKGITEHAQSAALAAEEGVEGAVPVMLHRAKGQTLSVVQDDFNEKVKRLVVDSPRTYHEVTSYLQEVAPELCSRVELYEKRKPIFDVYNIEKEIDSILCKRVPLCNGGSLVIEQTEALVSIDVNGGHSMFGQGTSQEKAILEVNLEAAKQIARELRLRDIGGIIIVDFIDMSDDSNKRLVYEEMKKAVEKDRSTVGVSELSKLGLMEITRKRVRPSVTFMISEPCTCCHGTGRVEALDTSFSKIEREICRRLATSRRKSDPEKPKSWPRFVLRVDHEMCTYLTSGKKTKLGLLSSSLKVWILLKIARGFSRGAFELLPYSEKENCAEKETSSELPQKEGRPKLSVFPIKKWMSRAKRAK

SEQ ID NO: 7228 - protein, 247 aa, Pennisetum glaucum
MSERSESATEKIMSSIIDTIADNLPKQKSGQFDPGSVSDKVKNKLFGRQKTLHGALGGGKPADVLLWRNKKISSSVLAVATAIWVFFEWLDYHFLTIISFALVLGMVGQFVWSNFSNMLNGSPSKVPRVELPDELFVNIAVAIGAQVNKFLNFLQDVSCERNLKHFVVAIAGLWAAAVIGSWCNFLTVIYIGFVCAHTLPVLYEKYEDQVDDFLYNLLGLLRDQYQKLDQGVLSKIPKGNLKAKKNE

SEQ ID NO: 7229 - protein, 248 aa, Zea mays
MSERSESATEKIMSSIMDTIADNLPKQKSGKFDPGSVSDKVKNKLFGRQKTLHGVLGGGKPADVLLWRNKKISSSVLALATAIWVFFEWLDYHFLTIVSFALVLGMVVQFVWSNFSNMLSSGSRSQVPRVELPDELFVNIAVAIGAQVNKFLCFLQDVSCERNLKHFVVAIAGLWAAAVIGSWCNFLTVIYVGFVCVHTLPVLYEKYEDQVDDFLYSLLGLLRDQYQKLDQGVLSKIPKGNMKAKKNE

SEQ ID NO: 7230 - protein, 247 aa, Saccharum officinarum
MSESSESATEKIMSSIMDTIADNLPKQKSGHFDPGSVSDKVKNKLFGRQKTLHGVLGGGKSADVLLWRNKKISSSVLALATAIWVFFEWLDYHFLTIVSFALVLGMVIQFVWSNFSNMLSGSPSQVPRVELPDELFVNIAVAIGAQVNKFLCFLQDVSCERNLKHFVVAIAGLWAAAVIGSWCNFLTVIYIGFVCVHTLPVLYEKYEDQVDDFLYNLLGLLRDQYQKLDQGVLSKIPKGNMKAKKNE

SEQ ID NO: 7231 - protein, 247 aa, Sorghum bicolor
MSERSESATEKIMSSIMDTIADNLPKQKSGHFDPGSVSDKVKNKLFGRQKTLHGVLGGGKPADVLLWRNKKISSSVLALATAIWVFFEWLDYHFLTIVSFALVLGMVVQFIWSNFSNMLSGSPSQVPRVELPEELFVNIAIAIGAQVNKFMCFLQDVSCERNLKHFVVAIAGLWAAAVIGSWCNFLTVIYIGFVCVHTLPVLYEKYEDQVDDFLYNLLGLLRDQYQKLDQGVLSKIPKGNMKAKKNE

SEQ ID NO: 7232 - protein, 247 aa, Panicum virgatum
MSERSGSATEKIMSSIIDSIADNLPKQKSGQFDPGAVSEKVKNKLFGRQKTLHGVLGGGKPADVLLWRNKKISSSVLALATAIWVFFEWLDYHFLTIVSFALVLGMVVQFVWSNFSNMLSGSPSQVPRVELPDEMFVNIAVAIGAQVNKFLSFLQDVSCERNLKHFLVSIAGLWAAAVIGSWCNFLTVIYIGFVCAHTLPVLYEKYEDQIDDFLYNLLGLLRDQYQKLDQGVLSKIPKGNMKAKKNE

SEQ ID NO: 7233 - protein, 118 aa, Panicum virgatum
MSERSGSATEKIMSSIIDSIADNLPKQKSGQFDPGAVSEKVKNKLFGRQKTLHGVLGGGKSADVLLWRNKKISSSVLALATAIWVFFEWLDYHFLTIVSLPLFLECLSSLFGPISQTC

SEQ ID NO: 7234 - protein, 247 aa, Oryza sativa
MLEHSESATEKIMSSIMDTIAENLPKQKSGKFDVGAASDKMKEKLFGRQKTIHRVLGGGKPADVLLWRNKKISSSVLALATAIWVFFEWLDYHFLTIVSFALVLGMVVQFVWSNFSSALSGSPSKVPRVELPEELFVNIAVAVGTQVNKFLSFLQDVSCERNLKHFVLAIVGLWAAAVIGGWCNFLTVIYIGFVSAHTLPVLYEKYEDQVDDFLYNILGLLRDQYQKLDQGVLSKIPKGNMKFKKSE

SEQ ID NO: 7235 - protein, 265 aa, Echinochloa colona
MEYLAYVTASRATIYRHHLCLSVLHLSLLSVCSIMDTIADNLPKQKSGHFDPSSVSDKVKNKLFGRQKTLHGVLGGGKPADVLLWRNKKISSSVMALATAIWVFFEWLDYHFLTIVSFALVLGMVVQFVWSNFSNMLSGSPSQVPRVELPDELFVNIAVAIGAQVNKFLSFLQDVSCERNLKHFVVAIAGLWAAAVIGSWCNFLTVIYIGFVCAHTLPVLYEKYEDQVDDFLYNLLGLLRDQYQKLDQGVLSKIPKGNMKAKKNE

SEQ ID NO: 7236 - protein, 242 aa, Brachypodium distachyon
MSEHSENVTEKIMGSIMDTIADNLPKQKSGRFDPAAVSDKVNKLFGRQQSLHGVLGGGKSADVLLWRNKKISSSVLALATAIWIFFEWLDYHFLTIISFALVLGMVVQFVWSNFASRSSNVPRVELPKELFVNIAVAVGAQVNKFLGFLQDVSCERNLKHFVLAIVGLWAAAVAGSWFNFLTVIYIGFVCAHTLPVLYEKYEDQVDSFLYSLLDLLRDQYKKLDSGVLSRIPKGNMKFKKSE

SEQ ID NO: 7237 - protein, 437 aa, Cenchrus ciliaris
MAASHHHGGHLVLLALSLAAALYAADASSHNITAVLDGRSEYTLYNSYLSETKVCDEINSEHTVTVLVLNNGAMSSLVANLSLADIKNALRLLTLLDYFDEKKLHSLDSGSELTTSLYQKNGQAAGNMGHVNITDLRGGKVGIAPATPGAKFQSTYTKRVDEEPSTLSVLEVSDPITFPGLFGSPSASSVNLTDLLEKAGCKQFARLIVSSGVLKMYQAAMDKGLTLLAPNDDAFKAKDLPDLSKLSSADLVTLLQYHALPQYAPKSSLKVAKGHIPTLASSGAGKYDLSVVSSGDDVSLDTGKDRSRVASTVLDDTPTVILTVDKVLVLPGLFGGAPSPAPAPGPAADVPASAPAPETSAPSPSPKGAGKKKKKKAKSPSHSPPAPPSDSPDMAPADAPEGDAADKVESKKNGAAAAAASFAATVACVALAVAAFL

SEQ ID NO: 7238 - protein, 437 aa, Panicum virgatum
MAAAPHHHRGHLVLAVLSLAAAFAAAVDSSSHNITAVLDGRSEYTLYNSYLSETKVCDEINSEHTVTVLVLTNGAMSSLVANLSLAEIKNALRMLTLLDYFDEKKLHSLDSGSELTTSLYQKTGQAAGNMGHVNITDLRGGKVGFASAAPGAKFQSTYTKRVDTEPSTLSVLEVSDPITFPGLFGSPSASSVNLTDILDKAGCKQFARLIVSSGVVKMYQAAMDKALTLLAPNDDAFKAKGLPDLSKLSSADLVTLLQYHALPQYAPKASLKVAKGDIPTLASTGAGKYGLSVVSSGDDVSLDTGLGKSRVASTVLDDTPTVILTVDKLLLPSELFGGAPSPAPAPGPAADVPASAPAPETSAPAPSPKAAAKKKKAKSPSHSPPAPPADSPDLAPADAPEGDAEDKADSKKNGAAAAAVSLAATVACIALAVAAFL

SEQ ID NO: 7239 - protein, 429 aa, Sorghum bicolor
MAASHHLILLVLCLTAAAASAHNITAILDGRSEYTLYNSYLSQTKVCDEINSRSSVTVLVLTNGAMSSLVANLSLADIKNALRLLTLLDYFDEKKLHSIGSSSQLTTSLYQTTGQAAGDMGHVNITDLRGGKVAFASAAPGAKFQSTYTKRVADFPSNLSVLEVSDPITFPGLFGSPSASSANITDLLEKAGCKQFARLIVSSGVVKTYQAAMDKGLTLFAPNDDAFKAKDLPDLSKLTSADLVALLQYHALPQYAPKASLKVASGRIPTLASTGAGKYDLTVASSGDEVSLDTGVDKSRVASTVLDDPPTVILTVDSVLLPHVIFGGAPSPAPAPGPAADVPASAPAPEGSAPAPTPKAAGKKKKKKAKSPSHSPPAPPADSPDLAPADAPDDDAADKVESKKNGAAAAAVSFVASVASAGLAVALLL

SEQ ID NO: 7240 - protein, 429 aa, Zea mays
MAASHRLILLVLCLTATAASAHNITAILDGRSEYTLYNSYLSETKVCDEINSRSSVTVLVLTNGAMSSLVANLSLADIKNALRLLTLLDYFDEKKLHSIGSSSQLTTSLYQTTGQAAGDMGHVNITDLRGGKVAFASAAPGAKFQSTYTKRVADFPSNLSVLEVSDPITFPGLFGAPSASSANITDLLEKAGCKQFARLIVSSGVVKTYQAAMDKALTLFAPNDDAFKAKDLPDLSKLTSADLVALLQYHALPQYAPKASLKVASGRIPTLASTAAGKYDLAVASSGDEVTLDTGVDKSRIASTVLDDPPTVILTVDSVLLPHVLFGGAPSPAPAPGPAADVPASAPAPEGSAPAPAPKAAGKRKKKKARSPSHSPPAPPADSPDMAPADAPTEDAADKVESKKNGGAAAAVSFAASVASVALAVAYLL

SEQ ID NO: 7241 - protein, 303 aa, Panicum virgatum
MSHTKALLILCPDLLTAWNSRKMVLLEKYDFTKIKDELQLCALILSYSPKNESTWSHRRWVLKQVAEHHQDMTELVEKESVLVKEIAERSKMNYRAWRHRCWLIPYMTRKQVLDELKKSTRWSELHVADNCCFHYRRSLLLALLDVRLENREDSLSWESETYLLWKEELRWNEMLIRRHQGRESLWNHRRFLLQWWIQQLLAVDETRSSMTFQVDLFITQEICLLSECLNEPADEFEESRVQAELSALYILWISKQVPAVNGKLKERLHSVSIMGLKDLLVRACRPEKTRLWMNVLGLADPLQ

SEQ ID NO: 7242 - protein, 416 aa, Panicum virgatum
MEQEDGSAAAAAEQPAGGAEEQLAGDLLHHFERVLHSDPLIDEVGFLHPTQFNSLGCGQDGDSAPQDSELQRRYFWCRDHKLAISAEILPELYRAARDAYYSSRNAPLPPTHLMSHTKALLVLCPDLLTAWNSRKRVLSEEYDFTKLKDELQLCALILSYSPKNESTWSHRRWVLKQLAEHHQDMAELVEKESVLVKELAERSKMNYRAWRHRCWLIPYMTRKQVLDELKKSTRWSELHVADNCCFHYRRSLLLALLDSRLENREDSLCWESETYLLWKEELRWNEMLIRRYQGRESLWNHRRFLSLWWIQQLLAVEETCSSMTSQVDLFITQEICLLSECLNDPADEFEESHAQGELSALYILWISKQVPAVNGKLKEGLHSVSIRGLKDMLVRACRPEKTRLWMNVLSLANPSQ

SEQ ID NO: 7243 - protein, 364 aa, Pennisetum glaucum
GDLLRHFERVLHSDPLIDEVGFLHPTQFVSLGRGQDGDSAPQAPEFQRRYFWCRDHKLAICSEVLPKLYRAARDAYSSARNDPSQAARLMSLTKALLILCPDMLTAWNSRKMVLSGKYDFTKLKDELQLCALILSYSPKNESTWSHRRWVLKQVAEQHQDMAELVEKESVLVEEIAERSKMNYRAWRHRCWLIPHMTRKQVLDELKKSTRWSELHVADNCCFHYRRSLLLTLLDNHLENGQDSLSCESETYLLWKEELRWNEMLIRRYQGRESLWNHRRFLSQWWIQQLFVVEETCPSTTSQVDLFITQEIGLLSECLNDPGDEFGESCVQAELSALYILWISMQVPAVKGKLEARLHSVPLRG

SEQ ID NO: 7244 - protein, 303 aa, Panicum virgatum
MSHTKALLILCPDLLTAWNSRKMVLSEKYDFTKLKDELQLCALILSYSPKNESTWSHRRWVLKQVAEQHQDMTELVEKESVLVKEIAERSKMNYRAWRHRCWIIPYMTRKQVLDELKKSTRWSELHVADNCCFHYRRSLLLALLDSHLENREDSLSWESETYLLWKEELRWNEMLIRRYQGRESLWNHRRFLSQWWIQQLLAVEKNCPSMTSQVDLFITQEIDLLSECLNDPVDDFEEPRIQAELSGLYILWISKQFPAVNGKLKERLHSVSIMGLKDVLVRACRLEKTRLWMNVLGLADPSQ

SEQ ID NO: 7245 - protein, 397 aa, Panicum virgatum
MGKSGRKPRESHRQGRGRRTSHFGDDLPSSAYDAPPPHHEDSSDDDDDGTNGATAEDEQEEDAKADEKDQWAAGSMPSKFHLYQLSVQSPKGDISYLQKFFLMYVGGRVPLHLQEDFCGTALLSTEWIRTDARRTAIGLDLDLESLEWCLENNLSKIGADGYSRMLLFHGNVLQPKEARLVKQRFNDLVQGLDVNSGNGSSGSNKCEQLGLANSKCIANSTMSEAALPGRDIICAFNYSCCCLHSRKDLVLYFRHAFNILSKRGSIFVMDVYGGTSSERKLRLQRKFPSFTYFWEQEEFDITSRQTRISLHFQAGKKQMLRHAFTYHWRLWSIPEIKDCLEEAGFKSIHVWIREMPNTQSSGNAKEYNANRDVKYEESQRFNQGDAWNAYVVGVANI

SEQ ID NO: 7246 - protein, 392 aa, Panicum virgatum
MGKSGKKPRESHRQGRGRRTSHFGDDLPSSAYDAPPSHDDDDDGTNEATAKDEREEDSGADEKGQWAAGSMPSKFHLYQLSVQSPKGDISYLLKFFLMYVGGRVPLHLQEDFCGTALLSAEWIRTDARRTAIGLDLDLESLEWCLENNLGKIGADGYSRMLLFHGNVLQPKEARLVKQRFNDLVQGLDVNSGNGFSESHSCEQSSLANSKCISNSTMSEAALPGRDIICAFNYSCCCLHSRKDLVLYFRHAFNALSKRGGIFVMDVYGGTSSERKLRLQRKFPSFTYFWEQEEFDIISRQTRISLHFQAGKKQMLRHAFTYHWRLWSIPEIKDCLEEAGFKSIHVWIREMPNTQSSGNAKEYNANRDVKYEESQRFNQGDAWNAYVVGVANI

SEQ ID NO: 7247 - protein, 399 aa, Sorghum bicolor
MGKSGKKPRESHRQGRGRRASHFGDEDGDDLPSSAYDAPPRPNEDSSDDNDDTSEATAEDEPERDAEAGEQDQWRAGSMPSKFHLYQLSVQSPKGDISYLQKFFLMYVGGRVPLHLQEDFCGTALLSTEWIRTDARRTAIGLDLDLESLEWCLEHNLSKIGVDGYSRMLLFHGNVLQPKDARLVKQKFSDLVHGLNVNSDNGSGSNSCEQTDLADSKCLANLTMSEATFPGRDIICAFNYSCCCLHSRKDLVLYFRHVCSALSKRGGIFVMDVYGGTSSERKLRLQRKFPSFTYFWEQDEFDIISRQTRISLHFQAGKKQMLKHAFTYHWRLWSIPEIKDCLEEAGFKSVHIWIREMPNTQSSGNTKEYNANRDVKYEESQRFNQGDAWNAYIVGVANI

SEQ ID NO: 7248 - protein, 403 aa, Oryza sativa
MGKSGKKTESHRQGRGRRASRFRGGGGGGDEDGDELPSSAYDAPPPHHEDSDGDDTDEAAAEDEHEGGVDGGDQEQREVGSMPSKFHLYQLSVQSPKGDISYLQKFFLMYVGGRVPLHFQEDFCGTALLSAEWLRTDARRTAVGLDLDLESLEWCLENNLSKIGADGYSRMLLFHGNVLQPNVARLVKQKICDAMQDLHVNNDNDSLASNICDQLDPASPKCSANSTMSDLVLPARDIICAFNYSCCCLHRRKDLVLYFRHAFNALSKRGGIFVMDVYGGTSSERKLRLQRRFPSFTYFWEQEEFDIISHQTRISLHFQAGKKQMLRHAFTYHWRLWSIPEIKDCLEEAGFKSIHVWIREMPNTQSSGNAKEYNANRDVKYEELQHFNQADAWNAYVVGVANI

SEQ ID NO: 7249 - protein, 396 aa, Triticum aestivum
MGKSGKKTKESHRQGRGRRGSQVGDDDLPSSAYDAPPRRQEDSDGDDSDEAAAEDEHDGGAEAGDRQGQWQVGSMPSKFHLYQLSVQSPKGDISYLQKFFLMYVGGRVPLHLQEDFCGTALLSTEWLRTDTRRTAVGLDFDRESLEWCLENNLSKIGADGYSRLLLFDGNVLQPNESRLVKQKISDLVQGLNVTSDDGSTEKNSCEQSDSSFTKCEANSTMSDAVLPGRDIICAFNYSCCCLHKRKDLVLYFRHAFNALSKRGGIFVMDVYGGTSSECKLRLQRRFPSFTYFWEQEEFDIITRETRISLHFQVGKKQMIRHAFTYHWRLWSIPEIKDCLEEAGFKSIHVWIREMPDTKSSGNAKEYTADRDVKYEELQHFNQADAWNAYIVGVANI

SEQ ID NO: 7250 - protein, 417 aa, Brachypodium distachyon
MCKIYIPSSKTAKPLAGKHAGTHRWVRAERSRRNRTDMAEATVPHSSAMRTYLRLTIGAPPPRPEDSDDDDSNEAAAEGEDEGDAEAGDQGQWQVGPMPSKFHLYQLSVQSPKGDISYLQKFFLMYVGGRVPLHLQEDFCGTALLSTEWLRTDARRTAIGLDFDRESLEWCLDNNMSKIGADGYSRMLLFDGNVLQPNESRLVKQKISDLMQGLNTTNDNGSTEICDQSESAIPKCLANSTMADAVLPGRDVICAFNYSCCCLHRRKDLVLYFRHAFSALSKRGGIFVMDLYGGTSSECKLRLQRRFPSFTYFWEQEEFDIITRETRISLHFQVGKKQMLRHAFTYHWRLWSIPEIKDCLEEAGFKSIHVWVREMPDTQSSGNAKEYTADRDVKYEELQHFNQGDAWNAYVVGVANI

SEQ ID NO: 7251 - protein, 396 aa, Hordeum vulgare
MGKSGKKTKESHRQGRGRRGSQLGDDDLPSSAYDEPPRRQEDSDGDDSDGAAAEDEHDGGAEAGDRQGQCQVGSTPSKFHLYQLSVQSPKGDISYLQKFFLMYVGGRIPLHLQEDFCGTALLSTEWLRTDTRRTAVGLDFDRESLEWCLENNLSKIGADGYSRLLLFDGNVLQPNESRLVKQKASDLVQGLNLTSDDGSTETNSCEQSDSSFTKCAANSTMSDAVLPGRDIICAFNYSCCCLHKRKELVLYFRHAFNALSKRGGIFVMDVYGGTSSECKLRLQRRFPSFTYFWEQEEFDIITRETRISLHFQVGKKQMIRHAFTYHWRLWSIPEIKDCLEEAGFKSIHVWVREMPDTKSSGNAKEYTADRDVKYEELQRFNQADAWNAYVVGVANI

SEQ ID NO: 7252 - protein, 335 aa, Zea mays
MALAAAIIVVFLLPGLLLTAMAATPYPHGRGADALVGASKKYEGSSNLVDLRYHMGPVLSAAPLRLYVLWYGRWDPAHQVPVRDFLLSLSDTSLPRPSVADWWATAALYADQTLANVTCRVDLAGEAADESASLGRSLSRLDIQRVLASAVAAGRLPADTRGGAYLVLTAPGVGVQDFCRAVCGFHYFTFPSLVGHTLPYAWVGHSGGRCADVCAYPFALSSYMARSGMAALRPPNGDAGVDGMVSVIAHELAELATNPLVNAWYAGEDPTAPTEIADLCEGVYGTGGGGGYAGKVSVDAQGRSWNVNGRKGRKFLVQWLWSPEAKACVGPNASD

SEQ ID NO: 7253 - protein, 331 aa, Panicum virgatum
MALAAAAVLLLIPGLLLTAMAATPYPHGDPLLGASKRYEGSSDLVDLRYHMGPVLSAAPLRLYVLWYGRWDPAHQAPLRDFLLSLSDPSPPPPSVAAWWATAALYADQTLANVTRRVALAAEATDASASLGRSLSRLDIQRVLAAAVAAGRLPADARGGAYLVLTAPGVGVQDFCRAVCGFHYFTFPSLVGHTLPYAWVGHSGGRCADVCAYPFALPAYMSRGGMAALRPPNGDAGVDGMVSVIAHELAELATNPLVNAWYAGEDPTAPTEIADLCEGVYGTGGGGGYAGRVAVDAQGRSWNVNGRNGRKFLVQWLWSPEAKACVGPNASD

SEQ ID NO: 7254 - protein, 332 aa, Panicum virgatum
MAHAAAVLLLIPGFLLHTAMAATPYPHGGDPLLGASKRYEGSSDLVDLRYHMGPVLSAAPLRLYVLWYGRWDPAHQAPLRDFLLSLSDPSPPPPSVAAWWATAALYADQTLANVTRRVALAAEAADASASLGRALSRLDIQRVLASAVAAGRLPADARGGAYLVLTAPGVGVQDFCRAVCGFHYFTFPSLVGHTLPYAWVGHSGGRCAEVCAYPFALPSYMSRGGMAALRPPNGDAGVDGMVSVIAHELAELATNPLVNAWYAGEDPTAPTEIADLCEGVYGTGGGGGYAGRVAVDAQGRSWNLNGRNGRKFLVQWLWSPEAKACVGPNAND

SEQ ID NO: 7255 - protein, 537 aa, Panicum virgatum
MADGAAGGGRAEVDTSAPFESVREAVDRFGGSAAWSSDLVRRMFAPSKKHEDSEQAAQTINVQEQAAQLENEVAVKERETLDVLKELESTKKIIADLKLKIQKETSETSPDEAVKSEETDLVSTAEPEEQQPENVIVDVDMEGVEENPQQPSGGSVLVELEQTKESLNRTTNDLAAVRAAVELLRNSIAKEKMLLERGREKLSSNTSLVSSLEDELDQTAQKLETLKDLQKRRKDPSDIFIEIKKMTSEVQELRSMANGSKSEAMLLAAEIEQAKASISTAEIRCIAAKKMEEAARAAEALALAEIKALLSSESSFEGENSSDGVTLSMEEYFILCSKALETDENSKKKVGDAMQQVDIANSSESESVKRLEDAKLEVEECKKALREALKRVEAANHGKLAVEEILRRWKSESGHRKRSIGGSPKFKNATHHRKDSYSMDIVDNVSDRSFKQTLSIGQILSMKLMGPDGYDKSVWDDKTSETPNISLGQILNRSGVLCREDVASRRRISAKRKKFALTGLSVLLAKQSKSKKKRESF

SEQ ID NO: 7256 - protein, 545 aa, Sorghum bicolor
MSSDAECAAAQAAAPDAAGGGRAEIDTSAPFESVREAVDRFGGSAAWSSDLVRRMFAPSKKHEHSEQAAEAINAEEQAAQLENELAVKERETLDVLKELEATKKIIADLKLKIQKEATETSPEEAAKSDEADQVSEAGPEEQQPENINVDVDMEGAEENHSGSVSAELEQAKASLNRTTGDLAAVRAAVELLRNSIAKEKLLLERGREKLSSNTSLVSSLEDELDQAAQKMETLKDLQRRRKDPSDIFMEIKKMTTEVQQLRSMANDSKSEAMVLAAEIEQAKASISTAEVRCIAARKMEDAARAAEALALAEIKALLSSESSFEGDTASDGVTLSMEEYFTLCSKALEADENSRKKAEDAMLQVDVANNSESESVKRLEDAKVEVEECKKALQEALKRVEAANHGKLAVEEILRRWKSESGHKKRSLGGSPKFKNVAHRREYSHTTDMISDVSDRSHKPTLSIGQILSMKLMGPDGYDKSVWDDKASEIPDISLGQILNRSGVLCREDMATRKRISGKRKKFALTGLSVLLAKQSKNKKKRESF

SEQ ID NO: 7257 - protein, 522 aa, Echinochloa colona
TSAPFESVREAVDRFGGSAAWSSDLVRRMFAPSKKHEHSEQAAQAINVQEQAAHLENELALKERETLDVLKELESTKKIIADLKLKIQKEATEASPAEAVNSEETDQVSAAGPDEQPPENFTMNVDMEGIEGNPQQPSGSVLLELEQTKESLNRTTSDLAAVRAAVELLRNNIAKEKMLLERGREKLSSNTSLVSSLEDELDQTAQKLETLKDLQRRRKDPSDIFIEIKKMTSEVQQLRSMANDSKSEALLLAAEIEQVKASISTAEVRCIATKKMEEAARAAEALALAEIKALLSSDSSFEGDKASDGATLSMEEYFTLCSKALEADENCKKKLGDAMLQVDIANSSESESVKRLEDAKVEVEECKKALQEALKRVEAANHGKLAVEEILQRWKSESRHRKRSIGGSPKFKNATHHRKDLLSMDIVDDVSDRSFKQTLSIGQILSMKLMGPDGYDKSVWDDKASEMPNISLGQILNRNGVLCREDMVSRKRISGKRKKFALTGLSVLLAKQSKSKKKRESL

SEQ ID NO: 7258 - protein, 561 aa, Panicum virgatum
MADGAAGGGRAEIDTSAPFESVREAVDRFGGSAAWSSDLVRRMFAPSKKHEDSEQAAETINVQEQAAQLENEVAVKERETLDVLKELESTKKIIADLTLKIQKESTETSPDEAVKSEETDQVSMAEPEDQQPENVAVDVDMEGVEENLQQPSGSVLVEENLNRTTKDLAAVNPQQPSDSVFVELEQTKERLNRTTNDLVAVRAAVELLRNSIAKEKMLLERGREKLSSNNSLVSSLEDELDQTAQKLETLKDLQKRRKDPSDIFIEIKKMTSEVQELRSMANGSKSDAMLLAAEIEQAKASISTAEIRCIAAKKMEEAARAAEALALAEIKALLSSESSLEGENSSDAVTLSMEEYFTLCSKALEADENSKKKVGDAMQQVDIANSSESELVKRLEDAKLEVEECKKALQEALKWVEAANHGKLAVEEILGRWKSESGHRKRSIGGSPKFKNATQRRKDSYSMDIVDDVSDRSFKQTLSIGQILSMKLMGPDGYDKSVWDDKTSETPNISLGQILNRSGVLCREDMASRRRISGKRKKFALTGLSVLLAKQSKSKKKRESF

SEQ ID NO: 7259 - protein, 666 aa, Zea mays
MSSDLSTRSSPSSSTASPSDDSRRQEQGQAAGNASGSRRWRWRLGLGAAWALDPRARWVRDWNRAYLLACAAGLMVDPLFLYAVSLSGPLMCIFVDGWLAAAVTALRCGVDAMHVWNVATQLRTAKAPPGKRVAGDEEQQQTVAEAARKLPEDAASRRGLLLDFFVILPVMQVVVWVAAPAMIRAGLTTPVMTVLLVSFLLEYLPKIYHAARLLRRMQRQSGYIFGTIWWGIALNLMAYFVAAHAVGACWYLLGVQRASKCLKEQCLQAAGCARGSAVACAAPLYYGGSPSPGVGGGDRLAWAGNAQARGTCLASGDNYQYGAYTWTVMLVANPSRVERMLLPIFWGLMTLSTFGNLESTTEWLEIVFNIITITGGLVLVTMLIGNIKVFLNATTSKKQAMHTRLRGVEWWMKRKKLPRSFRGRVRQFERQRWAATRGVDECQIVRDLPEGLRRDIKYHLCLDLVRQVPFFQHMDDLVLENICDRVKSLIFPKGETIVREGDVVQRMLFIVRGHLQCSQVLRNGATSSCTLGPGNFSGDELLSWCLRRPFLERLPTSSATLVTLESTEVFGLDAADVKYVTQHFRYTFTNDKVRRSARYYSPGWRTWAAVAVQLAWRRYKHRKTLSSLSFIRPRRPLSRCSSLGEEKLRLYTAILTSPKPNQDDDF

SEQ ID NO: 7260 - protein, 710 aa, Sorghum bicolor
MSSDLSARSSALSSSTASPSDDSRRKEQGRHATTNGSGSGSSSGRRGSHWRSQRVQWLGGAGAAWAVDPRARWVRDWNRAYLLACAAGLMVDPLFLYAVSLSGPLMCLFVDGWLAAAVTALRCAVDAMHVWNVATQLRLRVARAGAGAGATPGSKRVASGAGDEEQQQQQGAEDDDEEAAAEAARKLPEESRKGMLLDFFVILPVMQVVVWVAAPAMIRAGLTTPVMTVMLVAFLLEYLPKIYHAARLLRRTQRQSGYIFGTIWWGIALNLMAYFVAAHAVGACWYLLGVQRASKCLKEQCLQAAAAGGCARSSAVACAAPLYYGGSPSTSGVIGSGDRLAWSRNAQARGTCLSSGGGGGDNYQYGAYSWTVMLVANPSRVERMLLPIFWGLMTLSTFGNLESTTEWVEIVFNIVTITGGLVLVTMLIGNIKVFLNATTSKKQAMHTRLRSVEWWMKRKNLPRSFRARVRQFERQRWAATRGVDECQIVRDLPEGLRRDIKYHLCLDLVRQVPFFQHMDDLVLENICDRVKSLIFPKGETIVREGDVVQRMLFIVRGHLQCSQVLRNGATSSCTLGPGNFSGDELLSWCLRRPFLERLPTSSATLVTLESTEVFGLDAADVKYVTQHFRYTFTNDKVRRSARYYSPGWRTWAAVAVQLAWRRYKHRKTLSSLSFIRPRRPLSRCSSLGEEKLRLYTAILTSPKPNQDDDF

SEQ ID NO: 7261 - protein, 457 aa, Sorghum bicolor
MLATAGGRAVFHLRPRPPWRAPPPPATTHLSHSAPARRADHHRLPLGFLSTMEVGISSVYLGQRAHSATCSYSLDDRLQGELDDMNGEQRKQETVGAFQKIPMVMPATDILMSAQRKSRNVPPTKGIANIAKRERNKGAKQLDALMKELSVPLRTYTENFPKRRDLHPYERSLIELTFGEGYYEQVLGRVDTLRKRITSVGKQHASVCAKSTTKREAEERLTEGRKKLEEAFQHGKHAVDDLVNVAKALRSMPVVDLHIPTLCLVGSPNVGKSSLVRILSSGKPEVCSYPFTTRGILMGHIVSNHERFQVTDTPGLLTRHDDDRNNIERLTLAVLSYLPIAVLYVHDLSEDCGTSVADQYITYKHIKDRFGDRLWLDVISKCDLLGKKEPISFHDADDVAQYRRLGPEGALRVSVQSEIGVKELKERVHELLTSQMARIKASKAEHETQEIRTSVVY

SEQ ID NO: 7262 - protein, 462 aa, Zea mays
MRATATAGGRAVFHLQHLRPRPPWRALPPAATTHLSRSAPARRADHRCLPKGFLSTLEPRISGVSLCRRAHATCSYSLDDKLQGELDDTQGEQRKLETVGAFQKIPMVMPATDILMSAQRKSRNVPPTKGIANIAKRERNKGAKQLDALMKELSVPLRTYTENFPKRRDLHPYERSLIELTFGEGYYEQVLGRVDTLRKRITSVGKQHASVCAKSTTKREAEERLTEGRKKLEEAFQHGKHAIDDLVNVAKALRSMPVVDLHIPTLCLVGSPNVGKSSLVRILSSGKPEVCSYPFTTRGILMGHIVSNQERFQVTDTPGLLTRHDDDRNNIERLTLAVLSYLPIAVLYVHDLSEDCGTSVADQYITYKHIKDRFGDRLWLDVISKCDLLGKKEPISFHDADEDVARYRRLGPEGALQVSVQTEIGVKQLKERVHELLTSQMARIKSSKAEHETHEVGTSVVY

SEQ ID NO: 7263 - protein, 203 aa, Pennisetum glaucum
RRLPKGFLHTLEPGVSAVYLCRRVHSTACSVSLDGRLQGELDGAKGEVQKHETVGAFQKIPMVMPATDILMSAQRKSRNVPPTKGIANIAKRERNKGAKQLDALMKELSVPLRTYTENFPKRRDLHPYERSLIELTFGEGYYEQVLGRVDALRKRITSVGKEHASVCAKSTTKREAEERLTEGKKRLEEVFQYGQYAIDDLVM

SEQ ID NO: 7264 - protein, 355 aa, Sorghum bicolor
MVMPATDILMSAQRKSRNVPPTKGIANIAKRERNKGAKQLDALMKELSVPLRTYTENFPKRRDLHPYERSLIELTFGEGYYEQVLGRVDALRKRITSVGKQHASVCAKSTTKREAEERLTEGRKKLEESFQHGKHAIDDLVNVAKALRSMPVVDLHIPTLCLVGSPNVGKSSLVRILSSGKPEVCSYPFTTRGILMGHIVSNHERFQVTDTPGLLTRHDDDRNNIERLTLAVLSYLPIAVLYVHDLSEDCGTSVADQYITYKHIKDRFGDRLWLDVISKCDLLGKKEPISFSDADDDVAQHRRLGPEGALRVSVQSEIGVKELKERVHELLTSQMARIKASKAEHETQEIGTSVL

SEQ ID NO: 7265 - protein, 355 aa, Panicum virgatum
MVMPATDILMSAQRKSRNVPPTKGIANIAKRERNKGAKQLDALMKELSVPLRTYTENFPKRRDLHPYERSLIELTFGEGYYEQVLGRVDALRKKITSVGKQHASVCAKSTTKCEAEERLTEGRKRLEEAFQHGKHAIDDLVNIAKALRSMPVVDLHIPTLCLVGSPNVGKSSLVRILSSGKPEVCSYPFTTRGILMGHIVSNHERFQVTDTPGLLTRHDDDRNNIERLTLAVLSYLPIAVLYVHDLSEDCGTSVADQYITYKHIKERFGDRLWIDVISKCDLLGKKAPISSDDADEEVAQYRRFGPEGTLRVSVQSEIGVKELKERVHQLLTSQMARIKADKAEHETQKARISVP

SEQ ID NO: 7266 - protein, 466 aa, Festuca arundinacea
MRAAAGGRAFQFHLLCPRRPWRPPSSPSAATAPLSNSTHAGCLHRRHPSRGFLPSLEPGVSTVYMCRRVHSATSSVSLDDRSQEGLTDGSNGDIVHKSEMVGAFQKIPMVMPATDILMSAQRKSRNVPPTKGITNIAKRERNKGAKQLDALMKELSVPLRTYTENFPRRRDLHPYERSLIELTFGEGYYEKVLGRVDALRKKINSVGKQHASVCAKSLTKREAEERLCEGRKELEEVFQRGQHAIEDLINVAKALRSMPVVDPHIPTLCLVGSPNVGKSSLVRILSTGKPEVCSYPFTTRGILMGHIVSNHERFQVTDTPGLLTRHDDDRNNIEKLTLAVLSYLPIAVLYVHDLSEDCGTKVADQYITYKHIKERFGDRLWINVISKCDLLDKAVPSSFDYDDDEVRRYRMFGPEDAIRVSVQSQIGTEELKERVHHLLTSQMARIKDGKSEDELQGTDSTVRRLT

SEQ ID NO: 7267 - protein, 412 aa, Pennisetum glaucum
MSCLGWFKRRSRSAGGSSGKRGASAPPSGPATTTTTTVSGVSTSRSDSSSGAVRPVSKSAGSAASSQSQVSISSLYEERGHGQLRVFDYEELQAATAEFSRAQKLGEGGFGSVYKGFVRAADGKGDRIPVAVKKLNQRGLQGHKQWLAEVQFLGVLEHPNLVKLLGYCAVDSERGPQRLLVYEFMPNKSLEDHLFRRANPPLSWNGRLQVILGAAEGLAYLHEGVEVQVIYRDFKTSNILLDKDFRAKLSDFGLAREGPTGANTHVSTAVVGTHGYAAPEYIDSGHLTAKSDVWSFGVVLYEILTGRRSLDRNRPASEQKLLEWVTQFPADSRNFRMIMDPRLRGEYSVKAAREIAKLADSCLLKNAKERPTMSEVVEVLRRAVQAAEPDGRAPGAGAVRGKRADAAAPPRR

SEQ ID NO: 7268 - protein, 415 aa, Panicum virgatum
MSCLGWFKRRSRSDGASSGKRGASASASSGPATATATTTTVSGVSTSRSDDSGAVRPVSKSAGSAASSQSQRSISSLYEERGHGQLRVFDYQELQAATADFGRAQKLGEGGFGSVYKGFVRAADGRGDRIPVAVKKLNQRGLQGHKQWLAEVQFLGVLEHPNLVKLLGYCAVDSERGAQRLLVYEFMPNKSLEDHLFRRANPPLSWNKRLQVILGAAEGLAYLHQGVEVQVIYRDFKTSNILLDKDFRAKLSDFGLAREGPTGANTHVSTAVVGTQGYAAPEYVDSGHLTAKSDVFSFGVVLYEILTGRRSLDRNKPAAEQKMLEWVAQFPPDSRNFRMIMDPRLRGEYSAKAAREIAKLADSCLLKTAKERPTMGEVVEVLRRAVQAAEPDSRSAPGSGAVRGKRGDAAAPSRR

SEQ ID NO: 7269 - protein, 422 aa, Sorghum bicolor
MSCLGWFKRRRSRSGGSSTSTSGKRGASASAPVSVSGPATTMTTTTMASAVSTSRSDDSGAVRPVSKSAGSSSQASQRSISSLYEERGHGQLRVFDYEELQGATAEFSRAQKLGEGGFGSVYKGFIRAADGKGDRVPVAVKKLNQRSMQGHKQWLAEVQFLGVLEHPNLVKLLGYCAVDSERGPQRLLVYEFMPNKSLEDHLFRRANPPLSWNKRLQVILGAAEGLAYLHEGVEVQVIYRDFKTSNILLDKDFRAKLSDFGLAREGPTGENTHVSTAVVGTHGYAAPEYMESGHLTAKSDVWSFGVVLYEILTGRRSLDRNKPAAEQKLLEWVVQFPPDSRNFRMIMDPRLRGEYSVKAAREIAKLADSCLLKNAKERPTMSEVVEVLRRAVQAHAEPDSRTPGGPGAKGKKSSDAATPSRR

SEQ ID NO: 7270 - protein, 422 aa, Zea mays
MSCLGWFKRRSRSGGSAAKRGASAPVSASGPATTTTTTTTATTASAVSTSRSDDSGAARPASKSAGSAGSSSQSHRSISSLYEERGHGQLRVFGYEELQGATADFSRAQKLGEGGFGSVYKGFIRGADGKGDRVPVAVKKLNQRGMQGHKQWLAEVQFLGVLEHPNLVKLLGYCAVDSERGAQRLLVYEFMPNKSLEDHLFRRANPPISWNTRLQVILGAAEGLAYLHEGVEVQVIYRDFKTSNVLLDKDFRAKLSDFGLAREGPTGANTHVSTAVVGTHGYAAPEYMDTGHLTAKSDVWSFGVVLYEILTGRRSLDRNRPAAEQKLLEWVAQFPPDSRNFRMIMDPRLRGEYSAKAAREIAKLADSCLLKNAKERPTMSEVVEVLRRAVQAHAEPDGRTPGPGARGKKAAAAAAAAAPSRR

SEQ ID NO: 7271 - protein, 418 aa, Zea mays
MSCLCWFKRRSRKGRSSSSGKRGASSTATVSVSGPATATATTTTTASAESTSRSDDSGAVRPVSKSAGSSQSQRSISSLYEERGHGQLRVFDYDELQGATAEFGRAQKLGEGGFGSVYKGFIRAADGKGDRVPVAVKKLNQRGMQGHKQWLAEVQFLGVLEHPNLVKLLGYCAVDSERGAQRLLVYEFMPNKSLEDHLFRRANPPLPWNRRLQVILGAAEGLAYLHEGEVQVIYRDFKTSNVLLDKDFRAKLSDFGLAREGPTGANTHVSTAVVGTQGYAAPEYMDTGHLTTKSDVWSFGVVLYEILTGRRSLDRNRPAAEQKLLEWVAQFPPDSRNFRMIMDPRLRGEYSVKAAREIAKLADSCLLKNAKERPTMSEVVEVLGRAVQAHAEPDSGAPGPGAKGKKTDAATPSRRRRD

SEQ ID NO: 7272 - protein, 406 aa, Oryza sativa
MSCLGWFKKRRSSKSKESSGRRGSTTTTVSAVSTSRSDDSGAVRPASKSTGSTSSHRSISSLYEERGHGQLRDFDYDELQAATNGFSRAQKLGEGGFGSVYKGFVRSSPADGKAADRLAVAVKCLNQRGLQGHKQWLAEVQFLGVLEHPNLVKLLGYCAVDGERGPQRLLVYEYMPNKSLEDHLFVRAYPPLSWNRRLQIILGAAEGLAYLHEGQVQVIYRDFKASNILLDKDFRAKLSDFGLAREGPTGANTHVSTAVVGTHGYAAPDYIETGHLTVKSDVWSFGVVLYEILTGRRTLDRHRPQGEQKLLEWVAQFAPDSRNFRMIMDPRLRGEYSVKAARDIAKLAESCLLKNAKERPTMSEVVDVLRRAVQSQPDPPPPPAAAAAASGKGKRVDVAPQPARRR

SEQ ID NO: 7273 - protein, 128 aa, Panicum virgatum
MAAVARVFRGSRFLMSPAPGAAAAAGAKKAAAPQVTKADATAAKEKRGILKPVPVSEEMRRFTGGKPEVARSEAVKLIWAHIKANGLQNPAKKTEINCDATLKSLFGGRDKIGMLEISKLLNPHFLKN

SEQ ID NO: 7274 - protein, 128 aa, Panicum virgatum
MAAVARVFRGSRFLMSPAPGAAAAAGAKKAAAPKVTKADATAAKEKRGIMKPVPVSEELSRFAGGAPELARSQVVKLIWAHIKANGLQNPAKKKEINCDAALKSLFGGRDKVGMLEIPKLLNPHFMKN

SEQ ID NO: 7275 - protein, 127 aa, Pennisetum glaucum
MAAVARGFRGSRFLMSPAAGAAAAGAKKAAAPKVTKADATAAKEKRGIMKPVPVSEEMSRFAGGATELARPEAVKLVWAHIKANALQNPTKKTEINCDATLKSLFGGRDTVGMFEIGKLMNHHFLKN

SEQ ID NO: 7276 - protein, 71 aa, Cenchrus ciliaris
MGFVLVISLPFIFFSILLGFGCYFLGKHRGREEMRAGVGAQIYGTPLPPPGVVGGSSPAHEPFHMKKEGAE

SEQ ID NO: 7277 - protein, 73 aa, Echinochloa colona
MGFVLVISLPLIFFSILLGFGCYFLGKHRGREEMRAGVGAQIYGTPLPPPGVVGGSSPAPEPFHMKKEGPENV

SEQ ID NO: 7278 - protein, 73 aa, Echinochloa colona
MGFVLVISLPLIFFSILLGFGCYFLGKHRGREEMRAGVGAQIYGTPLPPPGVVGGSSPAPAPFHMKKEGPENV

SEQ ID NO: 7279 - protein, 73 aa, Panicum virgatum
MGFVLVISLPFIFFSILLGFGCYFLGKHRGQEEMRAGVGAQIYGTPLAPPGVVGGASPAHEPFAMKKEGAENV

SEQ ID NO: 7280 - protein, 73 aa, Eragrostis curvula
MGFVLVISLPFIFSSILLGFGCYFLGKHKGREEMRAGVGAQIYGTPLPPPGVLGGTSPAAEPFHMKKEGAENV

SEQ ID NO: 7281 - protein, 73 aa, Panicum virgatum
MGFVLVISLPFIFFTILLGFGCYFLGKHRGREEMRSGVAAQIYGTPLPPPGVVGGASPAHEPFAMKKEGAENV

SEQ ID NO: 7282 - protein, 73 aa, Saccharum officinarum
MGFVLVVSLPFIFLSILLGFGCYFLGKHRGREEMRTGVGAQIYGTPLPPPGVVGVSSPQPEPFHAKKQGPEAV

SEQ ID NO: 7283 - protein, 73 aa, Zea mays
MGFVLVVSLPFIFLSILLGFGCYFLGKHRGREEMRTGVGAQIYGTPLPPPGVVGASSPPPEPFHSKKQWSEAV

SEQ ID NO: 7284 - protein, 73 aa, Saccharum officinarum
MGFVLVVSLPFIFLSILLGFGCYFLGKHRGREEMRTGVCAQIYGTPLPPPGVVGVSSPQPEPFHAKKQGPEAV

SEQ ID NO: 7285 - protein, 73 aa, Saccharum officinarum
MAFVLVVSLPFIFLSILLGFGCYFLGKHRGREEMRTGVGAQIYGTPLPPPGVVGVSSPQPEPFHAKKQGPEAV

SEQ ID NO: 7286 - protein, 75 aa, Sorghum bicolor
MGFVLVVSLPFIFLSILLGFGCYFLGKHRGREEMRTGVGAQIYGTPLPPPGVVGVSSPPPGAEPFHAKKQGPEAV

SEQ ID NO: 7287 - protein, 70 aa, Lolium multiflorum
MGFVLVISLPFIFFTILLGFGCYFLGKHRGREEMRAGVGAQIYGTPLPPPGVAGSSPGPYPLTKEGPANV

SEQ ID NO: 7288 - protein, 74 aa, Secale cereale
MGFVLVISLPFIFFTILLGFGCYFLGKHKGREEMRAGVGAQIYGTPLPPPGVAGQSPGPYPVPVPMKKEGADAV

SEQ ID NO: 7289 - protein, 73 aa, Zea mays
MGFMLVVSLPFIFLSILLGFGCYFLGKHRGREEMRTGVGAQIYGTPLPPPGIVGASSPPPEPFHSKKQWSEAV

SEQ ID NO: 7290 - protein, 72 aa, Secale cereale
MGFVLVISLPFIFFTILLGFGCYFLGKHKGREEMRAGVGAQIYGTPLPPPGVAGQSPGPYPVPMKKEGPDAV

SEQ ID NO: 7291 - protein, 93 aa, Zea mays
MGFVLVVSLPFIFLSILLGFGCYFLGKHRGREEMRTGVGAQIYGTPLPPPSVVGASSPPPQPFHSKKEVYECDTRFAKKGSWRLFFLFFFSFG

SEQ ID NO: 7292 - protein, 74 aa, Secale cereale
  Sequence also found in Organisms: Triticum aestivum
MGFVLVISLPFIFFTILLGFGCYFLGKHKGREEMRAGVGAQIYGTPLPPPGVAGQSPGPYPVPVPMKKEGPDAV

SEQ ID NO: 7293 - protein, 70 aa, Avena sativa
MGFVLVISLPFIFFTILLGFGCYFLGKHKGREEMRAGVGAQIYGTPLPPPGVAGHSPGPYPLTKEGPANV

SEQ ID NO: 7294 - protein, 149 aa, Setaria italica
MAYMRVTHRDEEGKKVTEKMPIPETRRPDTAKHFERKLEEQGFHRLERHPANAPRGVGIGTPPPKSGRGGKYTWEGPGGLVEDELDPAPPAIDPNDPNYEEEEGGPAGDEDDAAKEVVVGEVEVAKVAEERDGVARVDVAPPLLQEQKQ

SEQ ID NO: 7295 - protein, 146 aa, Panicum virgatum
MAYMRVTHRDEEGKKVTEKLPVPETRRPDTAKYFERKLEEQGFHRFERHPANAPRGVGIGTPPPKSGRGGKYTWEGPGGLVEDELDPAPPAIDPNDPNYEDDDGAQDEVAKEVVVGEVEVAKVAEERDGVARVDVAPPLLQEQHTQ

SEQ ID NO: 7296 - protein, 145 aa, Panicum virgatum
MAYMRVTHRDEEGKKVTEKLPVPEARRPDTAKYIERKLEEQGFHRFERHPANAPRGVGIGTPPPKSGRGGKYTWEGPGGLVEDELDPAPPAIDPNDPNYEDDDGAVDEVAKDVVVGEVEVAKVAEGRDGVARVDVAPPLLQEQQQ

SEQ ID NO: 7297 - protein, 148 aa, Zea mays
MAAYMRVTHRDEEGKKVTEKMPVPETRRPDTAKHFERKLEEQGLHRFERHPANAPRGVGIGAPPPKSGRGGKYTWEGPGSVVEDQLDPAPPAIDPNDPNYEEGGAADEDDEAAREVVVGEVEVAKVAESRDGVARVDVAPGLLQDQKQ

SEQ ID NO: 7298 - protein, 154 aa, Cenchrus ciliaris
MAYMRVTHRDEEGKKVTEKMPLPETRRPDTAKHFERKLEDQGFHRLERHPANAPRGVGIGAPPPKSGRGGKYTWDGPGGLVQDELDAAPAAFFPNDPPYEEEAEDNKGGGGGRRGGGGRQGRRGKGWRRQGRRRAAPAPGTEAVAFRVVWVWSL

SEQ ID NO: 7299 - protein, 147 aa, Pennisetum glaucum
MAYMRVTHRDEEGRKVTEKMPVPETRRPDTAKHYERKLEDQGLHRLERHPANAPRGVGIGAPPPKSGHGGRYTWEGPGSLVQDELDPAPAAIDPNDPNYEDDGGAVVDDDAAGEALVGEVEVAKVAAARGGVARVDVAPPLLREQAQ

SEQ ID NO: 7300 - protein, 146 aa, Sorghum bicolor
MAAYMRVTHRDEEGKKVTEKMPVPETRRPDTAKHFERKLEEQGLHRFERHPANAPRGVGIGTPPPKSGRGGKFTWEGPGGVVDGQLDPAPPAIDANDPNYVAPEEEEEEVAREVVVGEVEVAKVAESRVGVARVDVAPALLQDQNQ

SEQ ID NO: 7301 - protein, 871 aa, Zea mays
MFGNIGKIPIIGDLTGSNKNAHLKGNLVLMRKTVLGFDVTSIAGSLMDGLGEFLGRGVTCQLVSSTVVDPNNGNRGKVGQEASLEQWLLHPPPLLAGEDQFRVTFDWEVEKHGVPGAIIVKNNHASEFFLKTITIDDVPGHGPIVFVANSWVYPQYKYRYNRVFFSNDTYLPSQMPAALKPYRDDELRNLRGDDQQGPYQEHDRVYRYDVYNDLGNPDAKNPRPVLGGSKHHPYPRRGRTGRKPTQTDPNSESRLTLTDGDVYVPRDERFGHIKNSDFYGYTIKAFVDGLVPILEGYLLGIEFNSFKDILQLYEGGIKLPDIPALEEFRKQFPLQMVKDLMPAGGDYVLKLPMPKIIKEDKKAWMSDEEFARETLAGVNPLIIRRLTEFPPKSTLDPSKYGDQTSTITEAHIAGSLEGLTVQQALDSNRLYILDHHDHYMPFLIEVNSLNDNFIYATRTLLFLRGDGTLAPVAIEMSLPELRDGITAAKSTVYTPAPPTAGAEAWVWRLAKAYVNVNDYCWHQGISHWLNTHAVMEPFVIATNRQLSVTHPVHRLLLPHYRDTMNINALARQKLINAGGIFEMTVFPRKYAIEISSKVYGSWNFTEQALPDDLIKRGMAVPDPSSPYKVRLLIEDYPYASDGLAVWHAIEQWVTEYLAIYYPNDGVLQADVELQAWWKEAREVGHADLKDEHWWPKMQTVPELVKACTTIIWIASALHAAVNFGQYPYCGYHPNRPSVSRRPMPVPGSDAYKELEKNPEKFFVRSITAQFQAVVGISLLEILSSHSSDEVYLGQRDTKEWTSDAKAQEAFKRFGARLTEIEKRVEAMNKDPRFKNRYSAAQFPYTLLFPNTSDKGDNTGVTAKGIPNSISI

SEQ ID NO: 7302 - protein, 873 aa, Sorghum bicolor
MFGNIGKIPVISDITGSNKNAHLKGNVVLMRKTVLGFDVTSTAGAVIDGVGEFLGRGVTCQLISSTVVDPYNGNRGKVGAEASLEQWLLQPPPLLSGENKFGVTFDWEVEKHGVPGAIIVKNNHASEFFLKTITLDDVPGHGTVVFVANSWIYPQSKYRYNRVFFSNDTYLPSQMPAALKPYRDDELRNLRGDDQQGPYQEHDRVYRYDVYNDLGNPDGGNPRPVLGGSKDHPYPRRGRTGRKPTLTDPSSESRLTLVDGDVYVPRDERFGHIKNSDFYGYTIKAFADGLVPILQGYFLGLEFNSFKDILQLYEGGIKLPDIPALEEFRKQFPLQMVKDLMPAGGDYVLKLPMPQIIKEDKKAWMSDEEFARETLAGVNPLIIRRLTEFPPKSTLDPSKYGDQTSTITEAHIAGSLEGLTVQEALDSNRLYILDHHDHYMPFLIEVNSLDDNFIYATRTLLFLRGNGTLAPVAIEMSLPELVRDVTAAKSTVYTPAPPTAAGAEAWVWRLAKAYVNVNDYCWHQGVSHWLNTHAVMEPFVIATNRQLSVTHPVHRLLLPHYRDTMNINALARQKLINAGGIFEMTVFPRKYAIEITSKVYATWNFADQALPDDLIKRGMAVPDPSSPYKVRLLIEDYPYASDGLAVWHAIEQWVTEYLGIYYPNDGVLQADVELQAWWKEAREVGHADLKDEPWWPKMETVAELVKACTTIIWIASALHAAVNFGQYPYCGYHPNRPSVSRRPMPVPGTDEYAELEENPEKFFLRSITTQFQAVVGISLLEILSSHSSDEVYLGQRDTKEWTSDAKAQEAFRRFGARLVEIEKRVEAMNKDPRYKNRYSEAQFPYTLLFPNTSDKKGDNAGVTAKGIPNSISI

SEQ ID NO: 7303 - protein, 867 aa, Setaria italica
MFGGIIGGLTGNKNGRLNGSVVLMRKSVLGFDVTSMGATVIDNIGEFLGRGVTCQLISSTVVDPNNGNRGKVCAEASLEQWLTSLPSLTSSESKFGVTFEWEVEKLGVPGAIIVKNNHASEFFLKTITLDDVPGRGTIVFVANSWVYPQSKYRYSRVFFANDTYLPSQMPAALKPYRDDELRNLRGDDQQGPYQEHDRVYRYDVYNDLGLPDSGNPRPTLGGSGDLPYPRRCRTGREPTKSDPSCESRLTLVEGDIYVPRDERFGHIKKSDFYGYAIKALVNAVVPAIRTYVDLSPGEFDSFGDIIRLYEGGIKLPEIPALEELRKQFPLQLVKDVLPVGGDYLLKLPMPQIIKEDKTAWMTDEEFGREILAGVNPMLIRRLTEFPPRSTLDPSKYGDHTSTITAAHIERNLEGLTVQQALDGNRLYILDHHDNFMPFLLKFNSLNGNFIYATRTLLFLRSDGTLAPVAIELSLPELKDGLTTAKSTVYTPTSTTGAEAWVWHLAKAYANVNDYCWHQLISHWLNTHAVMEPFVIATNRQLSVAHPVHKLLLPHYRDTMNINSNARQMLVNAGGIFETTVFPRKYTFEMSSVIYKNWNFTEQALPDDLIKRGMAVADPSSRYKVRLLIEDYPYASDGLAIWHAIEQWVTEYLAIYYPNDGVLHADVELQAWWKEVREVGHADIKDASWWPKMQTVAELAKACATIIWIASALHAAVNFGQYPYAGYLPNRPSVSRKPMPVPGTEEYAELERNPEKVFVRTITSQFQALVGISLLEILSSHSSDEVYLGQRDTPEWTSDAKAQEAFKRFGARLTEIEKRAMTMNADPRLKNRNGPAKFPYTLLYPNTSDKKGDAAGITAKGIPNSISI

SEQ ID NO: 7304 - protein, 867 aa, Setaria italica
MFGGIIGGLTGNKNGRLNGSVVLMRKSVLGFDVTSMGATVIDNIGEFLGRGVTCQLISSTVVDPNNGNRGKVCAEASLEQWLTSLPSLTSSESKFGVTFEWEVEKLGVPGAIIVKNNHASEFFLKTITLDDVPGRGTIVFVANSWVYPQSKYRYSRVFFANDTYLPSQMPAALKPYRDDELRNLRGDDQQGPYQEHDRVYRYDVYNDLGLPDSGNPRPTLGGSGDLPYPRRCRTGREPTKSDPSCESRLTLVEGDIYVPRDERFGHIKKSDFYGYAIKALVNAVVPAIRTYVDLSPGEFDSFGDIIRLYEGGIKLPEIPALEELRKQFPLQLVKDVLPVGGDYLLKLPMPQIIKEDKTAWMTDEEFGREILAGVNPMLIRRLTEFPPRSTLDPSKYGDHTSTITAAHIERNLEGLTVQQALDGNRLYILDHHDNFMPFLLKFNSLNGNFIYATRTLLFLRSDGTLAPVAIELSLPELKDGLTTAKSTVYTPTSTTGAEAWVWHLAKAYANVNDYCWHQLISHWLNTHAVMEPFVIATNRQLSVAHPVHKLLLPHYRDTMNINSNARQMLVNAGGIFETTVFPRKYTFEMSSVIYKNWNFTEQALPDDLIKRGMAVADPSSRYKVRLLIEDYPYAADGLAIWHAIEQWVTEYLAIYYPNDGVLHADVELQAWWKEVREVGHADIKDASWWPKMQTVAELAKACATIIWIASALHAAVNFGQYPYAGYLPNRPSVSRKPMPVPGTEEYAELERNPEKVFVRTITSQFQALVGISLLEILSSHSSDEVYLGQRDTPEWTSDAKAQEAFKRFGARLTEIEKRAMTMNADPRLKNRNGPAKFPYTLLYPNTSDKKGDAAGITAKGIPNSISI

SEQ ID NO: 7305 - protein, 873 aa, Zea mays
MFGNIGKIPIIGDLTGSNKNAHLKGNVVLVRKTVLGLDVTSIAGSLLDGIGEFLGRGVTCQLISSTVVDPNNGNRGKLGAEASLEQWLLNPPPLLSSENQFRVTFDWEVEKQGIPGAIIVKNNHASEFFLKTITLNDVPGHGTIVFVANSWIYPQSKYRYNRVFFSNDTYLPSQMPAALKPYRDDELRNLRGDDQQGPYQEHDRVYRYDVYNDLGLPDSGNPRPVLGGTKELPYPRRCRTGRKPTKSDPNSESRLTLVDGDVYVPRDERFGHIKKSDFYGYAIKALVNAVIPAIRTYVDLSPGEFDSFKDIMKLYEGGIQLPKIPALEDLRKQFPLELVKDVLPVGGDYLLKLPMPQIIKEDKTGWMTDEEFGREILAGVNPMLVKRLTEFPPRSSLDPSKYGDHTSTIREADLENKLEGLTVQQALHGNRLYILDHHDNFMPFLVRVNSLEGNFIYATRTVLFLRGDGTLVPVAIELSLPELRDGLTTAKSTVYTPKSTTGAEAWVWHLAKAYANVNDYCWHQLISHWLNTHAVMEPFVIATNRQLSVTHPVHKLLLPHYRDTMNINSNARQMLVNAGGIFETTVFPRQYAFEMSSVIYKDWNFTEQALPDDLIKRGMAVADPSSPYKVRLLVEDYPYASDGLAIWHAIEQWVTEYLAVYYPNDGVLRADVELQAWWKEAREVGHADLKDAPWWPKMQTVAELVKACTTIIWIASALHAAVNFGQYPYAGYLPNRPSVSRKPMPAPGSDEYAELERKPEKVFVRTITSQFQALVGISLLEILSSHSSDEVYLGQRDTKEWTSDAKAQEAFKRFGARLTEIEKRVVTMNADPRLKNRNGPAEFPYTLLYPNTSDTKGDAAGITAKGIPNSISI

SEQ ID NO: 7306 - protein, 873 aa, Saccharum officinarum
MFGNIGKIPIIGDITGSNKNARLKGNVVLVRKTVLGLDVTSIAGSIIDGVGEFLGRGVTCQLISSTVVDPNNGNRGKVGAEASLEQWLLNPPPLLSGDNQFRATFDWEVEKQGIPGAIIVKNNHASEFFLKTITIDNVPGHGTIVFVANSWIYPQSKYRYNRVFFANDTYLPSQMPAALKPYRDDELRNLRGDDQQGPYQEHDRVYRYDVYNDLGLPDSGNPRPVLGGTTELPYPRRCRTGRKPTKTDPSSESRLTLVDGDVYVPRDERFGHIKKSDFYGYAIKALVNAVIPAIRTYVDLSPGEFDSFKDIMKLYEGGIQLPKIPALEDLRKQFPLELVKDVLPVGGDYLLKLPMPQIIKEDKTGWMTDEEFGREILAGVNPMIVRRLTEFPPRSSLDPSKYGDHTSTVTEAHLENKLEGLTVQQALDGNRLYILDHHDNFMPFLVRINSLEGNFIYATRTLLFLRGDGTLVPVAIELSLPELRDGLTTAKSTVYTPTSTTGAEAWVWHLAKAYANVNDYCWHQLISHWLNTHAVMEPFVIATNRQLSVTHPVHKLLLPHYRDTMNINSNARQMLVNAGGIFETTVFPRQYAFEMSAVIYKNWNFTEQALPDDLIKRGMAGADPSSPYKVRLLVEDYPYASDGLAVWHSIEQWVTEYLAIYYPNDGVLQADVELQAWWKEAREVGHADLKDAAWWPEMQTVAELVKACTTIIWIASALHAAVNFGQYPYAGYLPNRPSVSRKPMPVPGSDEYAELGKNPEKVFVRTITSQFQALVGISLLEILSSHSSDEVYLGQRDTPEWTSDAKAQEAFRRFGTRLTEIESRVMTLNADPRLKNRNGPAKFPYTLLYPNTSDKKGDAAGITAKGIPNSISI

SEQ ID NO: 7307 - protein, 868 aa, Sorghum bicolor
MIGKIIGDITGSNKHAQLKGNVVLVRKTVLGLDVTSIAGSLLDGVGEFLGRGVTCQLISSTVVDPNNGNRGKVGAEASLEKWLLNPPPLLSGENKFHVTFDWEVEKQGIPGAIIVKNNHASEFFLKTITLDDVPGHGTVVFVANSWIYPQSKYRYNRVFFSNDTYLPSQMPAALKPYRDDELRNLRGDDQQGPYKEHDRVYRYDVYNDLGLPDSGNPRPVLGGNKELPYPRRCRTGRKPTRTDPNSERRLTVVEGDVYVPRDERFGHIKKSDFYGYAIKALVNAVIPAIRTYVDLSPGEFNSFKDIIKLYEGGIQLPKIPVLEDLRKQFPLELVKDVLPVGGDYLLKLPMPQIIKEDKTGWMTDEEFGREILAGVNPMIVRRLTEFPPRSTLDPSKYGDHTSTITEAHLENKLEGLTVQQALEGNRLYILDHHDNFMPFLIRINNLEGNFIYATRTVLFLRGDGTLVPVAIELSLPELRDGLTTAKSTVYTPTSTTGAEAWVWHLAKAFANVTDYCWHQLVSHWLNTHAVMEPFIIATNRQLSVTHPVHKLLLPHYRDTMNINSNARQMLVNAGGLFETTVFPRQYAFEMSAVIYKNWNFTEQALPDDLIKRGMAVADASSPYKVKLLVEDYPYASDGLAIWHAIEQWVTEYLGIYYPNDGVLQADVELQAWWKEVREVGHADLKDEPWWPKMETVAELVKACTTIIWIASALHAAVNFGQYPYAGYIPNRPSVSRKPMPAPGSEEYAELGKNPEKVFVRTITSQFQTLVGISLLEILSSHSSDEVYLGQRDTPEWTSDAKAQEAFRRFGARLTEIESRVMTMNADPSLKNRNGPAKFPYTLLYPNTSDKNGDAAGITAKGIPNSISI

SEQ ID NO: 7308 - protein, 507 aa, Theobroma cacao
MAGREQKKSGGGGKKKEVKKETGLGLSFTKDENFGEWYSEVVVNGEMIEYYDISGCYILRPWAISIWENMQTFFDAEIKKMKVKNCYFPLFVSPGVLQKEKDHVEGFAPEVAWVTKSGESDLEVPIAIRPTSETVMYPYYSKWIRGHRDLPLKLNQWCNVVRWEFSHPTPFIRSREFLWQEGHTAFSTKEEADTEVLQILELYRRIYEEFLAIPVIKGRKSELEKFAGGLYTTSVEAFIPNTGRGIQGATSHCLGQNFAKMFEINFENEKGEKAMVWQNSWAYSTRTIGVMVMVHGDDKGLVLPPKVAAVQVIVIPVPYKDADTQGIFDACVATVATLTEAGILAEADLRDNYSPGWKYSDWEMKGVPLRIEIGPRDLANNQVRAVRRDNGAKTDISRVFLVEQVKGMLDKIQQNLFDVAKQKRDACVEVVKTWEEFVTALGQKKMILAPWCDEEDVEKDVKARTKGEMGAAKSLCTPFEQPELPEGTKCFASGKPAKKWTYWGRSY

SEQ ID NO: 7309 - protein, 429 aa, Gossypium hirsutum
MAGGEKKKSGGGGKKKEVKKETGLGLSFTKDENFGEWYSEVVVNGEMIEYYDISGCYILRPWAMSIWENIQTFFDAEIKKMKVKNCYFPLFVSPGVLQKEKDHIEGFAPEVAWVTKSGESDLEVPIAIRPTSETVMYPYYSKWIRGHRDLPLKLNQWCNVVRWEFSNPTPFIRSREFLWQEGHTAFATKEEADTEVLQILELYRHIYEEFLAIPVTKGRKSELEKFAGGLYTTSVEAFIPNTGRGIQGATSHCLGQNFAKMFEINFENEKGKSMVWQNSWAYSTRTIGVMVMVHGDNKGLVLPPKVSALQVIVIPVPYKDADTQGIFDACAATVVTLSDAGIRAEADLRENYSPGWKYLNWKMKGVPLRIEKGPRDLANNQVRAVRRDNGEKTDISRVFLVEQVKGMLDKIQQNLFDVAKQKEMPALKL

SEQ ID NO: 7310 - protein, 500 aa, Carica papaya
MAGGGGKKKEVKKETGLGLSNKKDVNFGEWYAEVCVNGEMIEYYDISGCYILRPWAMAIWDTMQTFFDAEIKKMKVKNCYFPLFVSPGVLEKEKDHIEGFAPEVAWVTKSGKSDLEVPIAIRPTSETVMYPYYSKWIRGHRDLPLKLNQWCNVVRWEFSNPTPFIRSREFLWQEGHTAFATKEEADTEVLEILELYRRIYEEFLAIPVIKGKKSEMEKFAGGLYTTSVEAFIPNTGRGVQGATSHCLGQNFAKMFEINFENEKGEKAMVWQNSWAYSTRTIGVMVMVHGDDKGLVLPPKVASVQVVVVPVPYKDADTQGIFDACAATVATLDEAGIRAEADFRDNYSPGWKYSHWEMKGVPLRIEIGPKDLANNQVRAVRRDNGAKTDIPRGNLVEQIEEMLGKIQQSLFESAKQKRDTCVQIAKTWDEFVEALGQKKLILAPWCDEEEVEKDVKTRTKGEMGAAKTLCSPFDQPELPEGTKCFASGKPARKWTYWGRSY

SEQ ID NO: 7311 - protein, 509 aa, Castanea mollissima
MAGGDAKKSNASGGGKKKEVKKETGLGLANRKDENFGEWYSEVVVNGEMIEYYDISGCYILRPWAMAIWEIMQKFFDAEIKKMDIQNCYFPLFVSPGVLQKEKDHVEGFAPEVAWVTKSGESELEVPIAIRPTSETVMYPYYSKWIRGHRDLPLKLNQWCNVVRWEFSHPTPFIRSREFLWQEGHTAFATKAEADAEVLDILELYRRIYEEYLAIPVVKGKKSEMEKFAGGLYTTSVEAFVPNTGRGIQGATSHCLGQNFAKMFEINFENEKGEKGMVWQNSWAYSTRTIGVMVMVHGDDRGLVLPPKVASVQVIVIPVPYKDADTQAIFDACSATVASLSEAGIRAKADSRDNYSPGWKYSHWEMKGVPLRIEIGPKDLANSQVRAVRRDNSAKTDIPRDKLVEQVKEMLDNIQQSLFDAAKQKRDACIQTVKTWDEFVEALGQRKMILAPWCDEEEVEKEVKARTKGEMGACKSLCSPFDQPELLEGTKCFASGKPAKKWTYWGRSY

SEQ ID NO: 7312 - protein, 509 aa, Castanea mollissima
MAGGDAKKSNASGGGKKKEVKKETGLGLANRKDENFGEWYSEVVVNGEMIEYYDISGCYILRPWAMAIWEIMQKFFDAEIKKMDIQNCYFPLFVSPGVLQKEKDHVEGFAPEVAWVTKSGESELEVPIAIRPTSETVMYPYYSKWIRGHRDLPLKLNQWCNVVRWEFSHPTPFIRSREFLWQEGHTAFATKAEADAEVLDILELYRRIYEEYLAIPVVKGKKSEMEKFAGGLYTTSVEAFVPNTGRGIQGATSHCLGQNFAKMFEINFENEKGEKGMVWQNSWAYSTRTIGVMVMVHGDDRGLVLPPKVASVQVIVIPVPYKDADTQAIFDACSATVASLSEAGIRAKADSRDNYSPGWKYSHWEMKGVPLRIEIGPKDLANSQVRAVRRDNSAKTDIPRDKLVEQVKEMLDNIQQSLFDAAKQKRDACIQTVKTWDEFVEALGQRKMILAPWCDEEEVEIEVKARTKGEMGACKSLCSPFDQPELLEGTKCFASGKPAKKWTYWGRSY

SEQ ID NO: 7313 - protein, 511 aa, Citrullus lanatus
MAGPKPGSSTTNPKAGGKKKEVKKETGLGLTNKKDDNFGEWYSEVVVSGEMIEYYDISGCYILRPWAISVWETMQVFFDAEIKKMKIKNCYFPLFVSPGVLQREKDHIEGFAPEVAWVTKSGESDLEVPIAIRPTSETVMYPYYSKWIRGHRDLPLKLNQWCNVVRWEFSHPTPFIRSREFLWQEGHTAFATKDEADTEVLEILELYRRIYEEYLAIPVIKGKKSEMEKFAGGLYTTSVEAFIPNTGRGIQGATSHCLGQNFAKMFEINFENEKGEKAMVWQNSWAYSTRTIGVMVMVHGDDKGLVLPPKVASVQVIIVPVPYKDADTQGIFDACSATLDTLSKAGIRAEVDLRDNYSPGWKYSHWEMKGVPLRIEIGPKDLANNQVRAVRRDNSGKKDIPRASLVEQVKELLESIQQSLFDAAKEKRDACIQVINTWEEFTEALGQKKMILAPWCDEEEVEKDVKTRTKGEMGAAKTLCSPFEQPALPEGTKCFASGKPAKKWSYWGRSY

SEQ ID NO: 7314 - protein, 434 aa, Euonymus alatus
MAGDDVKKPKAKASGGGKKKEVKKETGLGLSFKKEENFGEWYSEVVVNAEMIEYYDISGCYILRPWTMSIWEIMQAFFDAEIKKMKIKNCYFPLFVSPGVLEKEKDHIEGFAPEVAWVTKSGKSILEKPIAIRPTSETVMYPYYSKWIRGHRDLPLKLNQWCNVVRWEFSNPTPFIRSREFLWQEGHTAFATKEEADTEVLEILELYRRIYEEFLAVPVIKGKKSEMEKFAGGLYTTSVEAFIPNTGRGIQGATSHCLGQNFAKMFEINFENEKGERAMVWQNSWAYSTRTIGVMVMVHGDDKGLVLPPKVASVQVIVIPVPYKDADTKGIYDACAATVEVLCEAGIRAEIDSRDNYSPGWKYSHWEMKGVPLRIEIGPKDLANNQVRAVRRDNGAKLDLSRDSLVDQVKTMLDNIHESLLDAAKTKSGMRVSK

SEQ ID NO: 7315 - protein, 503 aa, Nicotiana benthamiana
MAGKDSNRGKKKEVKKETGLGLSSKKDENFGEWYSEVVVSGEMIEYYDISGCYILRPWAMSIWEILHTFFDAEIKKMKIKNSYFPLFVSPGVLQKEKDHIEGFAPEVAWVTKSGESDLEVPIAIRPTSETVMYPYFSKWIRGHRDLPLRLNQWCNVVRWEFSNPTPFIRSREFLWQEGHTAFATKEEADAEVLDILELYRRIYEEFLAVPVSKGKKSELEKFAGGLYTTTVEAFIPNTGRGIQGATSHCLGQNFAKMFEINFENEKGEKAMVWQNSWAYTTRTIGVMIMVHGDDKGLVLPPKVAATQVIVIPVPYKDANTQGIFDACAATVKNLNESGIRAEADYRDNYSPGWKYSHWEMKGVPLRIEIGPKDLANNQVRAVRRDNGAKADIPVANIAEQVKNVLASIQQNLFDVAKQKRDACVQVVKTWDEFAEALSQKKLILAPWCDEEDVEKDVKARTKGEMGAAKTLCSPFDQPELPEGTLCFASGKPAKKWTYWGRSY

SEQ ID NO: 7316 - protein, 509 aa, Quercus alba
MAGGDAKKSNASGGGKKKEVKKETGLGLANRKDENFGEWYSEVVVNGEMIEYYDISGCYILRPWAMAIWEIMQKFFDAEIKKMDIQNCYFPLFVSPGVLQKEKDHVEGFAPEVAWVTKSGESELEVPIAIRPTSETVMYPYYSKWIRGHRDLPLKLNQWCNVVRWEFSHPTPFIRSREFLWQEGHTAFATKAEADAEVLDILELYRRIYEEYLAIPVIKGKKSEMEKFAGGLYTTSVEAFVPNTGRGIQGATSHCLGQNFAKMFEINFENERGEKGMVWQNSWAYSTRTIGVMVMVHGDDRGLVLPPKVASVQVIVIPVPYKDADTRAIFDACSATVASLSEAGIRAKADPRDNYSPGWKYSHWEMKGVPLRIEIGPKDLANSQVRAVRRDNSTKTDIPRDKLVEQVKEMLDDIQQSLFVAAKQKRDACIQTVKTWDEFVEALSQRKMILAPWCDEEEVEIEVKARTKGEMGACKSLCSPFDQPELLEGTKCFASGKPAKKWTYWGRSY

SEQ ID NO: 7317 - protein, 515 aa, Solanum phureja
MAGKDADKGKKKEGKKEVVHGKKKEVKKETGLGLSYKKDENFGEWYSEVVVSGEMIEYYDISGCYILRPWAMSIWEILQTFFDAEIKKMKIKNSYFPLFVSPAVLQKEKDHIEGFAPEVAWVTKSGDSDLEVPIAIRPTSETVMYPYFSKWIRGHRDLPLRLNQWCNVVRWEFSNPTPFIRSREFLWQEGHTAFATKEEADEEVLDILELYRRIYEEFLAVPVSKGKKSELEKFAGGLYTTTVEAFIPNTGRGIQGATSHCLGQNFAKMFEINFENEKGEKAMVWQNSWAYTTRTIGVMIMTHGDDKGLVLPPKVATTQVVVIPVPYKDANTQGIYDACAATVKSLNESGIRAEADFRDNYSPGWKYSHWEMKGVPLRIEIGPKDLANNQVRAVRRDNGAKTDIPVANLVEQVKDVLDSIQQNLFETAKQKREACVQVVKTWDEFAEALGQKKLILAPWCDEEDVEKEVKTRTKGEMGAAKTLCSPFDQPELPEGTLCFASGKPAKKWTYWGRSY

SEQ ID NO: 7318 - protein, 515 aa, Solanum lycopersicum
MAGKDADKGKKKEGKKEVVHGKKKEVKKETGLGLSYKKDENFGEWYSEVVVSGEMIEYYDISGCYILRPWAMSIWEILQTFFDAEIKKMKIKNSYFPLFVSPAVLQKEKDHIEGFAPEVAWVTKSGDSDLEVPIAIRPTSETVMYPYFSKWIRGHRDLPLRLNQWCNVVRWEFSNPTPFIRSREFLWQEGHTAFATKEEADEEVLDILELYRRIYEEFLAVPVSKGKKSELEKFAGGLYTTTVEAFIPNTGRGIQGATSHCLGQNFAKMFEINFENEKGEKAMVWQNSWAYTTRTIGVMIMTHGDDKGLVLPPKVATTQVVVIPVPYKDANTQGIYDACAATVKSLNESGIRAEADFRDNYSPGWKYSHWEMKGVPLRIEIGPKDLANNQVRAVRRDNGAKTDIPVANLVEQVKDVLDSIQQNLFETAKQKREACVQVVKTWEEFAEALGQKKLILAPWCDEEDVEKEVKARTKGEMGAAKTLCSPFDQPELPEGTLCFASGKPAKKWTYWGRSY

SEQ ID NO: 7319 - protein, 501 aa, Euphorbia peplus
MAGGGKGKKKEVKKETGLGLSFKKDENFGEWYSEVVVHGEMIEYYDISGCYILRPWSMSIWEVMQAFFDAEIKKMKVKNCYFPVFVSSTVLEKEKDHIEGFAPEVAWVTKSGKSDLEVPIAIRPTSETVMYPYYSKWIRGHRDLPLKLNQWCNVVRWEFSNPTPFIRSREFLWQEGHTAFATKEEADDEVLEILELYRRIYEEFLAIPVFKGRKSEMEKFAGGLYTTSVEAFIPNTGRGVQGATSHCLGQNFAKMFEINFENEKGEKGMVWQNSWAYSTRTIGVMVMVHGDDKGLVLPPTVASTQVIIVPVPYKDADMQGIYDACSATVDALSKAGIRAEADLRENYSPGWKYSHWELKGVPLRIEIGPKDLANNQVRAVRRDNATKKDLSRDNLVELVKGTLDDIQKSMFDAAKQKRDACIQTAKTWDEFKEALNQRKMILAPWCDEEEVEKDVKERTKGEMGAAKSLCTPFDQPELPEGTLCFASGKPAKKWTYWGRSY

SEQ ID NO: 7320 - protein, 501 aa, Ricinus communis
MASGGKGKKKEVKKETGLGLSFKKEEQFGEWYSDVVVSGEMIEYYDISGCYILRPWAMSIWEVMQTFFDAEIKKMKIKNCYFPLFVSSSVLEKEKDHIEGFAPEVAWVTKSGKSDLEIPIAIRPTSETVMYPYYSKWIRGHRDLPLKLNQWCNVVRWEFSNPTPFIRSREFLWQEGHTAFATKEEADEEVLQILELYRCIYEEFLAVPVVKGKKSEREKFAGGLYTTSVEAFIPNTGRGIQGATSHCLGQNFAKMFEINFENEKGEKGMVWQNSWAYSTRTIGVMVMVHGDDKGLVLPPKVASVQVIVIPVPYKDADTQGIFDACTETVDALCKVGIRAESDFRDNYSPGWKYSHWEVKGVPLRIEIGPKDLANNQVRTVRRDNATKKDISRVNLVEQVKEILDAIQQSLFDAAKQKRDACIQVVRTWDEFTEALSQRKMILAPWCDEEEVEEDVKQRTKGEMGAAKSLCTPFEQPELPEGTLCFASGKPARKWTYWGRSY

SEQ ID NO: 7321 - protein, 510 aa, Panax ginseng
MASNEAKKKPNAKSGGKKKEVKKETGLGLSYKKDENFGEWYSEVVVSGEMIEYYDISGCYILRPWTMSIWETMQDFFDKEIKKMKIKNCYFPLFVSPGVLQREKDHIEGFAPEVAWVTKSGESDLEVPIAIRPTSETVMYPYYSKWIRGHRDLPLKLNQWCNVVRWEFSHPTPFIRSREFLWQEGHTAFATKDEADAEVLDILELYRRIYEEYLAIPVVKGKKSEMEKFAGGLYTTSVEAFIPNTGRGIQGATSHCLGQNFAKMFEINFEDEKGEKGMVWQNSWAYSTRTIGVMVMVHGDDKGLVMPPKVASVQVIVIPVPYKDADTKAILDACSNAVNTLSEAGLRVEADLRENYSPGWKYSHWEMKGVPLRIEIGPKDLANNQVRAVRRDNFKKVDIPMVKLVEQVKDMLDDIQRNLFDLAKEKRDACIEKAKTWDEFVEALGKKKMILAPWCDEEEVEKDVKTRTKGEMGAAKTLCSPFDQPDLPSGTLCFASGKPAKKWTYWGRSY

SEQ ID NO: 7322 - protein, 510 aa, Panax ginseng
MASNEAKKKPNAKSGGKKKEVKKETGLGLSYKKDENFGEWYSEVVVSGEMIEYYDISGCYILRPWTMSIWETMQDFFDKEIKKMKIKNCYFPLFVSPGVLQREKDHIEGFAPEVAWVTKSGESDLEVPIAIRPTSETVMYPYYSKWIRGHRDLPLKLNQWCNVVRWEFSHPTPFIRSREFLWQEGHTAFATKDEADAEVLDILELYRRIYEEYLAIPVVKGKKSEMEKFAGGLYTTSVEAFIPNTGRGIQGATSHCLGQNFAKMFEINFEDDKGEKGMVWQNSWAYSTRTIGVMVMVHGDDKGLVLPPKVASVHVIVIPVPYKDADTKAILDACSNAVNTLSEAGLRVEADLRENYSPGWKYSHWEMKGVPLRIEIGPKDLANNQVRAVRRDNFKKVDIPMVKLVEQVKDMLDDIQQNLFDLAKEKRDACIEKAKTWDEFVEALGKKKMILAPWCDEEEVEKDVKTRTKGEMGAAKTLCSPFDQPDLPSGTLCFASGKPAKKWTYWGRSY

SEQ ID NO: 7323 - protein, 519 aa, Amsonia hubrichtii
MAGKDAKGSAAGSNTSKNTSKNTKGKKKEVKKETGLGLTQKKDENFGEWYSEVVVSGEMIEYYDISGCYILRPWAMSIWEIMQAFFDAEIKKMNIKNCYFPLFVSPGVLQKEKDHIEGFAPEVAWVTKSGESDLEVPIAIRPTSETVMYPYYSKWIRGHRDLPLRLNQWCNVVRWEFSHPTPFIRSREFLWQEGHTAFATKEEADQEVLEILELYRRIYEEFLAVPVTKGKKSELEKFAGGLYTTTVEAFIPNTGRGIQGATSHCLGQNFAKMFEINFEDEKGEKRMVWQNSWAYTTRTIGVMIMVHGDDKGLVLPPKVAAIQIVVIPVPYKDADTQGILDACAATVKTLNESGFRAEADLRDNYSPGWKYSNWEMKGVPLRIEIGPRDLANKQVRAVRRDNSAKIDIPMDNLVDQVRNLLDNIQQSLFDVAKQKKEACIQVVKTWEEFVEALGEKKLILAPWCDEEEVEKDVKARTKGEMGAAKTLCSPFEQPELPEGTLCFASGKPAKKWTYWGRSY

SEQ ID NO: 7324 - protein, 293 aa, Fagopyrum esculentum
MASKGQGKGNAGAKAGGKKKEVKKETGLGLTYKKDDNFGEWYSEVVVNAEMIEYYDISGCYILRPWTMSIWEIMQTFFDAEIKKMKIKNCYFPLFVSPGVLEKEKDHIEGFAPEVAWVTKSGESDLEVPIAIRPTSETVMYPYYSKWIRGHRDLPLRLNQWCNVVRWEFSNPTPFIRSREFLWQEGHTAFATQEEADAEVLDILELYRQIYEEYLAVPVVKGKKSELEKFAGGYYTTSVEAFIPNTGRGIQGATSHCLGQNFAKMFEITLRMKNERRKWYGRIHGHTVLEQLG

SEQ ID NO: 7325 - protein, 513 aa, Brassica rapa
MAGPSGKKEKVDKAGPSGGKKKKDVKKETGLGLSVKKDENFGEWYSEVCKHEMIEYYDISGCYILRPWSMAIWEIMQTFFDAEIKKMKVKNCYFPLFVSPGVLEKEKDHIEGFAPEVAWVTKSGKSDLEVPIAIRPTSETVMYPYYSKWIRGHRDLPLKLNQWCNVVRWEFSNPTPFIRSREFLWQEGHTAFATKEEADKEVLEILELYRRIYEEYLAVPVVKGMKSENEKFAGGLYTTSVEAFIPNTGRGVQGATSHCLGQNFAKMFEINFENEKGETEMVWQNSWAYSTRTIGVMIMTHGDDKGLILPPKVASVQVVVIPVPYKDANTQGIFDACTATVAALSEAGIRAEEDLRDNYSPGWKYSNWEMKGVPLRIEIGPRDLENNQVRTVRRDNGVKEDIPRGSLVEHVKELLEKIQANMYEVAKQKREACVEEIKTWDEFIVALNKKKLILAPWCDEEEVERDVKARTKGETGAAKTLCSPFEQPELPEGTLCFASGKPAKKWTYWGRSY

SEQ ID NO: 7326 - protein, 511 aa, Eucalyptus grandis
MAGGESKKPKANAGAGGKKKEVKKETGLGLSNKKDENFGEWYSEVVVSGEMIEYYDISGCYILRPWAMAIWEIMQEFFDAEIKKMKIKNCYFPLFVSPGVLQREKDHIEGFAPEVAWVTKSGESDLEVPIAIRPTSETVMYPYYSKWIRGHRDLPLRLNQWCNVVRWEFSHPTPFIRSREFLWQEGHTAFATKEEADAEVLDILELYRRIYEEYLAVPVIKGKKSELEKFAGGYYTTTVEAFIPDTGRGIQGATSHCLGQNFAKMFEINFENEKGEKAMVWQNSWAYTTRTIGVMIMVHGDDKGLVLPPKVSSVQVIVVPVPYKDADTQGIFDACTATANTLCEAGIRAEVDLRDNYSPGWKYSHWEMKGVPLRIEIGPKDFAKNQVRAVRRDNSTKSDIPQASLVEQVEKILDDIQQSLFDAAKQKREACIQIVKTWDEFIDALGKKKMILAPWCDEEEVEKDVKARTKGEMGAVKTLCSPFDQPELPEGTMCFASGKPAKKWSYWGRSY

SEQ ID NO: 7327 - protein, 515 aa, Glycine max
MAGTEAKKTESKKPAAKQSGAKKKEVKKETGLGLTHRKAENFGEWYSEVVVNAEMIEYYDISGCYILRPWSMAIWEIMQEFFDPEIKKMKIKNCYFPLFVSPGVLQKEKDHVEGFAPEVAWVTKSGESELEIPIAIRPTSETVMYPYYSKWIRGHRDLPLKLNQWCNVVRWEFSNPTPFIRSREFLWQEGHTAFATKDEADAEVLEILELYRRIYEEYLAVPVIKGKKSELEKFAGGLYTTSVEAFIPNTGRGIQGATSHCLGQNFAKMFEINFENEKGEKAMVWQNSWAYSTRTIGVMVMVHGDDKGLVLPPKVASVQVIVIPVPYKDADTQGIFDACSATVNTLNEAGIRAESDSRDNYSPGWKYSNWEMKGVPLRIEIGPKDLANKQVRAVRRDNGAKIDIASADLVVEIKKLLDTIQQNLFDVAKQKRDECIQIIHTWDEFVQALNQRKMILAPWCDEEEVEADVKARTKGEMGAAKTLCSPFDQPELPEGTKCFASGKPATKWTYWGRSY

SEQ ID NO: 7328 - protein, 516 aa, Brassica napus
MAGPSGKKEKVDKAGPSGGGGGKKKKDVKKETGLGLSVKKDENFGEWYSEVCKHEMIEYYDISGCYILRPWSMAIWEIMQTFFDAEIKKMKVKNCYFPLFVSPGVLEKEKDHIEGFAPEVAWVTKSGKSDLEVPIAIRPTSETVMYPYYSKWIRGHRDLPLKLNQWCNVVRWEFSNPTPFIRSREFLWQEGHTAFATKEEADKEVLEILELYRRIYEEYLAVPVVKGMKSENEKFAGGLYTTSVEAFIPNTGRGVQGATSHCLGQNFAKMFEINFENEKGETEMVWQNSWAYSTRTIGVMIMTHGDDKGLILPPKVASVQVVVIPVPYKDANTQGIFDACTATVAALSEAGIRAEEDLRDNYSPGWKYSNWEMKGVPLRIEIGPRDLENNQVRTVRRDNGVKEDIPRGSLVEHVKELLEKIQANMYEVAKQKREACVEEIKTWDEFIVALNKKKLILAPWCDEEEVERDVKARTKGETGAAKTLCSPFEQPELPEGTLCFASGKPAKKWTYWGRSY

SEQ ID NO: 7329 - protein, 372 aa, Tropaeolum majus
MYPYYSKWIRGHRDLPLKLNQWCNVVRWEFSNPTPFIRSREFLWQEGHTAFATKEEADAEVLDVLELYRRIYEEFLAIPVFKGKKSEMEKFAGGLYTTSVEAFIPHTGRGIQGATSHCLGQNFAKMFEINFENEKGEKAMVWQNSWAYSTRTIGVMIMVHGDDKGLVLPPKVASLQVIVIPVPFKDANTQGIFDACAATVATLSEAGIRAESDLRDNYSPGWKYSHWEMKGVPLRIEIGPKDLANNQVRIVRRDNGAKSDIAQANLVEQVKEVLDKIQQSMFDAAVEKRDACILVAKTWDEFMEGLAQKKMILAPWCDEEEVEKDVKARTKGDVGAAKTLCSPFDQPELPEGTLCFASGKPAKKWTYWGRSY

SEQ ID NO: 7330 - protein, 511 aa, Eucalyptus grandis
MASGEPKKSNKPNAGAGKKKEVKKETGLGLSNKKDENFGEWYSEVVVSGEMIEYYDISGCYILRPWAMAIWEIMQEFFDAEIKKMKIKNCYFPLFVSPGVLQREKEHIEGFAPEVAWVTKSGQSDLEVPIAIRPTSETVMYPYFSKWIRGHRDLPLRLNQWCNVVRWEFSNPTPFIRSREFLWQEGHTAFATKEEADAEVLDILELYRRIYEEYLAVPVIKGKKSELEKFAGGFYTTTVEAFVPNTGRGIQGATSHCLGQNFAKMFEIFFENEKREKAMVWQNSWAYTTRTIGVMVMVHGDDKGLVLPPKVASVQVIIVPVPYKDANTQGIFDACTATVNTLCEAGIRAEADLRDNYSPGWKYSHWEMKGVPLRIEIGPKDLANNQVRAVRRDNSAKKDIPRADLVEQVKELLANIQQSLFDAAKQKRDACIQVVKTWDEFVEALGQKKMVLAPWCDEEEVEKEVKARTKGEMGACKTLCSPFEEPELPEGTICFASGKPAKRWSYWGRSY

SEQ ID NO: 7331 - protein, 496 aa, Nicotiana benthamiana
EGKKKEVKKETGLGLSYKKDENFGEWYSEVVVSGEMIEYYDISGCYILRPWAMSIWEILQAFFDAEIKKMKIKNSYFPLFVSPGVLQKEKDHIEGFAPEVAWVTKSGESDLEVPIAIRPTSETVMYPYFSKWIRGHRDLPLRLNQWCNVVRWEFSNPTPFIRSREFLWQEGHTAFATKEEADTEVLDILELYRRIYEEFLAVPVSKGKKSELEKFAGGLYTTTVEAFIPNTGRGIQGATSHCLGQNFAKMFEINFENEKGEKAMVWQNSWAYTTRTIGVMIMVHGDDKGLVLPPKVASIQVIVIPVPYKDANTQGIFDACAATVEKLNESGIRAEADFRDNYSPGWKYSHWEMKGVPLRIEIGPKDLANNQVRAVRRDNGAKADIPMDNLAEQLEVLLATIQQNLFDVAKQKRDACVQIVRTWDEFTVALGQKKLVLAPWCDEEDVEKDVKARTKGEMGAAKTLCSPFDQPELPEGTLCFASGKPAKKWTYWGRSY

SEQ ID NO: 7332 - protein, 515 aa, Quercus alba
MAGGDAKKSNASGGGKKKEVKKETGLGLANRKDENFGEWYSEVVVNGEMIEYYDISGCYILRPWAMAIWEIMQKFFDAEIKKMDIQNCYFPLFVSPGVLQKEKDHVEGFAPEVAWVTKSGESELEVPIAIRPTSETVMYPYYSKWIRGHRDLPLKLNQWCNVVRWEFSHPTPFIRSREFLWQEGHTAFATKAEADAEVLDILELYRRIYEEYLAIPVVKGKKSEMEKFAGGLYTTSVEAFVPNTGRGIQGATSHCLGQNFAKMFEINFENEKGEKGMVWQNSWAYSTRTIGVMVMVHGDDRGLVLPPKVASVQVIVIPVPYKDADTQAIFDACSATVASLSEAGIRAKADSRDNYSPGWKYSHWEMKGVPLRIEIGPKDLANSQVRAVRRDNSAKTDIPRDKLVEQVKEMLDNIQQSLFDAAKQKRDACIQTVKTWDEFVEALGQRKMILAPWCDEEEVEIEVKARTKGEMGACKSLCSPFDQPELLEGTKCFASGKPAKRWTYWGRVTRLLIFT

SEQ ID NO: 7333 - protein, 510 aa, Cajanus cajan
MAGSEAKKPVAKQSGGKKKEVKKETGLGLTHRKAENFGEWYSEVVVNAEMIEYYDISGCYILRPWSMAIWEIMQEFFDPEIKKMKIKNCYFPLFVSPGVLQKEKDHVEGFAPEVAWVTKSGESELEIPIAIRPTSETVMYPYYSKWIRGHRDLPLKLNQWCNVVRWEFSNPTPFIRSREFLWQEGHTAFATKEEADAEVLDILELYRRIYEEYLAVPVIKGKKSEMEKFAGGLYTTSVEAFIPNTGRGIQGATSHCLGQNFAKMFEINFENDKGEKAMVWQNSWAYSTRTIGVMVMVHGDDKGLVLPPKVASVQVIVIPVPYKDADTQGIFDAVSATVNTLSEAGIRADSDFRDNYSPGWKYSHWEMKGVPLRIEIGPKDLANKQVRAVRRDNGAKIDIASAELVVEIKKLLGDIQQNLFDVAKQKRDECIQVIHTWDEFVQALNQRKMILAPWCDEEEVEADVKARTKGEMGAAKTLCSPFDQPELLEGTKCFASGKPATKWTYWGRSY

SEQ ID NO: 7334 - protein, 515 aa, Glycine max
MAGTEAKKTESKKPAAKQSGGKKKEVKKETGLGLTHRKAENFGEWYSEVVVNAEMIEYYDISGCYILRPWSMAIWEIMQEFFDPEIKKMKIKNCYFPLFVSPGVLQKEKDHVEGFAPEVAWVTKSGESELEIPIAIRPTSETVMYPYYSKWIRGHRDLPLKLNQWCNVVRWEFSNPTPFIRSREFLWQEGHTAFASKEEADAEVLEILELYRRIYEEYLAVPVIKGKKSELEKFAGGLYTTSVEAFIPNTGRGIQGATSHCLGQNFAKMFEINFENEKGERAMVWQNSWAYSTRTIGVMVMVHGDDKGLVLPPKVASVQVIVIPVPYKDADTQGIFDACSATVNTLNEAGIRAESDSRDNYSPGWKYSNWEMKGVPLRIEIGPKDLANKQVRAVRRDNGAKIDIASADLVVEIKKLLDTIQQNLFDVAKQKRDECIQIIHTWDEFVQALNQRKMIFAPWCDEEEVEADVKARTKGEMGAAKTLCSPFDQPELPEGTKCFASGKPATKWTYWGRSY

SEQ ID NO: 7335 - protein, 357 aa, Manihot esculenta
MLFVGNLAILLHLSGAESSFGRKGILHLQQRQKQMRRHETNYLIPVLQILELYRRIYEEFLAIPVVKGRKSEMEKFAGGLYTTSVEAFIPNTGRGIQGATSHCLGQNFAKMFEINFENEKGEKGMVWQNSWAYSTRTIGVMVMVHGDDKGLVLPPKVASVQVIVVPVPYKDANTQGIFDACTETVDTLCKAGIRAEADFRDNYSPGWKYSHWEMKGVPLRIEIGPKDLANNQVRAVRRDNAAKEDISRVNLVEQVKRILDDIHQSLFDAAKQKRDACIQVVKTWDEFKEALSQRKMILAPWCDEEEVEQDVKERTRGEMGAAKSLCTPFDQPELPEGTKCFASGKPAKKWTYWGRSY

SEQ ID NO: 7336 - protein, 372 aa, Euonymus alatus
MYPYYSKWIRGHRDLPLKLNQWCNVVRWEFSNPTPFIRSREFLWQEGHTAFATKEEADTEVLEILELYRRIYEEFLAVPVIKGKKSEMEKFAGGLYTTSVEAFIPNTGRGIQGATSHCLGQNFAKMFEINFENEKGERAMVWQNSWAYSTRTIGVMVMVHGDDKGLVLPPKVASVQVIVIPVPYKDADTKGIYDACAATVEILCEAGIRAEIDSRDNYSPGWKYSHWEMKGVPLRIEIGPKDLANNQVRAVRRDNGAKLDLSRDSLVDQVKTMLDNIHESLLDAAKQKRDACVQVVKTWDEFMEALSQRKLILAPWCDEEEVEQDVKTQTKGEKGAAKTLCSPFDQPELPEGTKCFASGKPAKKWSYWGRSY

SEQ ID NO: 7337 - protein, 510 aa, Vigna unguiculata
MAGTEAKKPSAKQSGGKKKEVKKETGLGLTHRKAENFGEWYSEVVVNAEMIEYYDISGCYILRPWSMAIWEIMQEFFDPEIKKMKIKNCYFPLFVSPGVLQKEKDHVEGFAPEVAWVTKSGESELEIPIAIRPTSETVMYPYYSKWIRGHRDLPLKLNQWCNVVRWEFSNPTPFIRSREFLWQEGHTAFATKEEADAEVLDILELYRRIYEEYLAVPVIKGKKSELEKFAGGLYTTSVEAFIPNTGRGIQGATSHCLGQNFAKMFEINFENEKGEKAMVWQNSWAYSTRTIGVMVMVHGDDKGLVLPPKVASVQVIVIPVPYKDANTQGIFDACSETVNTLSEAGIRAESDFRDNYSPGWKYSHWEMKGVPLRIEIGPKDLANKQVRAVRRDNGAKIDIASADLAVEIKKLLDNIQQNLFEVAKQKRDECIQIIHTWDDFVQALNQRKMILAPWCDEEEVEADVKARTKGEMGAAKTLCSPFDQPELPEGTKCFASGKPATKWTYWGRSY

SEQ ID NO: 7338 - protein, 518 aa, Nicotiana benthamiana
MHLFCLSSKGKKKEVKKEIGLGQGKKKEVKKETGLGLSYKKDDNFGEWYSEVVVSGEMIEYYDISGCYILRPWAMSIWEILQAFFDAEIKKMKIKNSYFPLFVSPGVLQKEKDHIEGFAPEVAWVTKSGESDLEVPIAIRPTSETVMYPYFSKWIRGHRDLPLRLNQWCNVVRWEFSNPTPFIRSREFLWQEGHTAFATKEEADTEVLDILELYRRIYEEFLAVPVSKGKKSELEKFAGGLYTTTVEAFIPNTGRGIQGATSHCLGQNFAKMFEINFENEKGEKAMVWQNSWAYTTRTIGVMIMVHGDDKGLVLPPKVASTQVIVIPVPYKDANTQGIFDACAATVEKLNESGVRAEADFRDNYSPGWKYSHWEMKGVPLRIEIGPKDLANNQVRAVRRDNGAKTDIPMDNLVEQLKDLLATIQENLFDVAKQKRDACVQIVRTWDEFTVALGQKKLVLAPWCDEEDVEKDVKARTKGEMGAAKTLCSPFDQPELPEGTLCFASGKPAKKWTYWGRSY

SEQ ID NO: 7339 - protein, 505 aa, Lippia dulcis
SESEKETVAHGKKKEVKKETGLGLSYKKDENFGEWYSEVVVNGEMIEYYDISGCYILRPWAMSIWEIMQTFFDAEIKKMKIKNCYFPLFVSSGVLQKEKDHIEGFAPEVAWVTKSGESELEMPIAIRPTSETVMYPYFSKWIRGHRDLPLRLNQWCNVVRWEFSNPTPFIRSREFLWQEGHTAFATKEEADTEVLDILELYRRIYEEFLAVPVFKGKKSEHEKFAGGLYTTTVEAFVPNTGRGVQGATSHCLGQNFAKMFEINFENEKGEKAMVWQNSWAYTTRTIGVMIMVHGDDKGLVLPPKVASVQVIVIPVPYKDANTQGIFDACAATVKSLNEAGIRAEADFRDNYSPGWKYSHWELKGVPLRIEIGPKDLANNQVRAVRRDNAAKIDIPMADLVEKVNDMLNNIQQSLLDVAKQKRDACIQVVHTWEEFTEALGQKKMILAPWCDEEEVEKDVKTRTKGEMGAAKSLCSPFDQPALPEGTLCFASGKPAKKWTYWGRSY

SEQ ID NO: 7340 - protein, 491 aa, Tripterygium wilfordii
EVKKETGLGLSFKKEENFGEWYSEVVVNAEMIEYYDISGCYILRPWTMSIWEIMQAFFDSEIKKMKIKNCYFPLFVSPGVLEKEKDHIEGFAPEVAWVTKSGKSDLEVPIAIRPTSETVMYPYYSKWIRGHRDLPLKLNQWCNVVRWEFSNPTPFIRSREFLWQEGHTAFATKEEADTEVLEILELYRRIYEEFLAVPVIKGKKSEMEKFAGGLYTTSVEAFIPNTGRGIQGATSHCLGQNFAKMFEINFENEKGEKSMVWQNSWAYSTRTIGVMVMVHGDDKGLVLPPKVASVQVIVIPVPYKDADTKGIFDACAATAETLCEAGIRAETDFRDNYSPGWKYSHWEMKGVPLRIEIGPKDLANNQVRAVRRDSGAKLDISRDSLVDQVKTMLDNIHQSLFDAATQKRDACVQVVKTWDEFKEALSQRKLILAPWCDEEEVEQDVKARTKGEIGAAKTLCSPFDQPELPEGTKCFASGKPAKKWTYWGRSY

SEQ ID NO: 7341 - protein, 515 aa, Brassica napus
  Sequence also found in Organisms: Brassica oleracea
MAGPSGKKEKVDKAGPSGGGGKKKKDVKKETGLGLSVKKDENFGEWYSEVCKHEMIEYYDISGCYILRPWSMAIWEIMHTFFDAEIKKMKVKNCYFPLFVSPGVLEKEKDHIEGFAPEVAWVTKSGKSDLEVPIAIRPTSETVMYPYYSKWIRGHRDLPLKLNQWCNVVRWEFSNPTPFIRSREFLWQEGHTAFATKEEADKEVLEILELYRRIYEEYLAVPVVKGMKSENEKFAGGLYTTSVEAFIPNTGRGVQGATSHCLGQNFAKMFEINFENEKGETEMVWQNSWAYSTRTIGVMIMTHGDDKGLILPPKVASVQVVVIPVPYKDANTQGIFDACTATVAALSEAGIRAEEDLRDNYSPGWKYSNWEMKGVPLRIEIGPRDLENDQVRTVRRDNGVKEDIPRGSLVEHVKELLEKIQANMYEVAKQKREACVEEIKTWDEFIVALNKKKLILAPWCDEEEVERDVKARTKGETGAAKTLCSPFEQPELPEGTLCFASGKPAKKWTYWGRSY

SEQ ID NO: 7342 - protein, 517 aa, Citrus clementina
MAGGQEKKPIAKAKPKADAGGGGKKKELKKETGLGLSYKKDDNFGEWYSEVVVNGEMIEYYDISGCYIMRPWAISIWETMQKFFDAEIKKMKIQNCYFPLFVSPTVLQKEKDHIEGFAPEVAWVTKSGESDLEVPIAIRPTSETVMYPYFSKWIRGHRDLPLKLNQWCNVVRWEFSNPTPFIRSREFLWQEGHTAFATKSEADDEVLQILELYRRIYEEFLAVPVIKGKKSELEKFAGGLYTTTVEAFIPNTGRGIQGATSHCLGQNFSKMFEIIFENEKGEKAMAWQNSWAYTTRTIGVMVMVHGDDKGLMLPPKVASVQVIVIPVPYKDADTQGIFDACTATVEKLCEAGIRANSDFRDNYSPGWKYSHWEMKGVPLRIEIGPKDLANDQVRAVRRDNGAKIDLPRGSLVERVKELLEEVQESLFVAAKQRRDACIQIVKTWDEFVEALGQRKMILAPWCDEEEVEKDVKARTKGEMGAAKTLCSPLEQPEVPEGTLCFASGKPAKKWTYWGRSY

SEQ ID NO: 7343 - protein, 516 aa, Vitis vinifera
MASGEGKKSGEGKKANANAKGGGKKKEVKKETGLGLSYKKEENFGEWYSEVCVNGEMIEYYDISGCYILRPWTMAVWETMQTFFDAEIKKMKIKNCYFPLFVSPGVLQKEKDHIEGFAPEVAWVTKSGQSDLEVPIAIRPTSETVMYPYYSKWIRGHRDLPLRLNQWCNVVRWEFSHPTPFIRSREFLWQEGHTAFATKEEADKEVLEILELYRRIYEEYLAIPVIKGKKSEMEKFAGGFYTTSVEAFIPNTGRGIQGATSHCLGQNFAKMFDITFENEKGEKAMVWQNSWAYSTRTIGVMVMVHGDDKGLVMPPKVASVQIIVVPVPFKDADTQAIFDACDATVNTLNEAGFRAEADLRDNYSPGWKYSHWEMKGVPLRIEIGPKDLANKQARAVRRDNSAKIDIPIVNLVEQVKDMLDNIQQNLFDVAKQKRDACIKTVRTWDEFIEALGQKKMILAPWCDEMEVEKDVKARTKGETGAAKTLCAPFDQPDLEGVNCFVTGKPAKKWSYWGRSY

SEQ ID NO: 7344 - protein, 517 aa, Vinca minor
MAGKEAKGAGKEAKGSGAGSNTKGKERSEKETGLGLTFKKDENFGEWYSEVVVSGEMIEYYDISGCYILRPWAMSIWEIMQGFFDAEIKKMNIKNCYFPLFVSPGVLQKEKDHIEGFAPEVAWVTKSGESDLEVPIAIRPTSETVMYPYYSKWVRGHRDLPLRLNQWCNVVRWEFSNPTPFIRSREFLWQEGHTAFATKEEADKEVLDILELYRRIYEEFLAVPVTKGKKSEREKFAGGLYTTTVEAFIPNTGRGVQGATSHCLGQNFAKMFEINFEDEKGEKRMVWQNSWAYTTRTIGVMIMTHGDDKGLVLPPKVAAVQVVVIPVPYKDADTQAILDACAATVKTLNESGFRAEADLRDNYSPGWKYSNWEMKGVPLRIEIGPRDLANKQVRVVRRDNAAKIDIPMDNLVEQVKNLLDTIQQNLYDVAKQKKEACIQVVKTWEEFVEALAQKKLILAPWCDEEEVEEDVKNRTKGEMGAVKTLCSPFEQPELPEGTLCFATGKPAKKWTYWGRSY

SEQ ID NO: 7345 - protein, 511 aa, Citrus clementina
  Sequence also found in Organisms: Citrus sinensis
MAGGGEKKSKANATGGGKKKEVKKETGLGLSYKKDENFGEWYSEVVVNGEMIEYYDISGCYIIRPWAMSIWETMQKFFDAEIKKMKIQNCYFPLFVSPTVLQKEKDHIEGFAPEVAWVTKSGESDLEVPIAIRPTSETVMYPYYSKWIRGHRDLPLKLNQWCNVVRWEFSNPTPFIRSREFLWQEGHTAFATKSEADDEVLQILELYRRIYEEFLAVPVIKGKKSELEKFAGGLYTTTVEAFIPNTGRGIQGATSHCLGQNFSKMFEIIFENEKGEKAMAWQNSWAYTTRTIGVMVMVHGDDKGLVLPPRVASVQVIVVPVPYKDADTQGIFDACTATVETLCEAGICANMDSRDNYSPGWKYSHWEMKGVPLRIEIGPKDLAKNQVRAVRRDNGAKVDLPRSSLVERIKELLDEIQESLFVAAKQRRDACIQIVKTWDEFVEALGQRKMILAPWCDEEEVEKDVKARTKGEMGAAKTLCSPLEQPEIPEGTLCFASGKPAKRWSYWGRSY

SEQ ID NO: 7346 - protein, 507 aa, Mimulus guttatus
MAGKDAKSNAAKGKKKEVKKETGLGLSYKKDENFGEWYSEVVVNGEMIEYYDISGCYILRPWAMSIWEIMQTFFDAEIKKMKIKNCYFPLFVSSGVLQKEKDHIEGFAPEVAWVTKSGESELEMPIAIRPTSETVMYPYFSKWIRGHRDLPLRLNQWCNVVRWEFSNPTPFIRSREFLWQEGHTAFATKEEADTEVLDILELYRRIYEEFLAVPVIKGKKSEHEKFAGGLYTTTVEAFVPNTGRGVQGATSHCLGQNFAKMFEINFENEKGEKAMVWQNSWAYTTRTIGVMIMVHGDDKGLVLPPKVASVQVIVIPVPYKDADTKGIFDACAATVKSLNESGIRAEADFRDNYSPGWKYSHWEMKGVPLRIEIGPKDYANNQVRAVRRDNATKHDIPMADVVERVKDMLDNIQQSLFDAAKEKRDVCIEVVHTWEEFAEALGQKKMILAPWCDEEEVERDVKTRTKGEMGAAKSLCSPFQQPELPEGTLCFASGKPAKKWTYWGRSY

SEQ ID NO: 7347 - protein, 512 aa, Eutrema halophilum
MAGPSGKKDKAEKAGPSGKKKKEVKKETGLGLSVKKDENFGEWYSEVCKHEMIEYYDISGCYILRPWSMAIWEIMQSFFDAEIKKMKVKNCYFPLFVSPGVLEKEKDHIEGFAPEVAWVTKSGKSDLEVPIAIRPTSETVMYPYFSKWIRGHRDLPLKLNQWCNVVRWEFSNPTPFIRSREFLWQEGHTAFATKEEADEEVLQILELYRRIYEEYLAVPVVKGMKSENEKFAGGLYTTSVEAFIPNTGRGVQGATSHCLGQNFAKMFEINYENEKGETAMVWQNSWAYSTRTIGVMIMTHGDDKGLILPPKVASVQVVVIPVPYKDANTQGIFDACTATVSTLCEAGIRAEEDLRDNYSPGWKYSNWEMKGVPLRIEIGPRDLENDQVRTVRRDNGVKEDIPRGSLGKHVQELLEKIQQNMYEVAKQKREACVEEIKTWDEFIEALNKKKLILAPWCDEEEVERDVKARTKGETGAAKTLCSPFEQPELPEGTLCFASGKPAKKWTYWGRSY

SEQ ID NO: 7348 - protein, 510 aa, Phaseolus vulgaris
MAGTEAKKPSAKQSGAKKKEVKKETGLGLTHRKADNFGEWYSEVVVNAEMIEYYDISGCYILRPWSMAIWEIMQEFFDPEIKKMKIKNCYFPLFVSPGVLQKEKDHVEGFAPEVAWVTKSGESELEIPIAIRPTSETVMYPYYSKWIRGHRDLPLKLNQWCNVVRWEFSNPTPFIRSREFLWQEGHTAFATKEEADAEVLDILELYRRIYEEYLAVPVIKGKKSELEKFAGGLYTTSVEAFIPNTGRGIQGATSHCLGQNFAKMFEINFENDKGEKAMVWQNSWAYSTRTIGVMVMVHGDDKGLVLPPKVASVQVIVIPVPYKDANTQGIYDACSATVNALSEAGIRSESDFRDNYSPGWKYSHWEMKGVPLRIEIGPKDLANKQVRAVRRDNGAKIDIASADLAVEIQKLLDNIQQNLFDVAKQKRDECIEVIHTWDEFVQALNQRKMILAPWCDEEEVEADVKARTKGEMGASKTLCSPFDQPELPEGTKCFASGKPATKWTYWGRSY

SEQ ID NO: 7349 - protein, 498 aa, Populus trichocarpa
MAGGKKKEVKKETGLGLSFKKEENFGEWYSEVVVNGEMIEYYDISGCYILRPWAMSIWEIMQVFFDAEIKKMKIKNCYFPLFVSSSVLEKEKDHIEGFAPEVAWVTKSGKSDLEIPIAIRPTSETVMYPYFSKWIRGHRDLPLKLNQWCNVVRWEFSNPTPFIRSREFLWQEGHTAFATKQEADEEVLQILELYRRIYEEFLAIPIIKGKKSEMEKFAGGLYTTSVEAFIPNTGRGIQGATSHCLGQNFAKMFEINFENEKGEKGMAWQNSWAYSTRTIGVMVMVHGDDKGLVLPPKVSSVQVIVVPVPFKDANTQGIFDACAATVDTLCEAGIRAEADYRENYSPGWKYSHWEMKGVPLRIEIGPKDLANNQVRAVRRDNAAKVDISCDNLAEKVKDMLDDIQKSMFDAAKQKRDACIQVAKTWDEFKEALSQRKMILAPWCDEEEVEKDVKDRTRGEMGAAKSLCSPFDQPELPEGTTCFASGKPAKKWTYWGRSY

SEQ ID NO: 7350 - protein, 498 aa, Populus trichocarpa
MADGKKKEVKKETGLGLTFKKEENFGEWYSEVVVNGEMIEYYDISGCYILRPWSMSIWETMQAFFDVEIKKMKIKNCYFPLFVSSSVLQKEKDHIEGFAPEVAWVTKAGKSDLEVPVAIRPTSETVMYPYFSKWIRGHRDLPLKLNQWCNVVRWEFSNPTPFIRSREFLWQEGHTAFASKQEADEEVLQILELYQRIYEEFLAIPVIKGKKSEMEKFAGGLYTTSVEAFIPNTGRGIQGATSHCLGQNFAKMFEINFENEKGEKGMAWQNSWAYSTRTIGVMVMVHGDDKGLVLPPKVASVQVIVVPVPYKDADTQGIFDACAATVDTLCEAGIRAEADFRENYSPGWKYSHWEMKGVPLRIEIGPKDLANNQVRAVRRDNAAKVDISRDSLMEKVKDMLDDIQQRLFDAAKQKRDACIQVVKTWGEFKEALSQRKMILAPWCDEEEVERDVKERTRGEMGAAKSLCSPFDQPELPEGTACFASGKPAKKWTYWGRSY

SEQ ID NO: 7351 - protein, 510 aa, Arachis hypogaea
MAGSEAKNSGSKQSGAKKKEVKKETGLGLTNRKADNFGEWYSEVVVNSEMIEYYDISGCYILRPWAMAIWEIMQGFFDPEIKKMKIKNCYFPLFVSPGVLEKEKEHVEGFAPEVAWVTKSGKTDLEIPIAIRPTSETVMYPYYSKWIRGHRDLPLKLNQWCNVVRWEFSNPTPFIRSREFLWQEGHTAFATKEEADAEVLEILELYRRIYEEFLAIPVIKGKKSEMEKFAGGLYTTSVEAFIPNTGRGVQGATSHCLGQNFAKMFEINFENEKGEKAMVWQNSWAYSTRTIGVMVMVHGDDKGLVLPPKVASVQVIVIPVPYKDANTQGIFDACTATVNTLCEAGIRAESDFRDNYSPGWKYSHWEMKGVPLRIEIGPKDLANKQARAVRRDNGAKIDIANDNLVDEVKKLLDTVQQNLFDVAKQKRDECIEVVHTWDEFVQALNQRKMILAPWCDEEAVEADVKARTKGEMGAAKTLCSPFDQPELPEGTKCFASEKPAKKWSYWGRSY

SEQ ID NO: 7352 - protein, 515 aa, Brassica oleracea
MAGPSGKKEKVDKAGPSGGGGKKKKDVKKETGLGLSVKKDENFGEWYSEVCKHEMIEYYDISGCYILRPWSMAIWEIMHTFFDAEIKKMKVKNCYFPLFVSPGVLEKEKDHIEGFAPEVAWVTKSGKSDLEVPIAIRPTSETVMYPYYSKWIRGHRDLPLKLNQWCNVVRWEFSNPTPFIRSREFLWQEGHTAFATKEEADKEVLEILELYRRIYEEYLAVPVVKGMKSENEKFAGGLYTTSVEAFIPNTGRGVQGATSHCLGQNFAKMFEITFENEKGETEMVWQNSWAYSTRTIGVMIMTHGDDKGLILPPKVASVQVVVIPVPYKDANTQGIFDACTATVAALSEAGIRAEEDLRDNYSPGWKYSNWEMKGVPLRIEIGPRDLENDQVRTVRRDNGVKEDIPRGSLVEHVKELLEKIQQNMYEVARQKREACVQEIRTWDEFISALNQKNLILAPWCDEEEVERDVKARTKGETGAAKTLCSPFEQPELPEGTLCFASGKPAKKWTYWGRSY

SEQ ID NO: 7353 - protein, 520 aa, Cicer arietinum
MAGTESKKQSAEKKPKSGAKPQQSGGKKKEVKKETGLGLTNRKAENFGEWYSEVVVNGEMIEYYDISGCYILRPWSMSIWEILQAFFDPEIKKMKIKNCYFPVFVSPGVLEKEKDHVEGFAPEVAWVTKSGNSDLEIPIAIRPTSETVMYPYYSKWIRGHRDLPLKLNQWCNVVRWEFSNPTPFIRSREFLWQEGHTAFATKEEADTEVLEILELYRRIYEEYLAVPVIKGKKSELEKFAGGLYTTSVEAFIPNTGRGIQGATSHCLGQNFAKMFEINYENEKGEKAMVWQNSWAYSTRTIGVMVMVHGDDKGLVLPPKVASVQVIVIPVPYKDADTQGIFDACSATVSMLCEAGIRAESDSRDNYSPGWKYSQWEMKGVPLRIEIGPKDLANKQVRAVRRDTGAKIDIANAGLVEEIKKLLDSIQQNLFDVATQKRDECIQIIHTWDEFVQALNQKKMILAPWCDEKDVEVDVKARTKGEMGAAKTLCSPFDQPELPEGTTCFASGKPAKKWSYWGRSY

SEQ ID NO: 7354 - protein, 511 aa, Eschscholzia californica
MANDKATKSSANPKSGGKKKEVKKETGLGLSHKKDENFGEWYSEVVVSGEMIEYYDISGCYILRPWSMSIWEIMQVFFDAEIKKMKIKNCYFPVFVSPGVLQREKDHIEGFAPEVAWVTKSGDTDLEVPIAIRPTSETVMYPYYSKWIRGHRDLPLRLNQWCNVVRWEFSNPTPFIRSREFLWQEGHTAFATKAEADKEVLEILELYRRIYEEFLAIPVVKGKKSENEKFAGGLYTTSVEAFIPNTGRGIQGATSHCLGQNFAKMFEINFENEKGEKGMVWQNSWAYSTRTIGVMVMVHGDDKGLVLPPKVASVQVIVIPVPYKDADMQAIFDACSSTVDKLNEAGFRAEADLRDNYSPGWKYSHWELKGVPLRIEIGPKDMANNQVRVVRRDNGSKVDIPNANLVDQIKDVLDDIQQSLFNAAKLKRDASVTIAKTWEEFITALNEKKMILAPWCDEEEVEKDVKARTKGETGAAKTLCTPFDQPELPEGTLCFASGKPATKWTYWGRSY

SEQ ID NO: 7355 - protein, 514 aa, Flaveria ramosissima
MASGKGDKAAKADKSAAVAKSSKGRKKETGLGLTNTKDGNFGEWYSEVVTNGEMIEYYEISGCYILRPWTMAIWEIMQNFFDPEIKKMKIKTCYFPLFVSNNVLQKEKDHIEGFAPEVAWVTRSGDSDLEVPIAIRPTSETVMYPYFSKWIRGHRDLPLKLNQWCNVVRWEFSNPTPFIRSREFLWQEGHTAHATKEEADTEVLEILELYRRLYEEYLAVPVVKGKKSELEKFAGGLYTTSVEAFIPNTGRGVQGATSHCLGQNFAKMFEINFEDEKGEKAMVWQNSWAYSTRTIGVMVMVHGDDKGLVLPPKVAAVQVIVIHVPYKDADVKEIMNACSATVKTLCDLGIRAEADLRENYSPGWKYSHWEMKGVPLRIEIGPKDLANNQVRAVRRDNGEKADIPMADLVDKVKGMLDNIQQNMFDVAKQKRDACIQVTKTWDEFIEALGQKKLILAPWCDEEEVEKEVKAKTKGETGAAKTLCSPFDQPELPEGTLCFASGKPAKKWTYWGRSY

SEQ ID NO: 7356 - protein, 513 aa, Chenopodium quinoa
MAGDSKAKTADPKAKNVGKKKKEVKKETGLGLTNKKDENFGEWYSEVVVNSEMIEYYDISGCYILRPWTMAIWEAMQEFFDAEIKKMKIKNCYFPLFVSPGVLEKEKDHIEGFAPEVAWVTKSGQSDLEVPIAIRPTSETVMYPYYSKWIRGHRDLPLRLNQWCNVVRWEFSNPTPFIRSREFLWQEGHTAFATQEEADAEVLDILELYRRIYEEFLAVPVVKGKKSEMEKFAGGYYTTSVEAFIPNTGRGVQGATSHCLGQNFAKMFEITYENEKGEKAMVWQNSWAYSTRTIGVMVMTHGDDKGLVLPPKVAAVQVIVVPVPFKDADTQGIFDACASTVKILSEAGIRAECDLRDNYSPGWKYSHWEMKGVPLRLEIGPKDLANSQTRAVRRDNSAKKDIPMADLVDQVKELLDTIQQNLFDVAKEKRDACVKEVRTWDEFVEALAQKKLILAPWCDEEEVEKDVKARTKGEIGAAKTLCSPFDQPALEEGTLCFASGKPAKKWTYWGRSY

SEQ ID NO: 7357 - protein, 495 aa, Vinca minor
GKKKEVKKETGLGLTYKKDENFGEWYSEVVVSGEMIEYYDISGCYILRPWAMSIWEIMQGFFDAEIKKMNIKNCYFPLFVSPGVLQKEKDHIEGFAPEVAWVTKSGESDLEVPIAIRPTSETVMYPYYSKWVRGHRDLPLRLNQWCNVVRWEFSNPTPFIRSREFLWQEGHTAFATKEEADIEVLDILELYRRIYEEFLAVPVTKGKKSEREKFAGGLYTTTVEAFIPNTGRGIQGATSHCLGQNFAKMFEINFEDEKGEKRMVWQNSWAYTTRTIGVMIMTHGDDKGLVLPPKVASVQVVVIPVPYKDADTQGILDACSATVKTLNESGFRAEADLRDNYSPGWKYSNWEMKGVPLRIEIGPRDLANKQVRAVRRDNSAKIDIPMDNLVEQVKNLLDTIQQNLYDVAKQKKEACIQVVKTWEEFIEALAQKKLILAPWCDEEEVEEDVKNRTKGEAGAVKTLCSPFEQPELPEGTLCFATGKPAKKWTYWGRSY

SEQ ID NO: 7358 - protein, 564 aa, Orobanche aegyptiaca
MDGKDANSSDSKGEKKEVKEVKNDGKKEVKNDGKKKEVKNDGKKEVKNDGKKKEVKEVKKDGKKKEVKKETGLGLSYKKDENFGEWYSEVVVTGEMIEYYDISGCYILRPWAMSIWEVMQTFFDAEIKKLKIKNCYFPLFVSSDVLQKEKDHIEGFAPEVAWVTKSGESVLEKPIAIRPTSETVMYPYFSKWIRGHRDLPLRLNQWCNVVRWEFSNPTPFIRSREFLWQEGHTAFETKEEADTEVLEILELYRRIYEEFLAVPVIKGKKSEHEKFAGGLYTTTVEAFVPNTGRGVQGATSHCLGQNFAKMFEINFENQKGERALVWQNSWAYTTRTIGVMIMVHGDDKGLVLPPKVASLQVIVIPVPYKDANTQGIFDACAATVESLTEAGILAEADFRENYSPGWKYSNWELKGVPLRIEIGPKDLANNQVRAVRRDNSAKIDIPMADLVEKVKDMLNDIQQSMFDVAKQKRDACIQIVHTWDEFVEALGQKKMILAPWCDEEEVEKDVKPARKETWVQLSLYVLHLISLSSQKVRCALRRESLPKSGPTGEGVTDHCFQFIT

SEQ ID NO: 7359 - protein, 514 aa, Brassica napus
  Sequence also found in Organisms: Brassica oleracea
MAGPSGKKEKVDKAGPSGGGKKKKDVKKETGLGLSVKKDENFGEWYSEVCKHEMIEYYDISGCYILRPWSMAIWEIMQTFFDAEIKKMKVKNCYFPLFVSPGVLEKEKDHIEGFAPEVAWVTKSGKSDLEVPIAIRPTSETVMYPYYSKWIRGHRDLPLKLNQWCNVVRWEFSNPTPFIRSREFLWQEGHTAFATKEEADEEVLQILELYRRIYEEYLAVPVVKGMKSENEKFAGGLYTTSVEAFIPNTGRGVQGATSHCLGQNFAKMFEIRYEDEEGKREMVWQNSWAYSTRTIGVMIMTHGDDKGLILPPKVASVQVVVIPVPYKDANTQGIFDACTATVSALSEAGIRAEEDLRDNYSPGWKYSNWEMKGVPLRIEIGPRDLENDQVRTVRRDNGVKEDIPRGSLVEHVKELLEKIQQNMYEVARQKREACVQEIRTWDEFISALNQKKLILAPWCDEEEVERDVKARTKGETGAAKTLCSPFEQPELPEGTLCFASGKPAKKWTYWGRSY

SEQ ID NO: 7360 - protein, 514 aa, Brassica rapa
MAGASGKKEKVDKAGPSGGGKKKKDVKKETGLGLSVKKDENFGEWYSEVCKHEMIEYYDISGCYILRPWSMAIWEIMQTFFDAEIKKMKVKNCYFPLFVSPGVLEKEKDHIEGFAPEVAWVTKSGKSDLEVPIAIRPTSETVMYPYYSKWIRGHRDLPLKLNQWCNVVRWEFSNPTPFIRSREFLWQEGHTAFATKEEADEEVLQILELYRRIYEEYLAVPVVKGMKSENEKFAGGLYTTSVEAFIPNTGRGVQGATSHCLGQNFAKMFEIRYEDEEGKREMVWQNSWAYSTRTIGVMIMTHGDDKGLILPPKVASVQVVVIPVPYKDANTQGIFDACTATVSALSEAGIRAEEDLRDNYSPGWKYSNWEMKGVPLRIEIGPRDLENDQVRTVRRDNGVKEDIPRGSLVEHVKELLEKIQQNMYEVAKQKREACVQEIRTWDEFISALNLKKLILAPWCDEEEVERDVKARTKGETGAAKTLCSPFEQPELPEGTLCFASGKPAKKWTYWGRSY

SEQ ID NO: 7361 - protein, 514 aa, Brassica napus
MAGPSGKKEKVDKAGPSGGGKKKKDVKKETGLGLSVKKDENFGEWYSEVCKHEMIEYYDISGCYILRPWSMAIWEIMQTFFDAEIKKMKVKNCYFPLFVSPGVLEKEKDHIEGFAPEVAWVTKSGKSDLEVPIAIRPTSETVMYPYYSKWIRGHRDLPLKLNQWCNVVRWEFSNPTPFIRSREFLWQEGHTAFATKEEADEEVLQILELYRRIYEEYLAVPVVKGMKSENEKFAGGLYTTSVEAFIPNTGRGVQGATSHCLGQNFAKMFEITYEDEEGKREMVWQNSWAYSTRTIGVMIMTHGDDKGLILPPKVASVQVVVIPVPYKDANTQGIFDACTATVSALSEAGIRAEEDIRDNYSPGWKYSNWEMKGVPLRIEIGPRDLENDQVRTVRRDNGVKEDIPRGSLVEHVKELLEKIQQNMYEVAKQKREACVQEIRTWDEFISALNQKKLILAPWCDEEEVERDVKARTKGETGAAKTLCSPFEQPELPEGTLCFASGKPAKKWTYWGRSY

SEQ ID NO: 7362 - protein, 510 aa, Actinidia deliciosa
MAGGEAKKASTNANNRKKKEVKKETGLGLSSKKDENFGEWYSEIVVSGELIEYYDISGCYILRPWTMSIWEIMQAFFDAEIKKMKIKNCYFPLFVSPGVLQKEKDHIEGFAPEVAWVTKSGQSDLDVPIAIRPTSETVMYPYFSKWIRGHRDLPLKLNQWCNVVRWEFSNPTPFIRSREFLWQEGHTAFAAKEEADKEVLEILELYRRIYEDYLAIPVIKGKKSEHEKFAGGLYTTSVEAFIPHTGRGIQGATSHCLGQNFAKMFEIDFENDKGEKAMVWQNSWAYSTRTIGVMVMVHGDDKGLVLPPKIAAVQVIVIPVPYKDADTKGIFDACDDTVKALNESGFRAEADFRDNYSPGWKYSHWEMKGVPLRIEIGPKDLANDQVRAVRRDNSAKRDIPRARLVEQVKDMLDDIQQSLFDAAKQNRDACVQVARTWDEFMEALNQKKMILAPWCDEEEVEKDVKARTKGEIGAAKTLCSPFDQPALDEGTLCFASGKPAKKWTYWGRSY

SEQ ID NO: 7363 - protein, 508 aa, Olea europaea
MAGKDKEANSSNSKGKKKEVKKETGLGLSVKKDDNFGEWYSEVVVNGEMIEYYDISGCYILRPWAMSIWEIMQTFFDAEIKKMKIKTATSPFVSPGVLQKEKDHIEGFAPEVAWVTKSGESELEVPIAIRPTSETVMYPYFSKWIRGHRDLPLRLNQWCNVVRWEFSNPTPFIRSREFLWQEGHTAFATKEEADTEVLEILELYRRIYEEFLAVPVIKGKKSEHEKFAGGLYTTTVEAFIPNTGRAIQGATSHCLGQNFAKMFEINFENDKGEKAMVWQNSWAYTTRTIGVMIMVHGDDKGLVLPPKIASVQVIVIPVPYKDANTQGIFDACAATVKTLDESGIRAEVDSRDNYSPGWKYSHWEMKGVPLRIEIGPKDLANNQVRVVRRDNSAKIDIPMASLVEQVNDLLNDIQKNLFEVAKQKRDACIHTVNTWEEFAEALNQKKMILAPWCDEEEVEKDVKARTKGELGAAKSLCSPFDQPELPEGKLCFASGKPARKWTYWGRSY

SEQ ID NO: 7364 - protein, 513 aa, Chenopodium quinoa
MAGDSKAKTADPKAKNAGKKKKEVKKETGLGLTNKKDENFGEWYSEVVVNSEMIEYYDISGCYILRPWTMAIWEAMQEFFDAEIKKMKIKNCYFPLFVSPGVLEKEKDHIEGFAPEVAWVTKSGQSDLEVPIAIRPTSETVMYPYYSKWIRGHRDLPLRLNQWCNVVRWEFSNPTPFIRSREFLWQEGHTAFATQEEADAEVLDILELYRRIYEEFLAVPVVKGKKSEMEKFAGGYYTTSVEAFIPNTGRGVQGATSHCLGQNFAKMFEITYENEKGEKAMVWQNSWAYSTRTIGVMVMTHGDDKGLVLPPKVAAVQVIVVPVPFKDADTQGIFDACASTVKILSEAGIRAECDLRDNYSPGWKYSHWEMKGVPLRLEIGPKDLANSQTRAVRRDNSAKKDIPMADLVDQVKELLDTIQQNLFDVAKEKRDACVKEVRTWDEFVEALAQKKLILAPWCDEEEVEKDVKARTKGEIGAAKTLCSPFDQPALEEGTLCFASGKPAKKWSYWGRSY

SEQ ID NO: 7365 - protein, 514 aa, Flaveria ramosissima
MASGKGDKAAKADKSTAVAKSSKGRKKETGLGLTNTKDGNFGEWYSEVVTNGEMIEYYEISGCYILRPWTMAIWEIMQNFFDPEIKKMKIKTCYFPLFVSNNVLQKEKDHIEGFAPEVAWVTRSGDSDLEVPIAIRPTSETVMYPYFSKWIRGHRDLPLKLNQWCNVVRWEFSNPTPFIRSREFLWQEGHTAHATKEEADTEVLEILELYRRLYEEYLAVPVVKGKKSELEKFAGGLYTTSVEAFIPNTGRGVQGATSHCLGQNFAKMFEINFEDEKGEKAMVWQNSWAYSTRTIGVMVMVHGDDKGLVLPPKVAAVQVIVIHVPYKDADVKEIMNACSATVKSLCDLGIRAEADLRENYSPGWKYSHWEMKGVPLRIEIGPKDLANNQVRAVRRDNGEKVDIPMADLADKVKGMLDNIQQNMFDVAKQKRDACIQVTKTWDEFIEALGQKKLILAPWCDEEEVEKEVKAKTKGETGAAKTLCSPFDQPELPEGTLCFASGKPAKKWTYWGRSY

SEQ ID NO: 7366 - protein, 508 aa, Mimulus guttatus
MASKGANNPAAKGKKKKEVKKETGLGLSYKKDENFGEWYSEVVVNGEMIEYYDISGCYILRPWAMSIWEVMQTFFDAEIKKMKIKNCYFPLFVSSSVLQKEKDHIEGFAPEVAWVTKSGDSELEMPIAIRPTSETVMYPYFSKWIRGHRDLPLRLNQWCNVVRWEFSNPTPFIRSREFLWQEGHTAFATKEEADTEVLDVLELYRRIYEEFLAVPVIKGKKSEHEKFAGGLYTTTVEAFVPNTGRGVQGATSHCLGQNFAKMFEINFENEKGEKSMVWQNSWAYTTRTIGVMIMVHGDDKGLVLPPKVASLQVVVIPVPYKDANTQGIFDACADVIKSLEEAGIRAEADYRDNYSPGWKYSHWEMKGVPLRIEIGPKDLANNQVRVVRRDNSAKSDIPMADLVKGVTDMLDNIQQSLFDAATQKRDACIHTVHTWEEFAEALGQKKMILAPWCDEEEVEKDVKTRTKGEMGAAKSLCTPFDQPALPEGTLCFASGKPAKKWTYWGRSY

SEQ ID NO: 7367 - protein, 461 aa, Allium cepa
MIEYYDISGCYILRPWTMSIWETMQEFFDAEIKKLKVKNCYFPLFVTETVLQKEKDHIEGFAPEVAWVTKSGQSEMEIPIAIRPTSETVMYPYFSKWIRGHRELPLKLNQWCNVVRWEFSNPTPFIRSREFLWQEGHTAFATKEEADKEVLDILELYRRIYEEYLAIPVVKGKKSELEKFAGGLYTTSVEAFIPNTGRGIQGATSHCLGQNFAKMFHINFENEKGEKAMVWQNSWAYSTRTIGVMVMVHGDNKGLVLPPKVASVQVIVIPVPYKDANTQAIFDACKSTVATLSIAGFRAEEDLRDNYSPGWKYSNWEMKGVPLRIEIGPKDLANNQVRVVRRDNGNKQDIPMEHLAEKVKEILIDIQQSLFNAAKEKRDACVKIISTWDEFVTALNDKKLILAPWCDEEEVEKDVKARTKGDLGAAKTLCTPFEQPRLPEGTKCFASGKPATKWTYWGRSY

SEQ ID NO: 7368 - protein, 513 aa, Helianthus annuus
MAGKGDKPAKADKSAAVAKSSKGRKKETGLGLTNTKDGNFGEWYSEVVTNGEMIEYYEISGCYILRPWTMAIWEIMQNFFDPEIKKMNIKTCYFPLFVSNNVLQKEKDHIEGFAPEVAWVTRSGDSDLEVPIAIRPTSETVMYPYFSKWIRGHRDLPLRLNQWCNVVRWEFSNPTPFIRSREFLWQEGHTAFATKEEADTEVLEILELYRRLYEEYLAVPVVKGRKSELEKFAGGLYTTSVEAFIPNTGRGVQGATSHCLGQNFAKMFEINFEDEKGEKAMVWQNSWAYSTRTIGVMVMVHGDDKGLVLPPKVAAVQVIVVHVPYKDADVKEIINACSATVKTLCDAGIRAEADLRENYSPGWKYSHWEMKGVPLRIEIGPKDLANNQARAVRRDNGAKVDIPMADLVDSVKGMLDTIQQNMFDVAKEKRDACIQVTKTWDEFIEALGQKKLILAPWCDEEEVEKEVKAKTKGETGAAKTLCSPLEQPELPEGTLCFASGKPAKKWTYWGRSY

SEQ ID NO: 7369 - protein, 519 aa, Lotus japonicus
MAGTEAKTKKSDSKPQKQQQQQGGGKKKEVKKETGLGLTHKKAENFGEWYSEVVVNSEMIEYYDISGCYILRPWSMAIWEIMQAFFDPEIKKMKIKNCYFPLFVSPGVLQKEKDHVEGFAPEVAWVTKSGESELEIPIAIRPTSETVMYPYYSKWIRGHRDLPLKLNQWCNVVRWEFSNPTPFIRSREFLWQEGHTAFATKEEADAEVLEILELYRRIYEEYLAVPVIKGKKSALEKFAGGLYTTSVEAFIPNTGRGVQGATSHCLGQNFAEMFEINFENEKGEKAMAWQNSWAYSTRTIGVMVMVHGDDKGLVLPPKVASVQVIVIPVPFKDANTQGIYDACAATVNTLCEAGIRAESDTRDNYSPGWKYSHWEMKGVPLRIEIGPKDLANKQVRAVRRDNGAKIDIANADLVEELKKLLDNIQQNLFDVAKQKRDECIQIIHTWDEFIQALNEKNMILAPWCDEEEVEADVKARTRGETGAAKTLCSPFDQPELPEGTKCFASGKPATKWSYWGRSY

SEQ ID NO: 7370 - protein, 501 aa, Cannabis sativa
MLAFTGGKKKEVKKETGLGLTHKKDENFGEWYSEVVVNGEMIEYYDISGCYILRPWTMAIWEIMQAFFDGEIKKMKIKNCYFPLFVSPTVLQKEKDHIEGFAPEVAWVTKSGESDLEVPIAIRPTSETVMYPYYSKWIRGHRDLPLRLNQWCNVVRWEFSNPTPFIRSREFLWQEGHTAFATKPEADEEVLEILELYRRIYEEFLAIPVVKGKKSEMEKFAGGLYTTSVEAFVPNTGRGVQGATSHCLGQNFAKMFEINFENEKGEKAMVWQNSWAYSTRTIGVMVMVHGDDKGLVLPPKVASVQVIVVPVPYKDADTQGIYDACTATVNSLNEVGIRAEADFRDNYSPGWKYSHWEMKGVPLRIEIGPKDLANSQVRCVRRDNASKKDIPMANLVEGVKELLDNIQQSLFDAAKVKRDACVQIVKTWEEFVDALAKRKLILAPWCDEEEVEKDVKTKTKGDMGAAKTLCSPFEQPELPEGTLCFASGKPAKKWTYWGRSY

SEQ ID NO: 7371 - protein, 487 aa, Catharanthus roseus
ETGLGLTHKKDENFGEWYSEVVVSGEMIEYYDISGCYILRPWAMSIWEIMQAFFDSEIKKMNIKNCYFPLFVSPAVLQKEKDHIEGFAPEVAWVTKSGESDLEVPIAIRPTSETVMYPYYSKWIRGHRDLPLRLNQWCNVVRWEFSHPTPFIRSREFLWQEGHTAFATKEEADQEVLDILELYRRIYEEFLAVPVTKGKKSELEKFAGGLYTTTVEAFIPNTGRGIQGATSHCLGQNFAKMFEINFENDKGEKGMVWQNSWAYTTRTIGVMIMTHGDDKGLVLPPKVAAIQVVVIPVPFKDADTQGILDACSATVKTLNESGFRAEADLRDNYSPGWKYSNWEMKGVPLRIEIGPRDLANKQVRAVRRDNGAKIDIPMDNLVEEVKNLLDNIQQNLFDVAKQKKDACIQVVKTWEEFVEALGQKKLILAPWCDEEEVEKDVKTRTKGEMGAAKTLCSPFVQPELPEGTLCFASGKPAKKWTYWGRSY

SEQ ID NO: 7372 - protein, 514 aa, Centaurea maculosa
MAGGKGDKPDNGKKPAAVAKSSKGRKKETGLGLTNTKDGNFGEWYSEVVTNGEMIEYYEISGCYILRPWTMSIWEIMQTFFDAEIKKMKIKTCYFPLFVSNNVLQKEKDHIEGFAPEVAWVTRSGDSELEVPIAIRPTSETVMYPYFSKWIRGHRDLPLKLNQWCNVVRWEFSNPTPFIRSREFLWQEGHTAFATKEEADTEVLEVLELYRRLYEEYLAVPVVKGKKSEMEKFAGGLYTTSVEAFIPNTGRGVQGATSHCLGQNFAKMFEINFEDEKGEKAMVWQNSWAYSTRTIGVMVMTHGDDRGLVLPPKVAAIQVIVIHVPYKDADIKEILNACSATVKALCDSGIRAEADLRENYSPGWKYSHWEMKGVPLRIEIGPKDLANKQVRAVRRDNAAKIDIPMDGLVDKVKGMLDDIQQSMFDVAKQKRDACVQVAKTWDEFIEALGQKKLILAPWCDEEEVEKDVKTKTKGETGAAKTLCSPFEQPELPEGTLCFASGKPAKKWTYWGRSY

SEQ ID NO: 7373 - protein, 514 aa, Centaurea maculosa
MAGGKGDKPDNGKKSAAVAKSSKGRKKETGLGLTNTKDGNFGEWYSEVVTNGEMIEYYEISGCYILRPWTMSIWEIMQTFFDAEIKKMKIKTCYFPLFVSNNVLQKEKDHIEGFAPEVAWVTRSGDSELEVPIAIRPTSETVMYPYFSKWIRGHRDLPLKLNQWCNVVRWEFSNPTPFIRSREFLWQEGHTAFATKEEADTEVLEVLELYRRLYEEYLAVPVVKGKKSEMEKFAGGLYTTSVEAFIPNTGRGVQGATSHCLGQNFAKMFEINFEDEKGEKAMVWQNSWAYSTRTIGVMVMTHGDDRGLVLPPKVAAIQVIVIHVPYKDADIKEILNACSATVKALCDSGIRAEADLRENYSPGWKYSHWEMKGVPLRIEIGPKDLANNQVRTVRRDNAAKIDIPMDGLVDKVKGMLDDIQQSMFDVAKQKRDACVQVAKTWDEFIEALGQKKLILAPWCDEEEVEKDVKTKTKGETGAAKTLCSPFEQPELPEGTLCFASGKPAKKWTYWGRSY

SEQ ID NO: 7374 - protein, 514 aa, Centaurea maculosa
MAGGKGDKPDNGKKSAAVAKSSKGRKKETGLGLTNTKDGNFGEWYSEVVTNGEMIEYYEISGCYILRPWTMSIWEIMQTFFDAEIKKMKIKTCYFPLFVSNNVLQKEKDHIEGFAPEVAWVTRSGDSELEVPIAIRPTSETVMYPYFSKWIRGHRDLPLKLNQWCNVVRWEFSNPTPFIRSREFLWQEGHTAFATKEEADTEVLEVLELYRRLYEEYLAVPVVKGKKSEMEKFAGGLYTTSVEAFIPNTGRGVQGATSHCLGQNFAKMFEINFEDEKGEKAMVWQNSWAYSTRTIGVMVMTHGDDRGLVLPPKVAAIQVIVIHVPYKDADIKEILNACSATVKALCDSGIRAEADLRENYSPGWKYSHWEMKGVPLRIEIGPKDLANKQVRAVRRDNAAKIDIPMDGLVDKVKGMLDDIQQSMFDVAKQKRDACVQVAKTWDEFIEALGQKKLILAPWCDEEEVEKDVKTKTKGETGAAKTLCSPFEQPELPEGTLCFASGKPAKKWTYWGRSY

SEQ ID NO: 7375 - protein, 516 aa, Lupinus angustifolius
MAGNEVKTKNPSSKQKSGGGGGKKKEVKKETGLGLTNKKAENFGEWYSEVVVNSEMIEYYDISGCYILRPWAMSIWENMQAFFDPEIKKLKIKNCYFPLFVSPGVLEKEKEHVEGFAPEVAWVTKSGQTDLEVPIAIRPTSETVMYPYFSKWIRGHRDLPLKLNQWCNVVRWEFSNPTPFIRSREFLWQEGHTAFAKKEEADQEVLDILELYRRIYEEYLAIPVIKGKKSELEKFAGGLYTTSVEAFIPNTGRGVQGATSHCLGQNFSKMFNIEFEDENREKARVWQNSWAYSTRTIGVMVMVHGDDKGLVLPPKVASVQVIVIPVPYKDADTQGILDACSATVNTLVEAGIRAESDLRDNYSPGWKYSHWEMKGVPLRIEIGPKDLANQQVRAVRRDNGAKIDIKSADSVVEIKKLLDHIQQNLFEVAKQKRDECIQVIHTWDEFVQALSQRKMILAPWCDEEEVEVDVKARTKGETGAAKTLCSPFEQPELPEGTKCFASGKPAKKWSYWGRSY

SEQ ID NO: 7376 - protein, 510 aa, Chrysanthemum coronarium
MAGGGGKGKGGDKPTKSAKGRKKETGLGLTNTKDGNFGEWYSEVVTNGEMIEYYEISGCYILRPWTMAIWETMQNFFDPEIKKMNIKTCYFPLFVSNTVLQKEKDHIEGFAPEVAWVTRSGSSDLEVPIAIRPTSETVMYPYFSKWIRGHRDLPLRLNQWCNVVRWEFSNPTPFIRSREFLWQEGHTAFATKEEADTEVLEILELYRRLYEDYLAVPVVKGKKSELEKFAGGLYTTSVEAFIPNTGRGVQGATSHCLGQNFAKMFEINFEDEKGEKAMVWQNSWAYSTRTIGVMVMVHGDDKGLVLPPKISAVQVIVIHVPFKDADVKEIMNACSATVKTLCDLGIRAEADLRENYSPGWKYSHWEMKGVPLRIEIGPKDLANNQVRAVRRDNGSKIDLPVADLGDKVKGMLDDIQQSMFDVAKQKRDACIQVTKTWDEFIEALGQKKLILAPWCDEEEVEKDVKAKTKGEVGAAKTLCSPFEQPELPEGTLCFASGKPAKKWTYWGRSY

SEQ ID NO: 7377 - protein, 500 aa, Allium cepa
MASKNAKKKEVKKETGLGLTYKKDENFGEWYSEVVVNGEMIEYYDISGCYILRPWTMSIWETMQEFFDAEIKKLKVKNCYFPLFVTETVLQKEKDHIEGFAPEVAWVTKSGQSEMEIPIAIRPTSETVMYPYFSKWIRGHRELPLKLNQWCNVVRWEFSNPTPFIRSREFLWQEGHTAFATKEEADKEVLDILELYRRIYEEYLAIPVVKGKKSELEKFAGGLYTTSVEAFIPNTGRGIQGATSHCLGQNFAKMFHINFENEKGEKAMVWQNSWAYSTRTIGVMVMVHGDNKGLVLPPKVASVQVIVIPVPYKDANTQAIFNACKSTVATLCSAGFRAEEDLRDNYSPGWKYSNWEMKGVPLRIEIGPKDLANSQVRVVRRDNGSKQDIPMENLAEKVKEILIDIQQSLFNAAKEKRDACVKIISTWDEFVTALNDKKLILAPWCDEEEVEKDVKARTKGDLGAAKTLCTPFEQPRLPEGTKCFASGKPATKWTYWGRSY

SEQ ID NO: 7378 - protein, 514 aa, Beta vulgaris
MAGDAKVKAGDTKAKPKTGGKKKEVKKETGLGLTYKKAENFGEWYSEVVVNAEMIEYYDISGCYILRPWTMSIWESMHEFFDAEIKTMNIKNCYFPLFVSPGVLENEKDHIDGFAPQVAWVTNSGQSDLEVPIAIRPTSETVMYPYYSKWITGHRDLPLRLNQWCNVVRWEFSNPTPFIRSREFLWQEGHTAFATQEEADAEVLDILELYRRIYEEFLAVPVFKGKKSEMEKFAGGYYTTSVEAFIPNTGRGVQGATSHCLGQNFAKMFEITYENEKGEKAMVWQNSWAYSTRTIGVMVMTHGDDKGLVLPPKVAAVQIIVVPVPFKDADMQGIYDACTSTVKILNEAGLRAETDLRDNYSPGWKYSHWEMKGVPLRLEIGPKDLANSQARAVRRDNTEKKDIPMANLVDQVKELLDTIQQNMFDVAKQKRDECIKVVRTWDEFIEALGQKKLILAPWCDEEEVEKDVKARTKGEMGAAKTLCSPFDQPELEEGTLCFASGKPAKKWTYWGRSY

SEQ ID NO: 7379 - protein, 155 aa, Cirsium arvense
MAGGKGDKAENGKKSAAVAKSSKGRKKETGLGLTNTKDGNFGEWYSEVVTNGEMIEYYEISGCYILRPWTMSIWEIMQTFFDAEIKKMKIKTCYFPLFVSNNVLQKEKDHIEGFAPEVAWVTRSGDSDLEVPIAIRPTSETVMYPYFSKWIRGTP

SEQ ID NO: 7380 - protein, 80 aa, Flaveria ramosissima
MASGKGDKAAKADKSTAAAKSSKGRKKETGLGLTNTKDGNFGEWYSEVVTNGEMIEYYEISGCYILGHGQWLLGDNAKLL

SEQ ID NO: 7381 - protein, 513 aa, Echinacea purpurea
MAGKGDKPAKADKSAAGAKSSKGRKKETGLGLTNTKDGNFGEWYSEVVTNGEMIEYYEISGCYILRPWTMAIWEIMQNFFDPEIKKMNIKTCYFPLFVSNNVLQKEKDHIEGFAPEVAWVTRSGDSDLEVPIAIRPTSETVMYPYFSKWIRGHRDLPLRLNQWCNVVRWEFSNPTPFIRSREFLWQEGHTAFATKEEADTEVLEILELYRRLYEEYLAVPVVKGKKSELEKFAGGLYTTSVEAFIPNTGRGVQGATSHCLGQNFAKMFEINFEDEKGEKAMVWQNSWAYSTRTIGVMVMVHGDDKGLVLPPKVAAVQVIVVHVPYKDADIKEIINACSATVKTLCDAGIRAEADLRENYSPGWKYSHWEMKGVPLRIEIGPKDLANSQVRAVRRDNGEKVDLPMADLVDKVKGMLDNIQQSMFDAAKQKRDACIQITKTWDEFIEALGQKKLILAPWCDEEEVEKEVKAKTKGETGAAKTLCSPLKQPELPEGTLCFASGKLAKKWTYWGRSY

SEQ ID NO: 7382 - protein, 518 aa, Lactuca sativa
MAGGKGDKPANANKSNANKSNAAAQSSKGRKKETGLGLTNTKDGNFGEWYSEVVTNGEMIEYYEISGCYILRPWTMSIWEIMQTYFDAEIKKMKIKTCYFPLFVSNTVLQKEKDHIEGFAPEVAWVTRSGDSELEVPIAIRPTSETVMYPYFSKWIRGHRDLPLKLNQWCNVVRWEFSNPTPFIRSREFLWQEGHTAFATKEEADTEVLEILELYRRLYEEYLAVPVVKGKKSEMEKFAGGLYTTSVEAFIPNTGRGVQGATSHCLGQNFAKMFEINFEDEKGEKAMVWQNSWAYSTRTIGVMVMVHGDDKGLVLPPKVAAVQVIVVNVPYKDADTEKIKDACLDTVKTLSDLGIRAEADLRENYSPGWKYSHWEMKGVPLRIEIGPRDVTNKQVRVVRRDNGEKIDIPMADLVKVKELLDDVQQSMFNVAKQKRDACVEVTKTWDEFIKALGQKKLILAPWCDEEEVEKDVKTKTKGETGAAKTLCSPFEQPELPEGTLCFASGKPAKKWTYWGRSY

SEQ ID NO: 7383 - protein, 511 aa, Prunus mume
MADAGAKKSNTNTKGGGKKKEVKKETGLGLSKKKDENFGEWYSEVVVHSEMIEYYDISGCYILRPWTMSIWETMQAFFDAEIKKMKVKNTYFPLFVSPGVLEKEKDHVEGFAPEVAWVTKSGKSELEVPIAIRPTSETVMYPYFSKWIRGHRDLPLKLNQWCNVVRWEFSNPTPFIRSREFLWQEGHTAFATQAEADEEVLEILELYKRIYEEYLAIPVVKGKKSELEKFAGGLYTTSVEAFIPNTGRGVQGATSHCLGQNFAKMFGIEFENEKGGKAMVWQNSWAYSTRTIGVMVMVHGDDKGLVLPPKVAATQVIVVPVPYKDTNTKEMFEACLRTVDTLTEAGFRVEADLRDNYGPGWKYSHWEMKGVPLRIEIGPRDLEKKQVRLARRDNSDKLDIPVSNLVEQVKNILDRIQENLFDVAKQKRDASIRVAKTWDEFMEALNQKKMILAPWCDEMEVEEDVKKRTKGEIGAAKSLCTPFEQPELPEGTLCFASGKPAKKWTYWGRSY

SEQ ID NO: 7384 - protein, 566 aa, Flaveria ramosissima
AKADKSTAAAKSSKGRKKETGLGLTNTKDGNFGEWYSEVVTNGEMIEYYEISGCYILRPWTMAIWEIMQNFFDPEIKKMKIKTCYFPLFVSNNVLQKEKDHIEGFAPEVAWVTRSGDSDLEVPIAIRPTSETVMYPYFSKWIRGHRDLPLKLNQWCNVVRWEFSNPTPFIRSREFLWQEGHTAHATKEEADTEVLEILELYRRLYEEYLAVPVVKGKKSELEKFAGGLYTTSVEAFIPNTGRGVQGATSHCLGQNFAKMFEINFEDEKGEKAMVWQNSWAYSTRTIGVMVMVHGDDKGLVLPPKVAAVQVIVIHVPYKDADVKEIMNACSATVKTLCDLGIRAEADLRENYSPGWKYSHWEMKGVPLRIEIGPKDLANNQVRAVRRDNGEKVDIPMADLVDKVKGMLDNIQQNMFDVAKQKRDACIQVTKTWDEFIEALGQKKLILAPWCDEEEVEKEVKTKTKGETGAAKTLCSPFDQPELPEGTLCFASGKPDKKWTYWDEVINIIHDFIFLFSIPYQVLENFMSLTICYDLCFVFLKPRKLTGFIRIRLYYLYSNLDLKYVFI

SEQ ID NO: 7385 - protein, 545 aa, Ricinus communis
MASGGKGKKKEVKKETGLGLSFKKEEQFGEWYSDVVVSGEMIEYYDISGCYILRPWAMSIWEVMQTFFDAEIKKMKIKNCYFPLFVSSSVLEKEKDHIEGFAPEVAWVTKSGKSDLEIPIAIRPTSETVMYPYYSKWIRGHRDLPLKLNQWCNVVRWEFSNPTPFIRSREFLWQEGHTAFATKEEADEEVLQILELYRCIYEEFLAVPVVKGKKSEREKFAGGLYTTSVEAFIPNTGRGIQGATSHCLGQNFAKMFEINFENEKGEKGMVWQNSWAYSTRTIGVMVMVHGDDKGLVLPPKVASVQVIVIPVPYKDADTQGIFDACTETVDALCKVGIRAESDFRDNYSPGWKYSHWEVKGVPLRIEIGPKDLANNQVRTVRRDNATKKDISRVNLVEQVKEILDAIQQSLFDAAKQKRDACIQVVRTWDEFTEALSQRKMILAPWCDEEEVEEDVKQRTKGEMGAAKSLCTPFEQPELPEGTSLWCLLRDIVLCLWKASEEMDILGQKLLEYYNSFPQLLDAFLCKASKEMDISEQGFIPMFFNV

SEQ ID NO: 7386 - protein, 471 aa, Cucumis sativus
MIEYYDISGCYILRPWAISIWETMQVFFDAEIKQMKIKNCYFPLFVSPGVLQREKDHIEGFAPEVAWVTKSGESDLEVPIAIRPTSETVMYPYYSKWIRGHRDLPLKLNQWCNVVRWEFSHPTPFIRQLLVLVLIFLSREFLWQEGHTAFATKDEADTEVLEILELYRRIYEEYLAIPVIKGKKSEMEKFAGGLYTTSVEAFIPNTGRGIQGATSHCLGQNFAKLFEINFENEKGEKAMVWQNSWAYSTRTIGVMVMVHGDDKGLVLPPKVASVQVIIVPVPYKDADTQGIFDACSATLDTLTAAGIRAEVDSRDNYSPGWKYSHWEMKGVPLRIEIGPKDLANNQVRAVRRDNSGKKDIPRDSLVEQVKELLESIQQSLFDAAKVKRDTCIQVINTWEEFTEALGQKKMILAPWCDEEEVEKDVKTRTKGEMGAAKTLCSPFDQPALPEGTKCFASGKPAKKWSYWGRSY

SEQ ID NO: 7387 - protein, 507 aa, Amaranthus tuberculatus
MAGEGNSKPKSGGKKKEVKKETGLGLTHKKDDNFGEWYSEVVVNAEMIEYYDISGCYILRPWTMAIWEAMQEFFDAEIKKMKIKNCYFPLFVSPGVLQKEKDHIEGFAPEVAWVTKSGQSELEVPIAIRPTSETVMYPYYSKWIRGHRDLPLRLNQWCNVVRWEFSNPTPFIRSREFLWQEGHTAFATQEEADAEVLDILELYRKIYEEFLAVPVIKGKKSEMEKFAGGYYTTSVEAFIPNTGRGVQGATSHCLGQNFAKMFEITYENEKGEKAMVWQNSWAYSTRTIGVMVMTHGDDKGLVLPPKVGAVQVIVVPVPFKDADTQGIFDACSSTVNILSEAGIRAEADLRDNYSPGWKYSHWEMKGVPLRLEIGPKDLANSQVRAVRRDNSAKKDLPMANLVDQVKELLDAIQKNLFDLAKEKRDACVQKVRTWDEFVEALAKKKLIFAPWCDEEEVEKDVKARTKGEMGAAKTLCSPFDQPEMEEGTLCFASGKPAKKWTYWGRSY

SEQ ID NO: 7388 - protein, 513 aa, Ambrosia trifida
MAGKGDKPAKQDKSAAASKSSKGRKKETGLGLTNTKDGNFGEWYSEVVTNGEMIEYYEISGCYILRPWTMAIWETMQNFFDPEIKKMNIKTCYFPLFVSNNVLQKEKDHIEGFAPEVAWVTRSGDSDLEVPIAIRPTSETVMYPYFSKWIRGHRDLPLRLNQWCNVVRWEFSNPTPFIRSREFLWQEGHTAFATREEADTEVLDILELYRRLYEEYLAVPVVKGRKSELEKFAGGLYTTSVEAFIPNTGRGVQGATSHCLGQNFAKMFEINFEDEKGEKAMVWQNSWAYSTRTIGVMVMVHGDDKGLVLPPKVSAVQVIVVHVPYKDADVKEIINACSATVKTLCEAGIRAEADLRENYSPGWKYSHWEMKGVPLRIEIGPKDLANNQVRAVRRDNGAKVDIPMAGLVDSINGMLDTIQQSMFDVAKQKRDACIQVTKTWDEFIEALGQKKLILAPWCDEEEVEKEVKAKTKGETGAAKTLCSPLEQPELPEGTLCFASGKPAKTWTYWGRSY

SEQ ID NO: 7389 - protein, 495 aa, Citrullus lanatus
MAGPKPGSSATNPKTGGKKKEVKKETGLGLTNKKDDNFGEWYSEVVVSGEMIEYYDISGCYILRPWAISIWETMQVFFDAEIKKMKIKNCYFPLFVSPGVLQREKDHIEGFAPEVAWVTKSGESDLEVPIAIRPTSETVMYPYYSKWIRGHRDLPLKLNQWCNVVRWEFSHPTPFIRSREFLWQEGHTAFATKDEADTEVLEILELYRRIYEEYLAIPVIKGKKSEMEKFAGGLYTTSVEAFIPNTGRGIQGATSHCLGQNFAKMFEINFENEKGEKAMVWQNSWAYSTRTIGVMVMVHGDDKGLVLPPKVASVQVIIVPVPYKDADTQGIFDACSATLDTLSEAGIRAEVDSRDNYSPGWKYSHWEMKGVPLRIEIGPKDLANNQVRAVRRDNSGKKDIPRDSLVEQVKELLESIQQSLFDAAKEKRDTCIQVINTWEEFTEALSQKKMILAPWCDEEEVEKDVKTRTKGEMGAAKTLCSPFEQPALPEGTKFL

SEQ ID NO: 7390 - protein, 310 aa, Amaranthus tuberculatus
MAGEGKAKSGGKKKEVKKETGLGLTHKKDDNFGEWYSEVVVNAEMIEYYDISGCYILRPWTMAIWEAMQEFFDAEIKKMKIKNCYFPLFVSPGVLQKEKDHIEGFAPEVAWVTKSGQSELEVPIAIRPTSETVMYPYYSKWIRGHRDLPLRLNQWCNVVRWEFSNPTPFIRSREFLWQEGHTAFATQEEADAEVLDILELYRKIYEEYLAVPVIKGKKSEMEKFAGGYYTTSVEAFIPNTGRGVQGATSHCLGQNFAKMFEITYENEKGEKAMVWQNSWAYSTRTIGVMVMTHGDDKGLVCLQKLQLFKS

SEQ ID NO: 7391 - protein, 507 aa, Chrysanthemum coronarium
MAGGKGDKPAATKSAKGRKKETGLGLTNTKDGNFGEWYSEVVTNGEMIEYYEISGCYILRPWTMAIWETMQNFFDPEIKKMNIKTCYFPLFVSNTVLQKEKDHIEGFAPEVAWVTRSGSSDLEVPIAIRPTSETVMYPYFSKWIRGHRDLPLRLNQWCNVVRWEFSNPTPFIRSREFLWQEGHTAFATKEEADTEVLEILELYRRLYEEYLAVPVVKGKKSELEKFAGGLYTTSVEAFIPNTGRGVQGATSHCLGQNFAKMFEINFEDEKGEKAMVWQNSWAYSTRTIGVMVMVHGDDKGLVLPPKISAVQVIVIHVPFKDADVKEIMNACSATVKTLCDLGIRAEADLRENYSPGWKYSHWEMKGVPLRIEIGPKDLANNQVRAVRRDNGSKVDLPMADLGEKVKGMLDDIQQSMFDVAKQKRDACIQVTKTWDEFIEALGQKKLILAPWCDEEEVEKDVKAKTKGEVGAAKTLCSPFDQPELPEGTLCFASGKPAKKWTYWGRSY

SEQ ID NO: 7392 - protein, 516 aa, Aristolochia fimbriata
MANDGTGSLKSLKISGNTSKAAKKKEVKKESGLGLTNKKDENFGEWYSEVVVNAEMIEYYDISGCYILRPWSIGIWEILHDFFDPEIKKMEIENCYFPLFVSPGVLQREKDHIEGFAPEVAWVTKSGSTDLEVPIAIRPTSETVMYPYYSKWIRGHRDLPLKLNQWCNVVRWEFSHPTPFIRSREFLWQEGHTAFASKEEADEEVLQILELYRRVYEEYLAVPVIKGKKSELEKFAGGLYTTSVEAFIPNTGRGIQGATSHCLGQNFAKMFEINFEDEKGEKRMAWQNSWAYSTRTIGVMVMVHGDDKGLVLPPKVASVQVIVIPVPYKDANTQGIFDACSATVKTLSEAGFRVKKDVRDNYSPGWKYSHWEMKGVPLRIEIGPKDLANNQVHVARRDNGAKTDIPMSKLVDEVANILSNIQQSMFDAAKQKRDACVVVIKTWDEFMTALNKKKLILAPWCDEEEVEKDVKARTKGEMGAAKTLCTPFDQPELPEGTLCFASGKPAKKWTYWGRSY

SEQ ID NO: 7393 - protein, 495 aa, Solanum phureja
GKMKEVKKETGLGLSYKKDENFGEWYSEVVVSGEMIEYYDISGCYILRPWSMSIWEILHGFFDAEIKKMKIKNSYFPLFVSPAVLQKEKDHIEGFAPEVAWVTKSGDSDLEVPIAIRPTSETVMYPYFSKWIRGHRDLPLRLNQWCNVVRWEFSNPTPFIRSREFLWQEGHTAFATKEESDAEVLEILELYRRIYEELLAVPVSKGKKSELEKFAGGLYTTTVEAFIPNTGRGIQGATSHCLGQNFARIFEINFENEKGEKAMVWQNSWGFSTRTIGVMIMVHGDDKGLVLPPKVASTQVVVIPVPYKDANTQGIYDACAATVREMNESGIRAEADFRDNYSPGWKYSHWEMKGVPLRIEIGPKDFANNQVRAVRRDNGAKTDIPMANLAEQVKDLLATIQQNLFDVAKQKRDACVQIVRTWDEFTVALGQKKLVLAPWCDEEDVEKDVKARTKGEMGSVKTLCSPFDQPELPEGTLCFASGKPAKKWTYWGRSY

SEQ ID NO: 7394 - protein, 493 aa, Solanum lycopersicum
MKEVKKETGLGLSYKKDENFGEWYSEVVVSGEMIEYYDISGCYILRPWSMSIWEILQGFFNAEIKKMKIKNSYFPLFVSPAVLQKEKDHIEGFAPEVAWVTKSGDSDLEVPIAIRPTSETVMYPYFSKWIRGHRDLPLRLNQWCNIVRWEFSNPTPFIRSREFLWQEGHTAFARKEESDAEVLEILELYRRIYEDLLAVPVSKGKKSELEKFAGGLYTTTVEAFIPNTGRGIQGATSHCLGQNFARIFEINFENEKGEKAMVWQNSWGFSTRTIGVMIMVHGDDKGLVLPPKVASTQVVVIPVTYKDANTQGIYDACAATVREMNESGIRAEADFRENYSPGWKYSHWEMKGVPLRIEIGPKDLANNQVRAVRRDNGDKTDIPMANLAEQVKDMLATIQQNLFDVAKQKRDACIQIVRTWDEFTVALGQKKLILAPWCDEEDVEKDVKARTKGEMGAAKTLCSPFDQPELPEGTLCFASGKPAKKWTYWGHSY

SEQ ID NO: 7395 - protein, 616 aa, Medicago truncatula
MSATLDTVAAVHQEPWSPLVIGTTPYLTAEVFLSADDFIFPRQLTAEGLVAREYTESLLARSIALARSILSRLLSNSTRIRCSSSFTMAGTDDNITQQQSAAKPQKQPKQPKQPKPQQSGGGKKKEVKKETGLGLTNKKAENFGEWYSEVVVNGEMIEYYDISGCYILRPWSMAIWEIMQAFFDPEIKKMKIKNCYFPLFVSNTVLEKEKDHIEGFAPEVAWVTKSGESDLEIPIAIRPTSETVMYPYYSKWIRGHRDLPLKLNQWCNVVRWEFSNPTPFIRSREFLWQEGHTAFATKEEADTEVLEILELYRRIYEEYLAVPVVKGKKSELEKFAGGLYTTSVEAFIPNTGRGIQGATSHCLGQNFAKMFEINYENEKGEKAMVWQNSWAYSTRTIGVMVMVHGDDKGLVLPPKVASVQVIVIPVPYKDADTQGIFDACTATVNMLLEAGIRAESDARDNYSPGWKYSQWEMKGVPLRIEIGPKDLANKQVRAVRRDSGAKIDIGNDDLVVEIKKLLDNIQQNLFDVAKHKRDACIQIIHTWDEFVAALNEKKMILAPWCDEEEVEKDVKARTKGETGAAKTLCSPFDQPELPEGTVCFASGKPAKKWSYWGKSY

SEQ ID NO: 7396 - protein, 512 aa, Cichorium intybus
MAGGKGEKSANAKKSADAKSSKGRKKETGLGLTNTKDGNFGEWYSEVVTNGEMIEYYEISGCYILRPWTMSIWEIMQSYFDAEIKKMKIKTCYFPLFVSNTVLQKEKDHIEGFAPEVAWVTRSGDSDLEVPIAIRPTSETVMYPYFSKWIRGHRDLPLKLNQWCNVVRWEFSNPTPFIRSREFLWQEGHTAFATKEEADTEVLEILELYRRLYEEYLAVPVVKGKKSEMEKFAGGLYTTSVEAFIPNTGRGVQGATSHCLGQNFAKMFEINFEDEKGEKSMVWQNSWAYSTRTIGVMVMVHGDDKGLVLPPKVAAVQVIIVNVPFKEADTDKIKNACLETVKTLCDLGIRAEADLRENYSPGWKYSHWEMKGVPLRIEIGPRDVANNQVVVARRDNGEKVSVPMADLVKVKDLLDDVQQNMFNVAKQKRDACVEVIKTWDEFIKALGQKKLILAPWCDEEEVEKEVKTKTKGETGAAKTLCSPFDQPELPEGTLCFASGKPAKKWTYWGRSY

SEQ ID NO: 7397 - protein, 422 aa, Ambrosia trifida
MLFPLFVSNNVLQKEKDHIEGFAPEVAWVTRSGDSDLEVPIAIRPTSETVMYPYFSKWIRGHRDLPLRLNQWCNVVRWEFSNPTPFIRSREFLWQEGHTAFATQEEADTEVLEILELYRRLYEEYLAVPVVKGRKSELEKFAGGLYTTSVEAFIPNTGRGVQGATSHCLGQNFAKMFEINFEDEKGEKAMVWQNSWAYSTRTIGVMVMVHGDDKGLVLPPKVSAVQVIVVHVPYKDADVKEIINACSATVKTLCEAGIRAEADLRENYSPGWKYSHWEMKGVPLRIEIGPKDLANNQVRAVRRDNGAKLDIPMADLAASVKGMLDTIQQSMFDVAKQKRDACIQVTKTWDEFIEALGQKKLILAPWCDEEEVEKEVKAKQKGRRGLLRRSALHWCSQNSLKVHYALHPGNQTKKWTYWGRSY

SEQ ID NO: 7398 - protein, 509 aa, Arnica chamissonis
MAGAKGDKPAKANKSASVAKSSKGRKKETGLGLTNTKDGNFGEWYSEVVTNGEMIEYYEISGCYILRPWTMAIWEIMQNFFDPEIKKMKIKTCYFPLFVSNNVLQKEKDHIEGFAPEVAWVTRSGDSDLEVPIAIRPTSETVMYPYFSKWIRGHRDLPLKLNQWCNVVRWEFSNPTPFIRSREFLWQEGHTAFATKEEADTEVLEILELYRRLYEEYLAVPVVKGKKSEMEKFAGGLYTTSVEAFIPQTGRGVQGATSHCLGQNFAKMFEINFEDEKGEKAMVWQNSWAYSTRTIGVMVMVHGDDKGLVLPPKVSAVQVIVIHVPYKDADVKEIINACSATVKTLCDLGIRAEADLRENYSPGWKYSHWEMKGVPLRIEIGPKDLANNQVRAVRRDNGEKIDIPMEDLVDKVKGMLDNIQQSMFDVAKQKRDACIQVTKTWDEFIEALGQKKLILAPWCDEEEVEKEVKTKTKGETGAAKTLCSPFDQPEMPEGTLCFASGKPAKKWTY

SEQ ID NO: 7399 - protein, 513 aa, Silene vulgaris
MASTGEGKGKGKSTSKSGGKKKEVKKETGLGLSFKKDENFGEWYSEVVVNGEMIEYYDISGCYILRPTSMSIWDILKDFFDDKIKKMKIKNCYFPLFVSPGVLEKEKDHIEGFAPEVAWVTKSGKSDLEVPIAIRPTSETVMYPYFSKWIRGHRDLPLRLNQWCNVVRWEFSNPTPFIRSREFLWQEGHTAFATQAEADAEVLQILELYRQVYEDYLAVPVVKGKKSELEKFAGGYYTTSVEAFIPHTGRGVQGATSHCLGQNFAKMFDITFENEKGEKAMVWQNSWAYSTRTIGVMVMTHGDDKGLVLPPKVAELQIIVVPVPFKDADMQGIYDACTSTVNTLIDAGFRAEADLRDNYSPGWKYSQWEMKGVPLRIEIGPKDLAKSQVRVVRRDNSAKVDIPMADLVDQVKEVLDQIQQNLFEVAKQKRDACIQVIKTWEEFADALAHKKLILAPWCDEEAVEKDVKARTKGEMGAAKTLCTPFDQPEMEEGTVCFASGKPAKKWTYWGRSY

SEQ ID NO: 7400 - protein, 522 aa, Arabidopsis lyrata
MAGPSEKKEKVKKEKVVKEKVAKASSIGQKKKDVKKETGLGLSVKKDENFGDWYSEVCKQDMIEYYDISGCYILRPWSMAIWEIMQIFFDAEIKKMKVKNCYFPLFVSPAVLEKEKDHIEGFAPEVAWVTKSGKSDLEIPIAIRPTSETVMYPYYSKWIRGHRDLPLKLNQWCNVVRWEFSNPTPFIRSREFLWQEGHTAFATKAEADEEVLQILELYRRIYEEYLAVPVVKGMKSENEKFAGGLYTTSVEAFIPNTGRGVQGATSHCLGQNFAKMFEINYENEKAETAMVWQNSWAYSTRTIGVMIMTHGDDKGLVLPPKVASVQVVVIPVPYKDANTQGIYDACTATASALCEAGIRAEEDLRDNYSPGWKYSDWEMKGVPLRIEIGPRDLENDQVRTVRRDNGVKEDIPRGSLVENVKELLEKIQQNMYEVAKQKREACVQEVKTWDEFIKALNEKKLILAPWCDEEEVERDVKARTKGETGAAKTLCSPFDQPELPEGTLCFASGKPAKKWTYWGRSY

SEQ ID NO: 7401 - protein, 247 aa, Eschscholzia californica
MFEINFENEKGEKGMVWQNSWAYSTRTIGVMVMVHGDDKGLVLPPKVASVQVIVIPVPYKDADMQAIFDACSSTVEKLNEAGFRAEADLRDNYSPGWKYSHWELKGVPLRIEIGPKDMANNQVRVVRRDNGSKVDIPNANLVDQIKDVLDNIQQSLFDAAKLKRDASVTIAKTWEEFITALNEKKMILAPWCDEEEVERDVKARTKGETGAAKTLCTPFDQPELPEGTLCFASGKPATKWTYWGRSY

SEQ ID NO: 7402 - protein, 384 aa, Plantago ovata
MPIAIRPTSETVMYPYFSKWIRGHRDLPLRLNQWCNVVRWEFSNPTPFIRSREFLWQEGHTAFATKEEADAEVLDILELYRRIYEEFLAVPVFKGRKSEHEKFAGGLYTTSIEAFIPNTGRGVQGATSHCLGQNFAKMFEINFENEKGEKGMVWQNSWAYTTRTIGVMIMVHGDDKGLVLPPKVASLQVIVIPVPYKDADMQGIYKACEDTVKSLTEAGLRAESDLRDNYSPGWKYSNWELKGVPIRIEIGPKDFEKNQVRAVRRDNGAKSDIPMADLVEKVNEMLDNIQKSLFDAAKQKRDACIQVVHTWEEFTEALGQRKMILAPWCDEEEVEKDVKARTKGEMGAAKTLCTPFAQPELPEGTLCFASGKPVKKWTYWGRSY

SEQ ID NO: 7403 - protein, 525 aa, Eutrema parvulum
MAGPSGKKEKVEKAGPSGKKEKVEKAGPGGGKKKKDVKKETGLGLSVKKDENFGEWYSEVCKHEMIEYYDISGCYILRPWSMAIWEIMQSFFDAEIKKMKVKNCYFPLFVSPGVLEKEKDHVEGFAPEVAWVTKSGKSDLEVPIAIRPTSETVMYPYYSKWIRGHRDLPLKLNQWCNVVRWEFSNPTPFIRSREFLWQEGHTAFATKEEADEEVLQILELYRRIYEEYLAVPVVKGMKSENEKFAGGLYTTSVEAFIPNTGRGVQGATSHCLGQNFAKMFEINYENEKGETAMVWQNSWAYSTRTIGVMIMTHGDDKGLILPPKVASVQVVVIPVPYKDANTQGIFDACTATVSALLEAGIRAEEDLRDNYSPGWKYSNWEMKGVPLRIEIGPRDLENDQVRTVRRDNGVKEDIPRGSLVKHVKELLDTIQQNMFEVAKQKREACVQEIKTWDEFVEALNTKKLILAPWCDEEEVERDVKARTKGETGAAKTLCSPFEQPELPEGTLCFASGKPAKKWTYWGRSY

SEQ ID NO: 7404 - protein, 461 aa, Papaver somniferum
MIEYYDISGCYILRPWSMAIWEIMQTFFDAEIKKMKIKNCYFPVFVSSTVLQKEKDHIEGFAPEVAWVTKSGDTDLEVPIAIRPTSETVMYPYFSKWIRGHRDLPLRLNQWCNVVRWEFSNPTPFIRSREFLWQEGHTAFATKDEADQEVLEVLELYRRIYEEFLAIPVVKGKKSENEKFAGGLYTTSVEAFVPNTGRGVQGATSHCLGQNFAKMFEINFENEKGEKGMVWQNSWAYSTRTIGVMVMVHGDDKGLVLPPKVASVQVIVIPVPYKDADTQAICDACSETAEELNKAGFRAETDLRDNYSPGWKYSNWELKGVPLRIEIGPKDMAKNQVRVVRRDNGAKEDISRTNLVDHIKDLLENVQQSLFDAAKQKRDACVTVAKTWEEFTKALNEKRMILAPWCDEEEVERDVKARTKGEMGACKTLCTPFDQPELPEGTLCFASGKPAKKWTYWGRSY

SEQ ID NO: 7405 - protein, 545 aa, Aquilegia formosa
MDNNQEEKVMNSLKEIEIESSTDNKNNNKAKKEKKKPSSSSSDKKTGGGGSKKKEVKKETGLGLTNKKDDNFGEWYSEVVVASEMIEYYDISGCYILRPWTMSIWEIMQTFFDAEIKKMKVKNCYFPVFVSGSALRREEDHIEGFAPEVAWVTKSGDTELDLPIAIRPTSETVMYPYYSKWIRGHRDLPLKLNQWCNVVRWEFSHPTPFIRSREFLWQEGHTAFATKEEADEEVLDILELYRRVYEEFLAIPVVKGKKSELEKFAGGLYTTSVEAFIPNTGRGIQGATSHCLGQNFAKMFDINFENEKGERGMVWQNSWAYSTRTIGVMVMVHSDDKGLVLPPKVASVQVVVVPVPYKDADMQGIFDACTNTVKTLNEAGFRAEEDLRENYSPGWKYSHWEMKGVPVRIEIGPKDMANKQVRVVRRDNSSKMDIPTSNLVEKIKDVLDDIQQSLFDSAKQKRDACIKVAKTWEEFTTALNEKKLILAPWCDEEEVEKDVKARTKGEMGACKTLCTPFDQPELPEGTLCFASGKLAKKWTYWGRSY

SEQ ID NO: 7406 - protein, 523 aa, Artemisia annua
KRSGGERKEKKEKAAGSKGDNKPAAPPTKSAKGRKKETGLGLTNTKDGNFGEWYSEVVTNGEMIEYYEISGCYILRPWTMAIWETMQNFFDPEIKKMNIKTCYFPLFVSNTVLQKEKDHIEGFAPEVAWVTRSGSSDLEVPIAIRPTSETVMYPYFSKWIRGHRDLPLRLNQWCNVVRWEFSNPTPFIRSREFLWQEGHTAFATKEEADTEVLEILELYRRLYEEYLAVPVVKGKKSELEKFAGGLYTTSVEAFIPNTGRGVQGATSHCLGQNFAKMFEINFEDEKGEKAMVWQNSWAYSTRTIGVMVMVHGDDKGLVLPPKISAVQVIVIHVPFKDADVKEIMNACSATVKALCDLGIRAEADLRENYSPGWKYSHWEMKGVPLRIEIGPKDLANNQVRAVRRDNGSKVDLPMADLGEKVKGMLDDIQQSMFDVAKEKRDACIQVTKTWDEFIEALGQKKLILAPWCDEEEVEKDVKAKTKGEVGAAKTLCSPFDQPELPEGTLCFASGKPAKKWTYWGRSY

SEQ ID NO: 7407 - protein, 496 aa, Amaranthus tuberculatus
GGKKKEVKKETGLGLTHKKDDNFGEWYSEVVVNAEMIEYYDISGCYILRPWTMAIWEAMQEFFDAEIKKMKIKNCYFPLFVSPGVLQKEKDHIEGFAPEVAWVTKSGQSELEVPIAIRPTSETVMYPYYSKWIRGHRDLPLRLNQWCNVVRWEFSNPTPFIRSREFLWQEGHTAFATQEEADAEVLDILELYRKIYEEFLAVPVIKGKKSEMEKFAGGYYTTSVEAFIPNTGRGVQGATSHCLGQNFAKMFEITYENEKGEKAMVWQNSWAYSTRTIGVMVMTHGDDKGLVLPPKVAAVQVIVVPVPFKDANTQGIFDACSNTVKVLSEAGIRAEADLRDNYSPGWKYSHWEMKGVPLRLEIGPKDLANSQVRAVRRDNSAKKDLPMANLVDEVKELLDAIQKNLYDLAKEKRDACVQKVRTWDEFVEALAQKKLIFAPWCDEEEVEKDVKARTKGEMGAAKTLCSPFDQPEMEEGTLCFASGKPAKKWTYWGRSY

SEQ ID NO: 7408 - protein, 526 aa, Trifolium pratense
MAGTEATKQQSGAGAKQPKQPKPQKQQQSGGGKKKEVKKETGLGLTNKKADNFGEWYSEVVVNGEMIEYYDISGCYILRPWSMAIWENMQAFFDPEIKKMKIKNCYFPVFVSSTVLEKEKDHIEGFAPEVAWVTRSGKSELEIPIAIRPTSETVMYPYYSKWIRGHRDLPLKLNQWCNVVRWEFSNPTPFIRSREFLWQEGHTAFATKEEADTEVLEILELYRRIYEEYLAVPVIKGKKSELEKFAGGLYTTSVEAFIPNTGRGIQGATSHCLGQNFAKMFDINYENEKGERAMVWQNSWAYSTRTIGVMVMVHGDDKGLVLPPKVASVQVIVIPVPYKDADTQGILDACSATVTALVEAGIRAESDSRDNYSPGWKYSQWEMKGVPLRIEIGPKDLANKQVRAVRRDSGAKIDIANADLVEEIKKLLDNIQQNLFDVAKQKRDECIQVIHTWDEFIEALNQKKMILAPWADEKEVEEDVKARTKGETGAAKTLCSPFDQPELPEGTTCFASGKPAKKWSYWGRSY

SEQ ID NO: 7409 - protein, 520 aa, Prunus persica
MADAGAKKSNTDAGAKKSNTNAKSGGKKKEVKKETGLGLSKKKDENFGEWYSEVVVHSEMIEYYDISGCYILRPWTMSIWETMQAFFDAEIKRMKVKNTYFPLFVSPGVLEKEKDHVEGFAPEVAWVTKSGKSELEVPIAIRPTSETVMYPYFSKWIRGHRDLPLKLNQWCNVVRWEFSNPTPFIRSREFLWQEGHTAFATQAEADEEVLEILELYRRIYEEYLAIPVVKGKKSELEKFAGGLYTTSVEAFIPNTGRGVQGATSHCLGQNFAKMFGIEFENEKGGKAMVWQNSWAYSTRTIGVMVMVHGDDKGLVLPPKVAATQVIVVPVPYKDTNTKEMFEACLRTVDTLTEAGFRVEADLRDNYGPGWKYSHWEMKGVPLRIEIGPRDLEKKQVRLARRDNSDKLDIPVSNLVEQVKDILDRIQENLFEVAKQKRDASIRVAKTWDEFMEALNQKKMILAPWCDEMEVEEDVKKRTKGEIGAAKSLCTPFEQPELPEGTLCFASGKPAKKWTYWGRSY

SEQ ID NO: 7410 - protein, 524 aa, Fragaria vesca
MADIADKKPNVNAKVKKAKGGGGGGGGGGGKKKEVKKETGLGLTKKKDENFGEWYSEVVVHGEMIEYYDISGCYILRPWTMAIWEIMQAFFDAEIKKMKIKNCYFPLFVSPAVLEKEKDHIEGFAPEVAWVTKSGKSELEVPIAIRPTSETVMYPYYSKWIRGHRDLPLKLNQWCNVVRWEFSNPTPFIRSREFLWQEGHTAFATKEEADKEVLEILELYRRIYEEFLAIPVVKGKKSENEKFAGGLYTTSVEAFVPNTGRGVQGATSHCLGQNFAKMFDITFENEKGEKAMIWQNSWAYSTRTIGVMVMVHGDDKGLVLPPKVASVQAVVIPVPFKDADTQAIFDACLKTVEELTEAGLRVEADLRDNYSPGWKYSHWELKGVPLRIEIGPKDLEKKQVRLARRDNSSKVDIPMVDLVKEVKETLEKIQQNLFDVAKQKRDASIQLAKTWDEFTAALGEKKLILAPWCDEQAVEEDVKARTKGEIGAAKSLCSPFDQPELPEGTLCFASGKPAKKWTYWGRSY

SEQ ID NO: 7411 - protein, 512 aa, Cichorium intybus
MAGGKGEKSANAKKSADAKSSKGRKKETGLGLTNTKDGNFGEWYSEVVTNGEMIEYYEISGCYILRPWTMSIWEIMQSYFDAEIKKMKIKTCYFPLFVSNTVLQKEKDHIEGFAPEVAWVTRSGDSDLEVPIAIRPTSETVMYPYFSKWIRGHRDLPLKLNQWCNVVRWEFSNPTPFIRSREFLWQEGHTAFATKEEADTEVLEILELYRRLYEEYLAVPVVKGKKSEMEKFAGGLYTTSVEAFIPNTGRGVQGATSHCLGQNFAKMFEVNFEDEKGEKAMVWQNSWAYSTRTIGVMVMVHGDDKGLVLPPKVAAVQVIIVNVPFKEADTDKIKNACLETVKTLCDLGIRAEADLRENYSPGWKYSHWEMKGVPLRIEIGPRDVANNQVVVARRDNGEKVSVPMADLVKVKDLLDDVQQNMFNVAKQKRDACVEVIKTWDEFIKALGQKKLILAPWCDEEEVEKEVKTKTKGETGAAKTLCSPFDQPELPEGTLCFASGKPAKKWTYWGRSY

SEQ ID NO: 7412 - protein, 513 aa, Cirsium arvense
MAGAKGDKPNNAKKSAPVAKSSKGRKKETGLGLTNTKDGNFGEWYSEVVTNGEMIEYYEISGCYILRPWTMSIWEIMQTFFDAEIKKMKIKTCYFPLFVSNNVLQKEKDHIEGFAPEVAWVTRSGDSDLEVPIAIRPTSETVMYPYFSKWIRGHRDLPLKLNQWCNVVRWEFSNPTPFIRSREFLWQEGHTAFATKEEADTEVLEILELYRRLYEEYLAVPVVKGKKSEMEKFAGGLYTTSVEAFIPNTGRGVQGATSHCLGQNFAKMFEINFEDEKGEKAMVWQNSWAYSTRTIGVMVMTHGDDRGLVLPPKVAAIQVIVIHVPYKDADIKEILNACSATVKALCDLGIRAEADLRENYSPGWKYSHWEMKGVPLRIEIGPKDLANNQVRAVRRDNAAKTDIPMDGLVDKVKSMLNDIQQNMFDVAKQKRDACVQVVKTWDEFIEALSQKKLILAPWCDEEEVEKDVKTKTKGETGAAKTLCSPFDQPELPEGMLCFASGKPAKNGRTGDEL

SEQ ID NO: 7413 - protein, 512 aa, Cichorium intybus
MAGGKGEKSANAKKSADAKSSKGRKKETGLGLTNTKDGNFGEWYSEVVTNGEMIEYYEISGCYILRPWTMSIWEIMQSYFDAEIKKMKIKTCYFPLFVSNTVLQKEKDHIEGFAPEVAWVTRSGDSDLEVPIAIRPTSETVMYPYFSKWIRGHRDLPLKLNQWCNVVRWEFSNPTPFIRSREFLWQEGHTAFATKEEADTEVLEILELYRRLYEEYLAVPVVKGKKSEMEKFAGGLYTTSVEAFIPNTGRGVQGATSHCLGQNFAKMFEIDFEDEKGEKAMVWQNSWAYSTRTIGVMVMVHGDDKGLVLPPKVAAVQVIIVNVPFKEADVDKIKNACLETVKTLCDLGIRAEADLRENYSPGWKYSHWEMKGVPLRIEIGPRDVANNQVVVARRDNGEKVSVPMADLVKVKDLLDDVQQNMFNVAKQKRDACVEVIKTWDEFIKALGQKKLILAPWCDEEEVEKEVKTKTKGETGAAKTLCSPFDQPELPEGTLCFASGKPAKKWTYWGRSY

SEQ ID NO: 7414 - protein, 512 aa, Cichorium intybus
MAGGKGEKSANAKKSADAKSSKGRKKETGLGLTNTKDGNFGEWYSEVVTNGEMIEYYEISGCYILRPWTMSIWEIMQSYFDAEIKKMKIKTCYFPLFVSNTVLQKEKDHIEGFAPEVAWVTRSGDSDLEVPIAIRPTSETVMYPYFSKWIRGHRDLPLKLNQWCNVVRWEFSNPTPFIRSREFLWQEGHTAFATKEEADTEVLEILELYRRLYEEYLAVPVVKGKKSEMEKFAGGLYATSVEAFIPNTGRGVQGATSHCLGQNFAKMFEIDFEDEKGEKSMVWQNSWAYSTRTIGVMVMVHGDDKGLVLPPKVAAVQVIIVNVPFKEADADKIKNACLETVKTLCDLGIRAEADLRENYSPGWKYSHWEMKGVPLRIEIGPRDVANNQVVVARRDNGEKVSVPMADLVKVKDLLDDVQQNMFNVAKQKRDACVEVIKTWDEFIKALGQKKLILAPWCDEEEVEKEVKTKTKGETGAAKTLCSPFDQPELPEGTLCFASGKPAKKWTYWGRSY

SEQ ID NO: 7415 - protein, 532 aa, Triphysaria pusilla
MAGKDAKIKDAKIKDAKIKDAKSSTGSGKDAKSSAGKGKKKEVKKETGLGLSYKKDENFGEWYSEVVVSGEMIEYYDISGCYILRPWAMSIWEVMQTFFDAEIKKMKIKNCYFPLFVSSNVLQKEKDHIEGFAPEVAWVTKSGESDLEMPIAIRPTSETVMYPYFSKWIRGHRDLPLRLNQWCNVVRWEFSNPTPFIRSREFLWQEGHTAFATKEEADTEVLDILELYRRIYEEFMAVPVIKGKKSEHEKFAGGLYTTTVEAFIPNTGRGVQGATSHCLGQNFAKMFEINFEDDKGEKAMVWQNSWAYTTRTIGVMIMVHGDNKGLVLPPKVASLQVVVIPVPYKDANTQGIYDACADTVKSLAEAGIRAEADYRDNYSPGWKYSHWELKGVPLRIEIGPKDLANNQVRAVRRDNSAKNDIPMADLVEQVKNTLDDIHQSLFDAAKQKRDACIQTVSTWEEFTEALGEKKMILAPWCDEEEVEKDVKARTKGEMGAAKSLCSPFDQPAIPEGTLCFASGKPAKKWTYWGRSY

SEQ ID NO: 7416 - protein, 452 aa, Flaveria ramosissima
MASGKGDKAAKADKSTAAAKSSKGRKKETGLGLTNTKDGNFGEWYSEVVTNGEMIEYYEISGCYILRPWTMAIWEIMQNFFDPEIKKMKIKTCYFPLFVSNNVLQKEKDHIEGFAPEVAWVTRSGDSDLEVPIAIRPTSETVMYPYFSKWIRGHRDLPLKLNQWCNVVRWEFSNPTPFIRSREFLWQEGHTAFATKEEADTEVLEILELYRRLYEKYLAVPVVKGKKSELEKFAGGLYTTSVEAFIPNTGRGVQGATSHCLGQNFVKMFEINFEDEKGEKAIVWQNSWAYSTRTIGVMVMVHGDDKGLVLPPKVAAVQVIVIHVPYKDADVKEIMNACSATVKTLCDLGIRAEADLRENYSPGWKYSHWEMKGVPLRIEIGPKDLANNQVRAVRRDNGEKVDIPMADLVDKVKGMLDNIQQNMFDVAKQKRDACIQVTKTRDEFIEALGQRN

SEQ ID NO: 7417 - protein, 236 aa, Sarracenia psittacina
MDNVNMGNYARFLRSRNKEDENKNCYFPLFVSPRCSAKRKDHIEGLPGGCMGYKSGESELEVPIAIRPTSETVMYPYYSKWIRGHRDLPLKLNQWCNVVRWEFSHPTPFIRSREFLWQEGHTAFATKEDADAEVLEILELYRRIYEEYLAIPVVKGKKSELEKFAGGLYTTSVEAFIPNTGRGIQGATSHCLGQNFAKMFEINFENEKGEKDVWFGKITWAYSTRTIGVNGDGSWG

SEQ ID NO: 7418 - protein, 466 aa, Trifolium pratense
MAGTDATKQQSGGGAKQPKQPKQPKQQQSGGGGGKKKEVKKETGLGLTNKKADNFGEWYSEVVVNGEMIEYYDISGCYILRPWSMAIWEIMQAFFDPEIKKMKIKNCYFPVFVSSTVLEKEKDHIEGFAPEVAWVTRSGKSELEIPIAIRPTSETVMYPYYSKWIRGHRDLPLKLNQWCNVVRWEFSNPTPFIRSREFLWQEGHTAFATKEEADTEVLEILELYRRIYEEYLAVPVIKGKKSELEKFAGGLYTTSVEAFIPNTGRGIQGATSHCLGQNFAKMFDINYENEKGERAMVWQNSWAYSTRTIGVMVMVHGDDKGLVLPPKVASVQVIVIPVPYKDADTQGILDACSETVNALLEAGIRAESDSRDNYSPGWKYSQWEMKGVPLRIEIGPKDLANKQVRAVRRDSGAKIDIANAGLVEEIKKLLDNIQQNLFDVAKQKRDECIQVIHTWEEFIEALNQKR

SEQ ID NO: 7419 - protein, 528 aa, Trifolium pratense
MAGTEATKQQSGAGAKQPKQPKPQKQQQSGAGGGEKKEVKKETGLGLTNKKADNFGEWYSEVVVNGEMIEYYDISGCYILRPWSMAIWENMQAFFDPEIKKMKIKNCYFPVFVSSTVLEKEKDHIEGFAPEVAWVTRSGKSELEIPIAIRPTSETVMYPYYSKWIRGHRGLPLKLNQWCNVVRWEFSNPTPFIRSREFLWQEGHTAFATKEEADTEVLEILELYRRIYEEYLAVPVIKGKKSELEKFAGGLYTTSVEAFIPNTGRGIQGATSHCLGQNFAKMFDINYENEKGERAMVWQNSWAYSTRTIGVMVMVHGDDKGLVLPPKVASVQVIVIPVPYKDADTQGILDACSATVTALVEAGIRAESDSRDNYSPGWKYSQWEMKGVPLRIEIGPKDLANKQVRAVRRDSGAKIDIANANLVEEIKKLLDNIQQNLFDVAKQKRDECIQVIHTWDEFIEALNQKKMILAPWADEKEVEEDVKARTKGETGAAKTLCSPFDQPELPEGTTCFASGKPAKKWSYWGRSY

SEQ ID NO: 7420 - protein, 505 aa, Musa acuminata
MATANANAKGARKKEVKKETGLGLTYKKNENFGEWYSEVVVNSEMIEYYDISGCYILRPWTMTIWEVLQTFFDAEIKKMNIKNAYFPLFVTESVLQREKDHIEGFAPEVAWVTKSGQSELEVPIAIRPTSETVMYPYFSKWIRGHRDLPLKLNQWCNVVRWEFSHPTPFIRSREFLWQEGHTAFATQAEADQEVLEILELYRKIYEEFLAIPVVKGRKSELEKFAGGYYTTSVEAFIPNTGRGIQGATSHCLGQNFAKMFQINFENDKGVKAMVWQNSWAYSTRTIGVMVMVHGDDKGLVLPPKVASVQVIVIPVPFKDANTDAIFSACSSTVQALREAGFRAEADLRDNYSPGWKYSHWEMKGVPLRIEIGPKDLANNQVRVVRRDNGAKSDIPMGNLVEKVKEILSSIQECLFNAAKQKRDACIKIVNTWDEFIAALNDKKMILAPWCDEEEVEKDVKARTKGELGAAKSLCTPFDQPRLPEGTLCFASGKPAKKWTYWGRSY

SEQ ID NO: 7421 - protein, 507 aa, Phalaenopsis aphrodite
MATANASTSSKNARKKEVKKETGLGLAYKKNESFGEWYSEVVVNGEMIEYYDISGCYILRPWTMVIWETMQAFFDAEIKKMNVKNAYFPLFVTENVLQKEKNHIEGFAPEVAWVTKSGQSDLEVPIAIRPTSETVMYPYFSKWIRGHRDLPLKLNQWCNVVRWEFSHPTPFIRSREFLWQEGHTAFATKEEADKEVLEILELYRRIYEEYLAIPVVKGKKSELEKFAGGLYTTSVEAFIPNTGRGIQGATSHCLGQNFAKMFEIDFENEKGEKAKVWQNSWAYSTRTIGVMVMVHGDDKGLVLPPKVAAVQVIVIPVPYKDADMQTIFEACSSTVQTLRAAGFRAEHDLRDNYSPGWKYSNWEMKGVPLRIEIGPKDIANKQVRIVRRDNGAKTDIPISCLVEQVQDVLSSIHENLFNAAKEKRDACIKVVHTWEEFMTALNDKKLILTPWCDEEEVEKNVKTRTKGELGSAKTLCTPFDQPSLPEGTLCFASGKPAKKWTYWGRSY

SEQ ID NO: 7422 - protein, 505 aa, Musa acuminata
MATANANTKGARKKEVKKETGLGLTYKKNENFGEWYSEVVVNSEMIEYYDISGCYILRPWTMTIWEVLQTFFDAEIKKMNIKNAYFPLFVTESVLQREKDHIEGFAPEVAWVTKSGQSELEVPIAIRPTSETVMYPYFSKWIRGHRDLPLKLNQWCNVVRWEFSHPTPFIRSREFLWQEGHTAFATQAEADQEVLEILELYRKIYEEFLAIPVVKGRKSELEKFAGGYYTTSVEAFIPNTGRGIQGATSHCLGQNFAKMFQINFENDKGEKAMVWQNSWAYSTRTIGVMVMVHGDDKGLVLPPKVASVQVIVIPVPFKDANTDAIFSACSSTVQALREAGFRAEADLRDNYSPGWKYSHWEMKGVPLRIEIGPKDLANNQVRVVRRDNGAKSDIPMGNLVEKVKEILSSIQECLFNAAKQKRDACIKIVNTWDEFIAALNDKKMILAPWCDEEEVEKDVKARTKGELGAAKSLCTPFDQPRLPEGTLCFASGKPAKKWTYWGRSY

SEQ ID NO: 7423 - protein, 509 aa, Malus domestica
MADQGAKKSNAKGGGKKKEVKKETGLGLSKKKDENFGEWYSEVVVNSEMIEYYDISGCYILRPWTIAIWETMQAFFDAEIKKMKIKNCYFPLFVSPSVLEREKDHIEGFAPEVAWVTKSGKSDLEVPIAIRPTSETVMYPYFAKWIRGHRDLPLKLNQWCNVVRWEFSNPTPFIRSREFLWQEGHTAFATKAEADEEVLEILELYRRIYEDYLAVPVVKGKKSENEKFAGGLYTTSVEAFIPNTGRGVQGATSHCLGQNFAKMFEINFENENREKGMVWQNSWAYSTRTIGVMVMVHGDDKGLVLPPKVAAIQAIVVPVPYKNTPMEEIYDACLKTVDTLTKAGIRAEADLSDNQTPGWKYSHWEMKGVPLRIEIGPKDLEKNQVRVVRRDNSAKEDIPVSTLVEQVQDILAKIHENLFNVAKEKRDASIKVAKTWEEFMEALNQKKMILAPWCDEQEVEEDVKKRTKGEIGAAKSLCTPFEQPELPEGTLCFASGKPAKKWTYWGRSY

SEQ ID NO: 7424 - protein, 490 aa, Centaurea maculosa
GKRRQVLVLQILKTETFGEWYSEVVTNGEMIEYYEISGCYILRPWTMSIWEIMQTFFDAEIKKMKIKTCYFPLFVSNNVLQKEKDHIEGFAPEVAWVTRSGDSDLEVPIAIRPTSETVMYPYFSKWIRGHRDLPLKLNQWCNVVRWEFSNPTPFIRSREFLWQEGHTAFATKEEADTEVLEVLELYRRLYEEYLAVPVVKGKKSEMEKFAGGLYTTSVEAFIPNTGRGVQGATSHCLGQNFAKMFEINFEDEKGEKAMVWQNSWAYSTRTIGVMVMTHGDDKGLVLPPKVAEIQVIVIHVPYKDADIKEILNACSATVKALCDSGIRAEADLRENYSPGWKYSHWEMKGVPLRIEIGPKDLANNQVRAVRRDNGAKVDIPMDGLADKVKLMLDDIQQNMFNVAKQKRDACVQVVKTWDEFIKALSQKKLILAPWCDEEEVEKDVKTKTKGETGAAKTLCSPFDQPELPQGTLCFASGKPAKKWTYWGRSY

SEQ ID NO: 7425 - protein, 505 aa, Elaeis guineensis
MATSKTDTSNARKKEVKKETRLGLTYKKDKDFGEWYSEVCVAGEMIEYYDISGCYILRPWTMAIWETLQAFFDAEIKKMNVKNVYFPLFVTENVLQKEKDHIEGFAPEVAWVTKSGQSEMEIPIAIRPTSETVMYPYYSKWIRGHRDLPLKLNQWCNVVRWEFSHPTPFIRSREFLWQEGHTAFATQDEADQEVLEILELYRRIYEEFLAIPVIKGKKSELEKFAGGFYTTSVEAFIPNTGRGIQGATSHCLGQNFAKMFEINFENEKGEKAMVWQNSWAYSTRTIGVMVMVHGDDKGLVLPPKVASVQVIVIPVPYKDADTQAIFDACRSTVDTLCKAGFRAEVDLRDNYSPGWKYSHWEMKGVPLRIEIGPKDLANKQVRVVCRDNGAKMDIPMHSLVEQVKEILSNIQESLFNAAKQKREACVKVINTWDEFIAALNNKKLILAPWCDEEDVEKDVKARTKGEHGAAKTLCTPFDQPRLPEGTLCFASGKPAKKWTYWGRSY

SEQ ID NO: 7426 - protein, 505 aa, Elaeis guineensis
MATSNTDTSNARKKEVKKETRLGLTYKKDKDFGEWYSEVCVAGEMIEYYDISGCYILRPWTMAIWETLQAFFDAEIKKMNVKNVYFPLFVTENVLQKEKDHIEGFAPEVAWVTKSGQSEMEIPIAIRPTSETVMYPYYSKWIRGHRDLPLKLNQWCNVVRWEFSHPTPFIRSREFLWQEGHTAFATQDEADQEVLEILELYRRIYEEFLAIPVIKGKKSELEKFAGGFYTTSVEAFIPNTGRGIQGATSHCLGQNFAKMFEINFENEKGEKAMVWQNSWAYSTRTIGVMVMVHGDDKGLVLPPKVASVQVIVIPVPYKDADTQAIFDACRSTVDTLCKAGFRAEVDLRDNYSPGWKYSHWEMKGVPLRIEIGPKDLANKQVRVVRRDNGAKMDIPMHSLVEQVKEILSNIQESLFNAAKQKREACVKVINTWDEFIAALNNKKLILAPWCDEEDVEKDVKARTKGEHGAAKTLCTPFDQPRLPEGTLCFASGKPAKKWTYWGRSY

SEQ ID NO: 7427 - protein, 530 aa, Arabidopsis thaliana
MADPSEQKEKVVKEKKEKVKKEKVVKEKVAKASSSGQKKKDVKKETGLGLSVKKDENFGEWYSEVCKQDMIEYYDISGCYILRPWSMAIWEIMQIFFDAEIKKMKVKNCYFPLFVSPGVLEKEKDHIEGFAPEVAWVTKSGKSDLEVPIAIRPTSETVMYPYYSKWIRGHRDLPLKLNQWCNVVRWEFSNPTPFIRSREFLWQEGHTAFATKAEADEEVLQILELYRRIYEEYLAVPVVKGMKSENEKFAGGLYTTSVEAFIPNTGRGVQGATSHCLGQNFAKMFEINFENEKAETEMVWQNSWAYSTRTIGVMIMTHGDDKGLVLPPKVASVQVVVIPVPYKDANTQGIYDACTATASALCEAGIRAEEDLRDNYSPGWKYSDWEMKGVPLRIEIGPRDLENDQVRTVRRDNGVKEDIPRGSLVEHVKELLEKIQQNMYEVAKQKREACVQEVKTWDEFIKALNEKKLILAPWCDEEEVERDVKARTKGETGAAKTLCSPFDQPELPEGTLCFASGKPAKKWTYWGRSY

SEQ ID NO: 7428 - protein, 446 aa, Cocos nucifera
MDDGNLGNIASFFDAEIKKMNIKNAYFPLFVTENVLQKEKDHIEGFAPEVAWVTKSGQSEMEIPIAIRPTSETVMYPYYSKWIRGHRDLPLKLNQWCNVVRWEFSHPTPFIRSREFLWQEGHTAFATKDEADQEVLEILELYRRIYEEFLAIPVIKGQKSELEKFAGGFYTTSVEAFIPNTGRGIQGATSHCLGQNFAKMFQINFENEKGEKAMVWQNSWAYSTRTIGVMVMVHGDDKGLVLPPRVASVQVIVIPVPYKDADTQAIFDACRSTVETLCKAGFRAEVDLRDNYSPGWKYSHWEMKGVPLRIEIGPKDLANNQVRVVRRDSGAKMDIPMHSLVEQVKEILSNIQESLFNAAKQKREACVKVINTWDEFIAALNNKKLILAPWCDEEDVEKDVKARTKGELGAAKTLCTPFDQPRLPEGTLCFASGRPAKKWTYWGRSY

SEQ ID NO: 7429 - protein, 532 aa, Cyclamen graecum
MEPSEAAVSVAKDLSSMALDGKVAGGKPKKANANTNNRKKKEVKKETGLGLTAKKDDNFGEWYSEVVVSGELIEYYDISGCYILRPWTMSIWEIMQAFFDSEIKKMRIKNCYFPLFVSPGVLQKEKDHIEGFAPEVAWVTKSGQSDLEVPIAIRPTSETVMYPYYSKWIRGHRDLPLKLNQWCNVVRWEFSNPTPFIRSREFLWQEGHTAFATKEEADIEVLEILELYRRIYEEFLAIPVIKGKKSEHEKFAGGLYTTSVEAFVPHTGRGVQGATSHCLGQNFAKMFEINFENEKGEKAMVWQNSWAYSTRTIGVMVMVHGDDKGLVLPPKVSAVQVIVIPVPYKDADTKGIYDACETAMKTLNESGIRAEADFRDNYSPGWKYSHWEMKGVPLRIEIGPKDLANNQVRAVRRDTAAKIDIPMADLVNHVGDLLNSIQKSLFEAAKHKRDACIQVVKTWDEFTEALSNKKMILAPWCDEEEVEKDVKARTKGEIGAAKTLCSPFEQPELIEGTLCFASGKPAKKWTYWGRSY

SEQ ID NO: 7430 - protein, 509 aa, Avena sativa
MSTSKGGGGGGGGGKKKKEVKKETKLGMAYKKDDNFGEWYSEVVVNSEMIEYYDISGCYILRPWAMEIWELMKEFFDAEIKKLKLKPYYFPLFVTENVLQKEKDHIEGFAPEVAWVTKSGKSDLEAPIAIRPTSETVMYPYFSKWIRSHRDLPLKCNQWCNVVRWEFSNPTPFIRSREFLWQEGHTVFATKEEADEEVLQILELYRRIYEEFLAVPVSKGRKSEMEKFAGGLYTTSVEAFIPNTGRGIQGATSHCLGQNFAKMFDITFENEKGERSMVWQNSWAYTTRSIGVMVMTHGDDKGLVLPPKVAPIQVIVIPVPFKDADTTAIKGACESTVYTLNQAGIRADLDARENYSPGWKYSQWEMKGVPLRIEIGPKDLANKQVRIVRRDNGAKVDIPSTDLVEQVRVLLDGIQVNLLETAKQKRDACIAPISTWDEFTAALNDKKLILAPWCDEEEVEKDVKARTKGELGAAKTLCTPFDQPDLPSGTVCFASGKPATKWSFWGRSY

SEQ ID NO: 7431 - protein, 509 aa, Brachypodium distachyon
MSTNKGGGGGGGGGKKKKEVKKETKLGMAFKKDENFGEWYSEVVVNSEMIEYYDISGCYILRPWAMEIWELLKEFFDAEIKKLKLKPYYFPLFVTENVLQKEKDHIEGFAPEVAWVTKSGKSDLEAPIAIRPTSETVMYPYFSKWIRSHRDLPLKCNQWCNVVRWEFSNPTPFIRSREFLWQEGHTVFATKEEADEEVLQILELYRRIYEEFLAVPVYKGRKSEMEKFAGGLYTTSVEAFIPNTGRGIQGATSHCLGQNFAKMFDITFENEKGERSMVWQNSWAYTTRSIGVMVMTHGDDKGLVLPPRVAPIQVIVIPVPFKDADTTAIKGACESTVYTLNQAGIRADLDARENYSPGWKYSQWEMKGVPLRIEIGPKDLANKQVRIVRRDNGAKVDIPSTDVVEQVGALLEGIQANLLETAKQKRDACIKTISTWDEFIGALNDKKLILAPWCDEEEVEKDVKARTKGELGAAKTLCTPFDQPDLPAGTVCFASGKPAQKWSFWGRSY

SEQ ID NO: 7432 - protein, 510 aa, Oryza sativa
MSSGKGGGGGGKGGGGKKKEVKKETKLGMAYKKDDNFGEWYSEVVVNSEMIEYYDISGCYILRPWAMEIWELLKEFFDAEIKKLKLKPYYFPLFVTENVLQKEKDHIEGFAPEVAWVTKSGKSDLEAPIAIRPTSETVMYPYFSKWIRSHRDLPLRCNQWCNVVRWEFSNPTPFIRSREFLWQEGHTAFATKEEADEEVLQILELYRRIYEEFLAVPVSKGRKSEMEKFAGGLYTTSVEAFIPNTGRGVQGATSHCLGQNFAKMFDITFENDKGSRSMVWQNSWAYTTRSIGVMVMTHGDDKGLVLPPRVAPLQVIVIPVPYKDVDTTAIVNECKKTVETLEKAGIRADLDTRENYSPGWKYSHWEMKGVPLRIEIGPKDMANNQARVVRRDNGAKADIPTADLVEKVNGLLDEVQKNLFETAKQKRDACLKVVNTWDEFIVALNDKKLILAPWCDEEEVEKDVKARTKGDLGAAKTLCTPFEQPDLPEGTTCFASGKPAKKWSFWGRSY

SEQ ID NO: 7433 - protein, 519 aa, Valeriana officinalis
MSSGDKKSNEKDKSSGAKKPNAKGGKVKEVKKETGLGLSHKKDDNFGEWYSEVVVNSEMIEYYDISGCYILRPWTMSIWEIMQEFFDKEIKQMKIKNCYFPLFVSAGVLQREKDHIEGFAPEVAWVTKSGQSDLENPIAIRPTSETVMYPYFSKWIRGHRDLPLRLNQWCNVVRWEFSNPTPFIRSREFLWQEGHTAFASKEEADKEVLEILELYRRVYEEFLAVPVFKGKKSENEKFAGGLYTTSVEAFIPHTGRGVQGATSHCLGQNFAKMFDITYENEKGGKAMVWQNSWAYSTRTIGVMVMVHGDDKGLVLPPKVASVQVIVVPVPYKDVDTEAILEACTNAVKILTEAGIRAESDLRDNYSPGWKYSQWEMKGVPLRLEIGPKDLAKNQARAVRRDTFAKVDLPVANLVEQVSEMLDNIQQNLFEVATQKRDACVKKIHTWEEFVEALGQKKMILAPWCDEEEVEKDVKARTKGEMGAAKTLCSPFDQLELPEGTKCFASGKPATKWSYWGRSY

SEQ ID NO: 7434 - protein, 507 aa, Avena sativa
MSTSKGGGGAGGKKKKEVKKETKLGMAYKKDDNFGEWYSEVVVNSEMIEYYDISGCYILRPWAMEIWELMKEFFDAEIKKLKLKPYYFPLFVTENVLQKEKDHIEGFAPEVAWVTKSGKSDLEAPIAIRPTSETVMYPYFSKWIRSHRDLPLKCNQWCNVVRWEFSNPTPFIRSREFLWQEGHTVFATKEEADEEVLQILELYRRIYEEFLAVPVSKGRKSEMEKFAGGLYTTSVEAFIPNTGRGIQGATSHCLGQNFAKMFDITFENEKGERSMVWQNSWAYTTRSIGVMVMTHGDDKGLVLPPKVAPIQVIVIPVPFKDADTTAIKGACESTVYTLNQAGIRADLDARENYSPGWKYSQWEMKGVPLRIEIGPKDLANKQVRIVRRDNGAKVDIPSTDLVEQVRVLLDGIQVNLLETAKQKRDACIAPISTWDEFTAALNDKKLILAPWCDEEEVEKDVKARTKGELGAAKTLCTPFDQPDLPSGTVCFASGKPATKWSFWGRSY

SEQ ID NO: 7435 - protein, 547 aa, Castanea mollissima
MAGGDEKKSNPGGGVAKKPNAGGGGGAKKPNVSGGGKKKEVKKETGLGLVNRKDENFGEWYSEVVVNAELIEYYDISGCYILRPWTMAIWEEMQKFFDAEIKKMDIQNCYFPLFVSPGVLQKEKDHVEGFAPEVAWVTKSGESELEVPIAIRPTSETVMYPYYSKWIRGHRDLPLKLNQWCNVVRWEFSHPTPFIRSREFLWQEGHTAFATKAEADEEVLDILELYRRIYEEYLAIPVIKGKKSELEKFAGGLYTTSVEAFVPNTGRGIQGATSHCLGQNFAKMFEINFENEKGEKGMVWQNSWAYSTRTIGVMVMVHGDDRGLVLPPKVASVQVIVIPVPYKDADTQAIFDACSATVASLSEAGIRAKADSRDNYSPGWKYSHWEMKGVPLRIEIGPKDLANSQVRAVRRDNSAKTDIPRGKLVEQVKEMLDNIQQSLFDAAKQKRDACIQTVKTWDEFVEALGQRKMILAPWCDEEEVEIEVKARTKGEMGACKSLCSPFDQPELLEGTKCFASGKPAKNGRTGEGVTRLLIFDMISSPGVPQSV

SEQ ID NO: 7436 - protein, 471 aa, Fagus grandifolia
MAGGDAKKSNAKASGGGKKKEVKKETGLGLVNRKDENFGEWYSEVVVNGEMIEYYDISGCYILRPWAMAIWEIMQKFFDAEIKKMDIQNCYFPLFVSPGVLQKEKDHVEGFAPEVAWVTKSGESELEVPIAIRPTSETVMYPYYSKWIRGHRDLPLKLNQWCNVVRWEFSHPTPFIRSREFLWQEGHTAFATQAEADAEVLDILELYRRIYEEYLAIPVTKGKKSELEKFAGGLYTTSVEAFVPNTGRGIQGATSHCLGQNFAKMFEINFENEKGEKGMVWQNSWAYSTRTIGVMVMVHGDDKGLVLPPKVASVQVIVIPVPYKDADTKGIFDAVAATVDALSEAGIRAKSDLRDNYSPGWKYSHWEMKGVPLRIEIGPKDLANSQVRAVRRDNAAKIDIPRAQLVEQVKEMLDNIQQSLFDAAKQKRDACIQTVKTWDEFVEALSQRKMILAPWCDEEEVEKDVKARTKG

SEQ ID NO: 7437 - protein, 509 aa, Festuca arundinacea
MSTNKGGGGAGGGGKKKKEVKKETKLGMAYKKDDNFGEWYSEVVVNSEMIEYYDISGCYILRPWAMEIWELLKEFFDAEIKKLKLKPYYFPLFVTENVLQKEKDHIEGFAPEVAWVTKSGKSDLEAPIAIRPTSETVMYPYFSKWIRSHRDLPLKCNQWCNVVRWEFSNPTPFIRSREFLWQEGHTVFATKEEADEEVLQILELYRSIYEEFLAVPVSKGRKSEMEKFAGGLYTTSVEAFIPNTGRGIQGATSHCLGQNFAKMFDITFENEKGERSMVWQNSWAYTTRSIGVMVMTHGDDKGLVLPPKVAPIQVIIIPVPFKDADTTAIKGACESTAYTLNQAGIRADLDARENYSPGWKYSQWEMKGVPLRIEIGPKDLANKQVRIVRRDNGTKVDIPSTDLVEQVRVLLDVIQVNLFETAKQKRDACIAPISTWDEFTAALNDKKLILAPWCDEEEVEKDVKARTKGELGAAKTLCTPFDQPDLPSGTMCFASGKPATKWSFWGRSY

SEQ ID NO: 7438 - protein, 509 aa, Lolium multiflorum
MSTNKGAGGAGGGGKKKKEVKKETKLGMAYKKDDNFGEWYSEVVVNSEMIEYYDISGCYILRPWAMEIWELLKEFFDAEIKKLKLKPYYFPLFVTENVLQKEKDHIEGFAPEVAWVTKSGKSDLEAPIAIRPTSETVMYPYFSKWIRSHRDLPLKCNQWCNVVRWEFSNPTPFIRSREFLWQEGHTVFATKEEADEEVLQILELYRRIYEEFLAVPVSKGRKSEMEKFAGGLYTTSVEAFIPNTGRGIQGATSHCLGQNFAKMFDITFENEKGERSMVWQNSWAYTTRSIGVMVMTHGDDKGLVLPPKVAPIQVIVIPVPFKDADTTAIKGACESAVYTLNQAGIRADLDARENYSPGWKYSQWEMKGVPLRIEIGPKDLANKQVRIVRRDNGTKVDIPSADLVEQVRMLLDGIQVNLFETAKQKRDACIAPINTWDEFTAALNEKKLILAPWCDEEEVEKDVKARTKGELGAAKTLCTPFDQPDLPSGTVCFASGKAATKWSFWGRSY

SEQ ID NO: 7439 - protein, 498 aa, Cirsium arvense
MAGGKGDKPDNAKKSAAVAKSSKGRKKETGLGLTNTKDGNFGEWYSEVVTNGEMIEYYEISGCYILRPWTMSIWEIMQTFFDAEIKKMKIKTCYFPLFVSNNVLQKEKDHIEGFAPEVAWVTRSGDSDLEVPIAIRPTSETVMYPYFSKWIRGHRDLPLKLNQWCNVVRWEFSNPTPFIRSREFLWQEGHTAFATKEEADIEVLEVLELYRRLYEEYLAVPVVKGKKSEMEKFAGGLYTTSVEAFIPNTGRGVQGATSHCLGQNFAKMFEINFEDEKGEKAMVWQNSWAYSTRTIGVMVMTHGDDRGLVLPPKVAAIQVIVIHVPYKDADIKEILNACSATVKALCDSGIRAEADLRENYSPGWKYSHWEMKGVPLRIEIGPKDLANKQVRAVRRDNAAKIDIPMDGLVDKVKGMLDDIQQSMFDVAKQKRDACVQVAKTWDEFIEALSQKKLILAPWCDEEEVEKDVKTKTKGETGAAKTLCSPFDQPELPEGTLCF

SEQ ID NO: 7440 - protein, 509 aa, Festuca arundinacea
MSTNKGGGGAGGGGKKKKEVKKETKLGMAYKKDDNFGEWYSEVVVNSEMIEYYDISGCYILRPWAMEIWELLKEFFDAEIKKLKLKPYYFPLFVTENVLQKEKDHIEGFAPEVAWVTKSGKSDLEAPIAIRPTSETVMYPYFSKWIRSHRDLPLKCNQWCNVVRWEFSNPTPFIRSREFLWQEGHTVFATKEEADEEVLQILELYRRIYEEFLAVPVSKGRKSEMEKFAGGLYTTSVEAFIPNTGRGIQGATSHCLGQNFAKMFDITFENEKGERSMVWQNSWAYTTRSIGVMIMTHGDDKGLVLPPKVAPIQVIVIPVPFKDADTTAIKGACESAVYSLNQAGIRADLDARENYSPGWKYSQWEMKGVPLRIEIGPKDLANKQVRIVRRDNGTKVDIPSTDLVEQVRMLLDGIQVNLLETAKQKRDACIAPINTWDEFTAALNEKKLILAPWCDEEEVEKDVKARTKGDLGAAKTLCTPFDQPDLPSGTMCFASGKPATKWSFWGRSY

SEQ ID NO: 7441 - protein, 509 aa, Lolium multiflorum
MSTNKGGGGAGGGGKKKKEVKKETKLGMAYKKDDNFGEWYSEVVVNSEMIEYYDISGCYILRPWAMEIWELLKEFFDAEIKKLKLKPYYFPLFVTENVLQKEKDHIEGFAPEVAWVTKSGKSDLEAPIAIRPTSETVMYPYFSKWIRSHRDLPLKCNQWCNVVRWEFSNPTPFIRSREFLWQEGHTVFATKEEADEEVLQILELYRRIYEEFLAVPVSKGRKSEMEKFAGGLYTTSVEAFIPNTGRGIQGATSHCLGQNFAKMFDITFENEKGERSMVWQNSWAYTTRSIGVMIMTHGDDKGLVLPPKVAPVQVIIIPVPFKDADTTAIKGACESAVYTLNQAGIRADLDARENYSPGWKYSQWEMKGVPLRIEIGPKDLANKQVRIVRRDNGTKVDIPSTDLVEQVRLLLNVIQVNLFETAKQKRDACIAPISTWDEFTAALNDKKLILAPWCDEEEVEKDVKARTKGELGAAKTLCTPFDQPDLPSGTVCFASGKAATKWSFWGRSY

SEQ ID NO: 7442 - protein, 473 aa, Tripterygium wilfordii
PKGNASGGGKKKEVKKETGLGLSYKKEENFGEWYSEVVVNAEMIEYYDISGCYILRPWTMAIWEIMQAFFDAEIKKMKIKNCYFPLFVSPGVLEKEKDHIEGFAPEVAWVTKSGKSDLEVPIAIRPTSETVMYPYYSKWIRGHRDLPLKLNQWCNVVRWEFSNPTPFIRSREFLWQEGHTAFATKPEADEEVLQILELYRCIYEEFLAVPVIKGKKSEMEKFAGGLYTTSVEAFIPNTGRGIQGATSHCLGQNFAKMFEINYENEKGEKSMVWQNSWAYSTRTIGVMVMVHGDDKGLVLPPKVASVQVIVIPVPYKDADTKGIFDACAATVESLCAAGIRAEADFRDNYSPGWKYSHWEVKGVPLRIEIGPKDLANNQVRAVRRDNGAKIDISRVNLVEELKDLIDNIQQSLFDAAKQRRDSCIQVVNTWDEFREALNQRKLILAPWCDEEEVEQDVKARTKGEIGAAKTLCS

SEQ ID NO: 7443 - protein, 62 aa, Fagus grandifolia
MILAPWCDDEEVEKDVKARTKGEMGAAKSLCSPFDQPELPEGTTCFASGKPDKKWTYWGRSY

SEQ ID NO: 7444 - protein, 285 aa, Secale cereale
MEKFAGGLYTTSVEAFIPNTGRGIQGATSHCLGQNFAKMFDITFENEKGERSMVWQNSWAYTTRSIGVMVMTHGDDKGLVLPPKVAPIQVIVIPVPFKDADTTAIKGACESAVYTLNQAGIRADLDARENYSPGWKYSQWEMKGVPLRIEIGPKDLANKQVRIVRRDNGTKVDIPSTDLVEQVRVLLDGIQANLLETAKAKRDACIVIISTWDEFIAALNDKKLILAPWCDEEEVEKDVKARTKGELGAAKTLCTPFDQPDLPSGTVCFASGKPAQKWSFWGRSY

SEQ ID NO: 7445 - protein, 505 aa, Triticum aestivum
MSTNKGGGGGKKKKEVKKETKLGMAYKKDDNFGEWYSEVVVNSEMIEYYDISGCYILRPWAMEIWELLKEFFDAEIKKLKLKPYYFPLFVTENVLQKEKDHIEGFAPEVAWVTKSGKSDLEAPIAIRPTSETVMYPYFSKWIRSHRDLPLKCNQWCNVVRWEFSNPTPFIRSREFLWQEGHTVFATKEEADEEVLQILELYRRIYEEFLAVPVSKGRKSEMEKFAGGLYTTSVEAFIPNTGRGIQGATSHCLGQNFAKMFDITFENEKGERSMVWQNSWAYTTRSIGVMVMTHGDDKGLVLPPKVAPIQVIVIPVPFKDADTTAIKGACESAVYTLNQAGIRADLDARENYSPGWKYSQWEMKGVPLRIEIGPKDLANKQVRIVRRDNGTKVDIPSTDLVEQVRVLLDGIQANLLETAKAKRDACIVIISTWDEFIAALNDKKLILAPWCDEEEVEKDVKARTKGELGAAKTLCTPFDQPDLPSGTACFASGKPAQKWSFWGRSY

SEQ ID NO: 7446 - protein, 494 aa, Cirsium arvense
MAGGKGDKPDNGKKSAAVAKSSKGRKKETGLGLTNTKDGNFGEWYSEVVTNGEMIEYYEISGCYILRPWTMSIWEIMQTFFDAEIKKMKIKTCYFPLFVSNNVLQKEKDHIEGFAPEVAWVTRSGDSELEVPIAIRPTSETVMYPYFSKWIRGHRDLPLKLNQWCNVVRWEFSNPTPFIRSREFLWQEGHTAFATKEEADTEVLEVLELYRRLYEEYLAVPVVKGKKSEMEKFAGGLYTTSVEAFIPNTGRGVQGATSHCLGQNFAKMFEINFEDEKGEKAMVWQNSWAYSTRTIGVMVMTHGDDRGLVLPPKVAAIQVIVIHVPYKDADIKEILNACSATVKALCDSGIRAEADLRENYSPGWKYSHWEMKGVPLRIEIGPKDLANNQVRTVRRDNAAKIDIPMDGLVDKVKGMLDDIQQSMFDVAKQKRDACVQVAKTWDEFIEALGQKKLILAPWCDEEEVEKDVKTKTKGETGAAKTLCSPFEQPELPEG

SEQ ID NO: 7447 - protein, 507 aa, Secale cereale
MSTNKGGGGGGGKKKKEVKKETKLGMGYKKDDNFGEWYSEVVVNSEMIEYYDISGCYILRPWAMEIWELLKEFFDAEIKKLKLKPYYFPLFVTENVLQKEKDHIEGFAPEVAWVTKSGKSDLEAPIAIRPTSETVMYPYFSKWIRSHRDLPLKCNQWCNVVRWEFSNPTPFIRSREFLWQEGHTVFATKEEADEEVLQILELYRRIYEEFLAVPVSKGRKSEMEKFAGGLYTTSVEAFIPNTGRGIQGATSHCLGQNFAKMFDITFENEKGERSMVWQNSWAYTTRSIGVMIMTHGDDKGLVLPPKVAPIQVIVIPVPFKDADTTAIKGACESAVYTLNQAGIRADLDARENYSPGWKYSQWEMKGVPLRIEIGPKDLANKQVRIVRRDNGTKVDIPSTDLVEQVRVLLDGIQVNLLETAKAKRDACIKIISTWDEFIAALNDKKLILAPWCDEEEVEKDVKARTKGELGAAKTLCTPFDQPDLPSGTVCFASGKPAQKWSFWGRSY

SEQ ID NO: 7448 - protein, 507 aa, Secale cereale
MSTNKGGGGGGGKKKKEVKKETKLGMGYKKDDNFGEWYSEVVVNSEMIEYYDISGCYILRPWAMEIWELLKEFFDAEIKKLKLKPYYFPLFVTENVLQKEKDHIEGFAPEVAWVTKSGKSDLEAPIAIRPTSETVMYPYFSKWIRSHRDLPLKCNQWCNVVRWEFSNPTPFIRSREFLWQEGHTVFATKEEADEEVLQILELYRRIYEEFLAVPVSKGRKSEMEKFAGGLYTTSVEAFIPNTGRGIQGATSHCLGQNFAKMFDITFENEKGERSMVWQNSWAYTTRSIGVMIMTHGDDKGLVLPPKVAPIQVIVIPVPFKDADTTAIKGACESAVYTLNQAGIRADLDARENYSPGWKYSQWEMKGVPLRIEIGPKDLANKQVRIVRRDNGTKVDIPSTDLVEQVRVLLDGIQANLLETAKAKRDACIVIISTWDEFIAALNDKKLILAPWCDEEEVEKDVKARTKGELGAAKTLCTPFDQPDLPSGTVCFASGKPAQKWSFWGRSY

SEQ ID NO: 7449 - protein, 508 aa, Saccharum officinarum
MSTSKGGASNGGGGKKKEVKKETKLGMAYKKDDNFGEWYSEVVVNSEMIEYYDISGCYILRPWAMEIWELLKEFFDAEIKKLKLKPYYFPLFVTENVLQKEKDHIEGFAPEVAWVTKSGKSELEAPIAIRPTSETVMYPYFSKWIRSHRDLPLRCNQWCNVVRWEFSNPTPFIRSREFLWQEGHTAFATKEEADEEVLQILELYRRIYEEFLAVPVSKGRKSEMEKFAGGLYTTSVEAFIPNTGRGIQGATSHCLGQNFAKMFDITFENEKGVREMVWQNSWAYTTRSIGVMVMTHGDDKGLVLPPKVAPIQVIVIAVPYKDADTTAIKGACESTVYTLNQSGIRADQDTRENYSPGWKYSHWEMKGVPLRIEIGPKDLANKQVRIVRRDNGAKVDIPVTNLVEEVKVLLDEIQKNLFKTAQEKRDACVQVIKTWDEFTTALNNKRLILAPWCDEEEVEKDVKARTKGELGAAKTLCTPFEQPELPEGTLCFASGKPAKKWSFWGRSY

SEQ ID NO: 7450 - protein, 506 aa, Panicum virgatum
MSSGGGKGGGGGKKKEVKKETKLGMAYKKDENFGEWYSEVVVNSEMIEYYDISGCYILRPWAMEIWELLKEFFDAEIKKLKLKPYYFPLFVTENVLQKEKDHIEGFAPEVAWVTKSGKSELEAPIAIRPTSETVMYPYFSKWIRSHRDLPLRCNQWCNVVRWEFSNPTPFIRSREFLWQEGHTAFATKEEADKEVLQILELYRRIYEEFLAVPVSKGRKSEMEKFAGGLYTTSVEAFIPNTGRGIQGATSHCLGQNFAKMFDITFENEKGAREMVWQNSWAYTTRSIGVMVMTHGDDKGLVLPPRVAPIQVIVIPVPYKDSDTTAIKGACESTVYTLNESGFRADLDTRENYSPGWKYSHWEMKGVPLRIEIGPRDLANQQVRVVRRDNGAKVDIPVANLVEEVKVLLDEIQANLLKTAKEKRDACIEVIHTWDEFTTALNNKRLILAPWCDEEEVEKDVKARTKGDLGAAKTLCTPFDQPELPEGTLCFASGKPAKKWSFWGRSY

SEQ ID NO: 7451 - protein, 421 aa, Gossypium hirsutum
MTAEQTSAFKSVTEWVYLDRHHHPNSSSTAGLSSWVVDDFGVQKSLGRGMEKMVFELHSHSKHSDGFLSPSKLVERAHGNGVKVLALTDHDTMSGITEAVEAARRFGIKIIPGVEISTIFSPRNPEMEEPVHILAYYSGCGPMRYEELDKLLANIREGRYVRAKDIVLKLNKLKLPLKWEHVTKIAGKGVAPGRLHVARAMVEAGYVENLKQAFARYLYDGGPAYSTGSEPLAEEVVQLICETGGLAVLAHPWALKNPIPIIRRLKDAGLHGMEVYRSNGRRAAYNDLADTYNLLKLGGSDYHGRDGHGESELGSVNLPVVVLHDFLKVARPIWCSAIKDILEGYAKEPSDTNLAKIARFTRMGSFKGSSPSSCGKDLIDRCLASWLTAEERQNDEFEAIRLKLSHATINLSGVQVPIETK

SEQ ID NO: 7452 - protein, 418 aa, Theobroma cacao
MTAEQTLAFKSVTEWVYLDHQNSSSTAALSSWVVDDFGVQKSLGRGMEKVVFELHSHSKHSDGFLSPSKLVERAHGNGVKVLALTDHDTMSGIPEAIETARRFGIKIIPGVEISTIFSPRNSEMEEPVHILAYYSSCGPTRYEELETFLANIRDGRYLRAKDMVLKLNKLKLPLKWEHVTKIAGKGVAPGRLHVARAMVEAGYVENLKQAFARYLYDGGPAYSTGSEPLAEEAVQLICETGGLAVLAHPWALKNPIPIIRRLKDAGLHGMEVYRSDGRLAAYSDLADTYDLLKLGGADYHGRGGHGESELGSVNLPVLVLHDFLKVARPIWCGAIKDILETYAEEPSDSNLARIARFGRMGSFRGSSPLSCGQDFIDCCLSSWLTTEERQNAEFEAIRLKLSYISIDLGGVQAPIGSK

SEQ ID NO: 7453 - protein, 150 aa, Theobroma cacao
MGALDSLSDYISDLITVHTKRKKRKVMQTVEIKVKMDCDGCERRVKNAVSSMKGAKSVNVNRKQSRVTVTGYVEPNKVLKKVKSTGKRAEFWPYVPYNLVAYPYVAQAYDKKAPSGYVKNAVQALPSPNAADEKFITLFSDENPNACSVM

SEQ ID NO: 7454 - protein, 150 aa, Manihot esculenta
MGVLDSLSDYLSDLFTDARKRRKRKPMQTVDIKVKMDCDGCERRVKNSVSNMKGVKSVEVNRKQSRVTVSGYVEPNKVLKKVRSTGKRAEFWPYVPYNLVAYPYVAQAYDKKAPSGYVKNVVQAIPSPNAADEKFITMFSDENPNACSIM

SEQ ID NO: 7455 - protein, 150 aa, Hevea brasiliensis
MGALDSLSDYLSDLFTVARKKRKRKPMQTVDIKVKMDCDGCERRIKNSVSNMKGVRSVEVNRKQSRVTVSGYVEPNKVLKKVRSTGKRAEFWPYIPYNLVAYPYVAQAYDKRAPSGYVRNVVQALPSPNAADEKFTTFFSDENPNACSIM

SEQ ID NO: 7456 - protein, 146 aa, Humulus lupulus
MGVLDHLSDYFTVDRPRKKRKAMQTVEIKVKMDCDGCERRVKNAVSSMKGAKQVEVNRKQSRVTVTGYVEPNKVLKKVKSTGKKAEFWPYVPYNLVAYPYVAQAYDKKAPSGYVKNVSQALPSPNAQDEKFVTMFSDENPNACSIM

SEQ ID NO: 7457 - protein, 150 aa, Populus trichocarpa
MGALDDLSDYLSDLFTVARKKRKRKPMQTVDIKVKMDCDGCERRVKNSVSSMKGVKSVEVNRKQSRVTVSGNVEPNKVLKKVKSTGKRAEFWPYVPYNLVAYPYAAQAYDKKAPAGYVKNVVQALPSPNATDERFTSMFSDENPNACSIM

SEQ ID NO: 7458 - protein, 146 aa, Quercus alba
MGALDFLSDYITISTPRKKRKAMQTVEIKVKMDCDGCERRVKNAVSNMKGAKSVEVNRKQSRVTVTGYVEPNKVLKKVKSTGKRAEFWPYVPYNLVAYPYVAQAYDKKAPAGYVKNAVQAHPIPNATDEKLTTLFSDENPNACSIM

SEQ ID NO: 7459 - protein, 150 aa, Ricinus communis
MGALDDLSDYLSDLFTYARKKRKRKPMQTVEIKVKMDCDGCERRVKHAVSNIKGVKSVEVNRKQSRVVVSGYIEPNKVLKKVRSTGKRAEFWPYVPYNLVAYPYVAQAYDKKAPSGYVKNVFQALPSPNAPDEKYTTMFSDENPHACSIM

SEQ ID NO: 7460 - protein, 124 aa, Castanea mollissima
MQTVKIKVKMDCDGCERRVRNAVSNMKGAKSVEVDRKQSRVTVTGYVEPNKVLNKVKSTGKRAEFWPYVPYNLVAYPYVAQAYDKKAPSGYVKNAVQAQPDPNAIDEKLTSLFSDENPNACSIM

SEQ ID NO: 7461 - protein, 146 aa, Cannabis sativa
MGVLDHLSDYFTIDRPRKKRKAMQTVEIKVKMDCDGCERRVKNAVTSMKGAKQVEVNRKQSKVTVTGYVEANKVLKKVKSTGKKAELWPYVPYNLVAYPYVAQAYDKKAPSGYVKNVVQALPSPNASDEKLVTMFSDENPNACSIM

SEQ ID NO: 7462 - protein, 150 aa, Manihot esculenta
MGALDSFSDYLSDLFTLAKKKRKRKPMQTVDIKVKMDCDGCERRVKNSVSDMKGVKSVEVNRKQSRVTVSGYVDPNKVLKKVRSTGKRAEFWPYVPYNLVTYPYVAQAYDKKAPSGFVRDVFQALPSPNAADEKFTTLFSDENPHACSIM

SEQ ID NO: 7463 - protein, 466 aa, Vitis vinifera
MDYHIYGVPRLKWIKIFFLTAVFCLSTHAHASALPRKPSSSSNSPQINSNSVLVALLDSRYTELAELVEKALLLPTLEDAVGKHNITIFAPRNEALERDLDPEFKRFLLEPGNLRSLQTLLLFHIIPNRIGSGEWPGGLAGDPTHGTLSNDRLSLASKGSGVKSVDLAAVVHPDAIVRPDGVIHGIERLLIPLSVEEDFNRRRSLRSISAVLPEGAPEVDPRTHRLKKAVPVPAGAPPVLPIYDAMAPGPSLAPAPAPGPGGPRGHFDGESQVKDFIQTLLHYGGYNEMADILVNLTSLATEMGRLVSEGYVLTVLAPNDEAMAKLTTDQLSEPGAPEQIMYYHLVPEYQTEESMYNAVRRFGKVRYDTLRLPHKVVAQEADGSVKFGEGDGSAYLFDPDIYTDGRISVQGIDGVLFPPEEKESKPETKTSRAAKVVSKSRRGKLMEVACRMLGAFGQDSRFTTCQ

SEQ ID NO: 7464 - protein, 462 aa, Ricinus communis
MDPHIYGVSKFLLFTFFFFFFSSFSSALPQNSSSKPSSNSGINSNSVLVALLDSHYTELAELVEKALLLQTLEESVGKHNITIFAPRNEALERQLDPEFKRFLLEPGNLKSLQTLLMFHIIPKRVGSSDWPTDASNPTWHITLSNNHLHLDVRDSGKKVVDSAELVRPDDVIRPDGVIHGIERLLIPQSVQEDFNRRRSLRSISAVLPEGAPEVDPRTHRLKKPAAPVPVGAPPVLPIYDAMAPGPSLAPAPAPGPGGPHHHFDGESQVKDFIQTLLHYGGYNEMADILVNLTSLATEMGRLVSEGYVLTVLAPNDEAMAKLTTDQLSEPGAPEQIIYYHIIPEYQTEESMYNAVRRFGKVKYDTLRLPHKVVAQEADGSVKFGSGDGSAYLFDPDIYSDGRISVQGIDGVLFPEEEKETTDAKPTTSVKVVTKARRGKLMEVACRMLGAFGQDSQFSTCHQ

SEQ ID NO: 7465 - protein, 457 aa, Manihot esculenta
MDLHVYGVSKFFSFLSCFLFLFFTISAFPQHPSSNNTGINSNSVLVALLDSHYTELAELVEKALLLQTLEDAVGNHNITIFAPRNEALERQLDPEFKRFLLEPGNLKSLQTLLMFHIIPQRVGSSDWPSEKSKPARHSTLCNDHLHLISKSSGKKVVDSAEIIRPDDVIRPDGVIHGIERLLIPQSVQEDFNRRRNLRSISAVLPEGAPEVDPRTHRLKKPAAPVPVGAPPVLPIYDAMAPGPSLAPAPAPGPGGPHHHFDGESQVKDFIQTLLHYGGYNEMADILVNLTSLATEMGRLVSEGYVLTVLAPNDEAMAKLTTDQLSEPGAPEQIIYYHIIPEYQTEESMYNAVRRFGKIKYDTLRLPHKVVALEADGSVKFGSGDTSAYLFDPDIYTDGRISVQGIDGVLFPEEEKETVKKPTAAVKVVTKARRGKLMEVACRMLGAFGQDSHFNTCQ

SEQ ID NO: 7466 - protein, 461 aa, Aquilegia formosa
MDSHVYGVAKMIFTIYLISVLGISAALPENSTLKTNSTQINSNSVLVALLDSHYTELAELVEKALLLQTLEDAVGKHNITIFAPRNEALERDLDPEFKRFLLEPGNLKSLQTLLMFHIIPKRIGSNEWPEKVSESNRHLTLTRDTLHLTNCKDSGKKVGLAKVIHPDAVIRPDGVIHGIERLLIPRSVQEDFNRRRSLRSISAVLPEGAPEVDPRTNRLKKPASPSPAGAPPVLPIYSAMAPGPSLAPAPAPGPGGAHRHFDGESQVKDFIQTLLHYGGYNEMADILVNLTSLATEMGRLVSEGYVITVLAPNDEAMAKLTTDQLSEPGAPERIMYYHIIPEYQTEESMYNSVRRFGKIRYDTLHLPHKVMAQEADGSVKFGEGDESAYLFDPDIYTDGRISVQGIDGVLFPAEEVPKTETTKTVQSSKIVTTKPRRGKLLEVACSMLGAFGRNSHFTTCQ

SEQ ID NO: 7467 - protein, 462 aa, Manihot esculenta
MDPPIYGVSRIFFTLCLFVLLSASSASSALPQYPSSPSNKNTGINSNSVLVALLDSHYTELAELVEKALLLQTLEEAVGRNNITIFAPKNEALERQLDPEFKRFLLEPGNLKSLQTLLMFHVIPQRLGSNDWPSERSKLSRHTTLCNDHIHLISKTSGKKLVDSAEIIKPDDVIRPDGVIHGIERLLIPQSVQEDFNRRRNLRSISAVLPEGAPEVDPRTHRLKKPAAPVPVGAPPVLPIYDAMAPGPSLAPAPAPGPGGPHHHFDGESQVKDFIQTLLHYGGYNEMADILVNLTSLATEMGRLVSEGYVLTVLAPNDEAMAKLTTDQLSEPGAPEQIIYYHIIPEYQTEESMYNAVRRFGKIKYDTLRLPHKVVAQEADGSVKFGAGDTSAYLFDPDIYTDGRISVQGIDGVLFPEEEKESVKKSTAAVKVVTKPRRGKLMEVACRMLGAFGKDSHFSRCQ

SEQ ID NO: 7468 - protein, 157 aa, Gossypium hirsutum
  Sequence also found in Organisms: Gossypium raimondii
MANLYVKAVPPADLNRNTEWFMYPGVWTTYILILFFSWLLVLSIFGCSPGMAWTVVNLAHFLVTYHFFHWKKGTPFAEDQGIYNGLTWWEQIDNGKQLTRNRKFLTVVPVVLYLIASHTTDYQHPMLFFNTLAVLVLVIAKFPNMHKVRIFGINADK

SEQ ID NO: 7469 - protein, 157 aa, Heritiera littoralis
MANLYVKAVPPADLNRNTEWFMYPGVWTTYILILFFSWLLVLSIFGCSPGMAWTVVNLSHFLVTYQFFHWKKGTPFAEDQGIYNGLTWWEQIDNGKQLTRNRKFLTVVPVVLYLIASHTTDYQHPMLFLNTLAVIVLVIAKFPNMHKVRIFGINADK

SEQ ID NO: 7470 - protein, 157 aa, Cucumis melo
MANLYVKAVPPADLNRNTEWFMYPGVWTTYILILFFAWLLVLSVFGCSPGMAWTVVNLSHFAVTYHFFHWKKGTPFAEDQGIYNRLTWWEQIDNGKQLTRNRKFLTVVPVVLYLIASHTTDYQHPMLFLNTLAVIVLVIAKFPHMHKVRIFGINADK

SEQ ID NO: 7471 - protein, 157 aa, Theobroma cacao
MANLYVKAVPPADLNRNTEWFMYPGVWTTYILILFFSWLLVLSIFGCSPGMAWTIVNLSHFLVTYHFFHWKKGTPFAEDQGIYNGLTWWEQIDNGKQLTRNRKFLTVVPVVLYLIASHTTDYQHPMLFLNTLAVLVLVIAKFPNMHKVRIFGINADK

SEQ ID NO: 7472 - protein, 157 aa, Cucumis sativus
MANLYVKAVPPTDLNRNTEWFMYPGVWTTYILILFFAWLLVLSVFGCSPGMAWTVVNLSHFAVTYHFFHWKKGTPFAEDQGIYNRLTWWEQIDNGKQLTRNRKFLTVVPVVLYLIASHTTDYQHPMLFLNTLAVIVLVIAKFPHMHKVRIFGINADK

SEQ ID NO: 7473 - protein, 157 aa, Euphorbia peplus
MANLYVKAVPPADLNRNTEWFMYPGVWTTYILILFFSWLIVLSVFGCSPGMAWTIVNLAHFCVTYHFFHWKKGTPFAEDQGIYNRLTWWEQIDNGKQLTRNRKFLTVVPVVLYLIASHTTDYQHPMLFFNTLAVIVLVIAKFPNMHKVRIFGINADR

SEQ ID NO: 7474 - protein, 157 aa, Castanea mollissima
  Sequence also found in Organisms: Quercus alba
MANLYVKAAPPVDLNRNTEWFTYPGVWTTYILILFFAWLLVLSIFGCSPGMAWTIVNLAHFAVTYHFFHWKKGTPFADDQGIYNALTWWEQIDNGKQLTRNRKFLTVVPVVLYLIASHTTDYQHPMLFLNTLAAIVLVIAKFPNMHKVRIFGINADK

SEQ ID NO: 7475 - protein, 158 aa, Castanea mollissima
MMANLYVKAAPPVDLNRNTEWFTYPGVWTTYILILFFAWLLVLSIFGCSPGMAWTIVNLAHFAVTYHFFHWKKGTPFADDQGIYNALTWWEQIDNGKQLTRNRKFLTVVPVVLYLIASHTTDYQHPMLFLNTLAAIVLVIAKFPNMHKVRIFGINADK

SEQ ID NO: 7476 - protein, 157 aa, Citrus clementina
  Sequence also found in Organisms: Citrus sinensis
MANLYVKATPPADLNRNTEWFTYPGVWTTYILILFFAWLIVLSVFGCSPGMAWTIVNLAHFLITYHFFHWKKGTPFAEDQGIYNGLTWWEQIDNGQQLTRNRKFLTVVPVVLYLIASHTTDYQHPMLFFNTLAVFVLVVAKFPNMHKVRIFGINADK

SEQ ID NO: 7477 - protein, 157 aa, Cucurbita pepo
MANLYVKAMPPADLNRNTEWFLYPGVWTTYILILFFTWLLVLSVFGCSPGMAWTIVNLSHFAVTYHCFHWKKGTPFAEDQGIYNRLTWWEQIDNGKQLTRNRKFLTVVPVVLYLIASHTTDYQHPMLFLNTLAVIVLVIAKFPHMHKVRIFGINADK

SEQ ID NO: 7478 - protein, 157 aa, Heritiera littoralis
MANLYVKAVPTADLNRNTEWFMYPGVWTTYILILFFCWLLVLSIFGCSPGMAWTIVNLSHFLVTYQFFHWKKGTPFAEDQGIYNGLTWWEQIDNGKQLTRNRKFLTVVPVVLYLIASHTTDYQHPMLFLNTLAVIVLVVAKFPNMHKVRIFGINADK

SEQ ID NO: 7479 - protein, 157 aa, Momordica charantia
MANLYVKAVPPADLNRNTEWFLYPGVWTTYILILFFAWVLVLSVFGCSPGMAWTIVNLSHFAVTYHFFHWKKGTPFAEDQGIYNRLTWWEQIDNGKQLTRNRKFLTVVPVVLYLIASHTTDYQHPMLFLNSLAVIVLVIAKFPHMHKVRIFGINADK

SEQ ID NO: 7480 - protein, 157 aa, Carica papaya
MANLYVKAVPPADLNRNTEWFMYPGVWTTYILILFFSWLLVLSIVGCSPGMAWTIVNLAHFLVTYHFFHWKKGTPFADDQGIYNGLTWWEQIDNGQQLTRNRKFLTVVPVVLYLIASHTTDYQHPMLFFNTLAVIVLVVAKFPNMHKVRIFGINADK

SEQ ID NO: 7481 - protein, 76 aa, Fagus grandifolia
MASLYVKAEPTTDLNRNTEWFTYPGVWTTYILILFFSWLLVLSIFGCSPGMAWTVVNLAHFLVTYHFFHWKKDSIC

SEQ ID NO: 7482 - protein, 157 aa, Ricinus communis
MANLYVKAVPPADLNRNTEWFMYPGVWTTYILILFFSWLLVLSVFGCSPGMAWTIVNLAHFCITYHFFHWKKGTPFAEDQGIYNRLTWWEQMDSGKQLTRNRKFLTVVPVVLYLIASHTTDYQHPMLFFNTLAVAVLVIAKFPNMHKVRIFGINADT

SEQ ID NO: 7483 - protein, 157 aa, Acacia harpophylla
MANLYVKATPPADLNKNTEWFTYPGVWTTYILILFFAWLLVLSIFGCTPGMAWTIVNLGHFAVTYHFFHWKKGTPFADDQGIYNGLTWWEQIDSGKQLTRNRKFLTVVPVVLYLIASHTTDYQHPMLFFNTLAVMVLVVAKFPNMHKVRIFGINADT

SEQ ID NO: 7484 - protein, 157 aa, Manihot esculenta
MANLYVKAVPPADLNKNTEWFMYPGVWTTYILILFFSWLLVLSIFGCSPGMAWTIVNLAHFCITYHFFHWKKGTPFAEDQGIYNSLTWWEQIDNGKQLTRNRKFLTVVPVVLYLIASHTTDYQHPMLFLNTLAVTVLVIAKFPNMHKVRIFGINADK

SEQ ID NO: 7485 - protein, 157 aa, Cucurbita pepo
MASLYVKAVPPADLNRNTEWFLYPGVWTTYILILFFVWLLVLSVFGCSPGMAWTIVNLSHFAVTYHFFHWKKGTPFAEDQGMYNRLTWWEQIDNGKQLTRNRKFLTVVPVVLYLIASHTTDYQHPMLFLNTLAVIVLVIAKFPHMHKVRIFGINADK

SEQ ID NO: 7486 - protein, 157 aa, Gossypium raimondii
MANLYVKAVPPADLNRNTEWFMYPGVWTTYILFLFFSWLLVLSIFGCSPGMAWTIVNLAHFLVTYHFFHWKKGTPFADDQGIYNGLTWWEQIDNGKQLTRNRKFLTVVPVVLYLIASHTTDYQHPMLFLNTLAVIILVVAKFPNMHKVRIFGINADK

SEQ ID NO: 7487 - protein, 157 aa, Prunus persica
  Sequence also found in Organisms: Prunus mume
MASLYVKAVPPADLNRNTEWFMYPGVWTTYILILFFSWLLVLSIFGCSPGMAWTIVNLSHFLVTYHFFHWKKGTPFAEDQGIYNGLTWWEQMDSGKQLTRNRKFLTVVPVVLYLIASHTTDYQHPMLFFNSLAVIVLVIAKFPNMHKVRIFGINGDK

SEQ ID NO: 7488 - protein, 157 aa, Fragaria vesca
MASLYVKAVPPADLNRNTEWFMYPGVWTTYILILFFSWLLVLSIFGCSPGMAWTIVNLSHFLVTYQFFHWKKGTPFAEDQGIYNGLTWWEQMDNGKQLTRNRKFLTVVPVVLYLIASHTTDYQHPMLFLNTLAVIVLVIAKFPNMHKVRIFGINGDK

SEQ ID NO: 7489 - protein, 157 aa, Amaranthus tuberculatus
MANLYVKASPPADLNRNTEWFTYPGVWTTYILILFFSWLLVLSVFGCTPGMAWTVVNLAHFLVTYHFFHWKKGTPFSDDQGIYNRLTWWEQIDNGKQLTRNRKFLTVVPVVLYLIASHTTDYEHPMLFFNTIAMLVLVIAKFPNMHKVRIFGINGDE

SEQ ID NO: 7490 - protein, 157 aa, Vaccinium corymbosum
MANYYVKAEPPTDLNRNTEWFTYPGVWTTYILILFFSWLLVLSIFGCSPGMAWTIVNLSHFAVTYHFFHWKKGTPFADDQGIYNSLTWWEQIDNGKQLTRNRKFLTVVPVVLYLIASHTTDYQNPMLFLNTLAVMVLVIAKFPNMHKVRIFGINGDL

SEQ ID NO: 7491 - protein, 157 aa, Actinidia deliciosa
MPNLYVKAAPPADLNRNTEWFTYPGVWTTYILILFFSWLLVLSIFGCSPGMAWTIVNLSHFAVTYHFFHWKKGTPFADDQGIYNGLTWWEQIDSGKQLTRNRKFLTVVPVVLYLIASHTTDYQHPMLFFNTLAVIILVIAKFPNMHKVSIFGINGDQ

SEQ ID NO: 7492 - protein, 157 aa, Rosa hybrid cultivar
MASLYVKAVPPADLNRNTEWFMYPGVWTTYILILFFSWLLVLSIFGCSPGMAWTIVNLSHFVVTYQFFHWKKGTPFAEDQGIYNGLTWWEQMDNGKQLTRNRKFLTVVPVVLYLIASHTTDYQHPMLFLNTLAVIVLVIAKFPNMHKVRIFGINGDK

SEQ ID NO: 7493 - protein, 157 aa, Trifolium pratense
MANLYVKAVPPADLNRNTEWFTYPGVWTTYILILFFTWILVLSVFGCSPGIAWTIVNLAHFLVTYHFFHWKKGTPFADDQGIYNRLTWWEQVDNGKQLTRNRKFLTVVPLVLYLIASHTTDYEHPMLFFNTVAVIVLVVAKFPNMHKVRIFGINADK

SEQ ID NO: 7494 - protein, 157 aa, Cyclamen graecum
MANLYVKAVPPLDLNRNTEWFTYPGVWTTYILILFFSWLVVLSIFGCSPGMAWSIVNLSHFAVTYHFFHWKKGTPFADDQGMYNALTWWEQIDNGKQLTRNRKFLTVVPVVLYLIASHTTDYQHPMLFFNTLAVIVLVIAKFPNMHKVRIFGINGEG

SEQ ID NO: 7495 - protein, 157 aa, Malus domestica
MASLYVKAVPPADLNRNTEWFMYPGVWTTYILILFFSWLLVLSIFGCSPGMAWTIVNLSHFAVTYHFFHWKKGTPFADDQGIYNGLTWWEQMDSGKQLTRNRKFLTVVPVVLYLIASHTTDYQHPMLFFNSLAVIVLVIAKFPNMHKVRIFGINGDK

SEQ ID NO: 7496 - protein, 157 aa, Vaccinium corymbosum
MANLYVKAVPPTDLNRNTEWFTYPGVWTTYILILFFSWLLVLSLFGCSPGMAWTIVNFSHFLVTYHFFHWKKGTPFADDQGIYNGLTWWEQIDSGKQLTRNRKFLTVVPVVLYLIASHTTDYQHPMLFFNTLAVFVLVVAKFPNMHKVRIFGINGDQ

SEQ ID NO: 7497 - protein, 157 aa, Eucalyptus grandis
MANLYVKAVPPADLNRNTEWFMYPGVWTTYILILFFSWLLVLSLTACSPGMAWTVVNLSHFLVTYHFFHWKKGTPFSEDQGIYNSLTWWEQMDNGKQLTRNRKFLTVVPVVLYLIASHTTDYQNPMLFLNTLAVIVLVVAKFPNMHKVRIFGINADK

SEQ ID NO: 7498 - protein, 157 aa, Nicotiana tabacum
MANLYVKAVPPADLNRNTDWFMYPGVWTTYILILFFSWLLVLSLFGCSPGIAWTVVNLGHFLVTYHFFHWKKGTPFADDQGMYNQLTWWEQIDNGKQLTRNRKFLTVVPVVLYLIASHTTDYQHPMLFFNTIAVMVLVIAKFPNMHKVRIFGINEDP

SEQ ID NO: 7499 - protein, 187 aa, Catharanthus roseus
MANLYVKASPPTDLNRNTEWFTYPGVWTTYILILFFSWLMVLSVFGCSPGMAWTVVHLSHFLVTYHFFHWKKGTPFAEDQGIYNRLTWWEQVDNGKQLTRNRKFLTVVPVVLYLIASHTTDYQHPTAILQHSGSFRTSGCQVPPLCTRFAFLGLMQISDWRRGDPLKRLHKKVIYPFYYIFRHSFGI

SEQ ID NO: 7500 - protein, 136 aa, Sarracenia psittacina
MYPGVWTTYILILFFSWLVVLSVFGCSPGMAWTIVHLSHFLVTYHFFHWKKGTPFADDQGIYNRLTWWEQIDNGKQLTRNRKFLTVVPVVLYLIASHTTDYQHPMLFFNTLAVFVLVVAKFPHMHKVRIFGINADQ

SEQ ID NO: 7501 - protein, 85 aa, Sarracenia psittacina
MANLYVKATPPVDLNRNTEWFTYPGVWTTYILILFFSWLLVLSVFRCTPGMAWTVVNLSHFAVTYHFFHWKKELHLQMTRGSITH

SEQ ID NO: 7502 - protein, 113 aa, Euphorbia peplus
MASLYVKAVPPADLNRNTEWFMYPGVWTTYILILFFSWLAVLSVSGCSPGMAWTIVNLGHFCVTYHFFHWKKGTPFSEDQGIYNRLTWWEQIDNGKQLTRNRKFLTVVPVCCI

SEQ ID NO: 7503 - protein, 178 aa, Capsicum annuum
MANLYVKAVPPADLNRNTDWFMYPGVWTTYILILFFSWILVLSLFGCSPGMAWTVVNLGHFLVTYHFFHWKKGTPFADDQGMYNQLTWWEQIDNGKQLTRNRKFLTVVPVVLYLIASHTTDYQHPMLFFNTIAVTVLVIAKFPNMHKVRIFGITAIRKCFFFCVQFDCFSEFKLSHPP

SEQ ID NO: 7504 - protein, 157 aa, Amsonia hubrichtii
MANLYVKAVQPADLNRNTEWFMYPGVWTTYILILFFAWLIVLSLFGCTPGMAWTIVNLSHFAVTYHFFHWKKGTPFADDQGIYNRLTWWEQIDNGKQLTRNRKFLTVVPVVLYLIASHTTDYQNPMLFFNTLAVLVLVVAKFPNMHKVRIFGINGDQ

SEQ ID NO: 7505 - protein, 157 aa, Phaseolus vulgaris
MANLYVKAVPPADLNRNTEWFTYPGVWTTYILILFFSWILVLSVFGCSPGIAWTIVNLVHFAVTYHFFHWKKGTPFAEDQGIYNRLTWWEQVDNGKQLTRNRKFLTVVPLVLYLIASHTTDYQNPMLFFNTVAVIVLVVAKFPHMHKVRIFGINADK

SEQ ID NO: 7506 - protein, 157 aa, Cannabis sativa
MAKLYVKAVPPPDLNRNTEWFTYPGVWTTYILILFFAWLIVLSIIGCSPGMAWTIVNLGHFLVTYHFFHWKKGTPFPDDQGIYNGLTWWEQIDNGKQLTRNRKFLTVVPVVLYLIASHTTDYQHPMLFLNTIAVVILVIAKFPNMHKVRIFGINADK

SEQ ID NO: 7507 - protein, 157 aa, Vigna unguiculata
  Sequence also found in Organisms: Cajanus cajan
MANLYVKAVPPADLNRNTEWFTYPGVWTTYILILFFSWILVLSVFGCSPGIAWTIVNLAHFAVTYHFFHWKKGTPFAEDQGIYNRLTWWEQVDNGKQLTRNRKFLTVVPLVLYLIASHTTDYQNPMLFFNTVAVIVLVVAKFPHMHKVRIFGINADK

SEQ ID NO: 7508 - protein, 157 aa, Euonymus alatus
MASLYVKAVPPADLNRNTEWFMYPGVWTTYILILFFSWLLVLSVFNCSPGMAWTIVNLAHFGVTYHFFHWKKGTPFAEDQGIYNRLTWWEQIDSGKQLTRNRKFLTVVPIVLYLIASHTTDYQHPMLFFNTLAVLVLVIAKLPNMHKVRIFGINDDQ

SEQ ID NO: 7509 - protein, 157 aa, Lupinus angustifolius
MANLYVKAVPPPDLNRNTEWFTYPGVWTTYILILFFSWILVLSVFGCSPGIAWTTVNLAHFAVTYHFFHWKKGTPFADDQGIYNRLTWWEQIDNGKQLTRNRKFLTVVPLVLYLIASHTTDYQHPMLFYNTFAVIVLVVAKFPNMHKVRIFGINADK

SEQ ID NO: 7510 - protein, 157 aa, Medicago truncatula
MANLYVKAVPPADLNRNTEWFTYPGVWTTYILILFFSWIMVLSVFGCSPGIAWTIVNLAHFLVTYHFFHWKKGTPFADDQGIYNRLTWWEQVDNGKQLTRNRKFLTVVPLVLYLIASHTTDYEHPMLFFNTVAVIVLVVAKFPNMHKVRIFGINADK

SEQ ID NO: 7511 - protein, 157 aa, Arachis hypogaea
MANLYVKAVPPPDLNRNTEWFTYPGVWTTYILILFFSWLLVLSVFGCSPGMAWTTVNLAHFAVTYHFFHWKKGTPFADDQGIYNRLTWWEQIDNGKQLTRNRKFLTVVPLVLYLIASHTTDYQNPMLFFNTVAVMVLVIAKFPHMHKVRLFGINADK

SEQ ID NO: 7512 - protein, 157 aa, Rhizophora mangle
MANLYVKEVPPADLNRNTEWFMYPGVWTTYILILFFAWLLVLSVFGCSPGMAWTIVNLSHFVITYHFFHWKKGTPFADDQGIYNGLTWWEQMDNGKQLTRNRKFLTVVPVVLYLIASHTTDYQHPMLFFNTLAVMVLVVAKFPNMHKVRIFGINGDK

SEQ ID NO: 7513 - protein, 157 aa, Trigonella foenum-graecum
MANLYVKAVPPADLNRNTEWFTYPGVWTTYILILFFSWIMVLSVFGCSPGIAWTIVNLVHFLVTYHFFHWKKGTPFADDQGIYNRLTWWEQVDNGKQLTRNRKFLTVVPLVLYLIASHTTDYEHPMLFFNTVAVIVLVVAKFPNMHKVRIFGINADK

SEQ ID NO: 7514 - protein, 157 aa, Valeriana officinalis
MANLYVQAVPPTDLNKNTEWFTYPGVWTTYISILFFAWLVVLSVFGCSPGMAWTVVHLAHSLVTYQFFHWKKGTPFADDQGIYNRLTWWEQIDNGKQLTRNRKFLTVVPVVLYLIASHTTDYQHPMLFFNTLAVFVLVVAKFPNMHKVRIFGINADQ

SEQ ID NO: 7515 - protein, 158 aa, Euphorbia peplus
MASLYVKAVPPADLNRNTEWFMYPGVWTTYILILFFCWLVVLSVSGCSPGTAWTVVNLGHFCVTYHFFHWKKGTPFSEDQGIYNRLTWWEQIDSGKQLTRNRKFLTVVPVVLYLIASHTTDYQHPMLFLNTLAVAVLVIAKFPNMHKVRIFGINADDR

SEQ ID NO: 7516 - protein, 107 aa, Sarracenia psittacina
MAWTVVNLSHFAVTYHFFHWKKGTPFADDQGIYNALTWWEQIDNGKQLTRNRKFLTVVPVVLYLIASHTTDYQHPMLFFNTLAVIVLVVAKFPNMHKVRIFGINGDQ

SEQ ID NO: 7517 - protein, 157 aa, Vicia sativa
MANLYVKAVPPADLNRNTEWFTYPGVWTTYILILFFTWILVLSVFGCSPGIAWTIVNLAHFLVTYHFFHWKKGTPFADDQGIYNRLTWWEQVDNGQQLTRNRKFLTVVPLVLYLIASHTTDYEHPMLLFNTIAVIVLVVAKFPNMHKVRIFGINADK

SEQ ID NO: 7518 - protein, 157 aa, Amsonia hubrichtii
MASLYVKAVPPTDLNRNTEWFTYPGVWTTYILILFFSWLMVLSVFGCSPGMAWTVVHLSHFLVTYHFFHWKKGTPFAEDQGIYNRLTWWEQVDSGKQLTRNRKFLTVVPVVLYLIASHTTDYQHPMLFFNTVAVFILVVAKFPHMHKVRIFGINADQ

SEQ ID NO: 7519 - protein, 157 aa, Cicer arietinum
MANLYVKAVPPADLNRNTEWFTYPGVWTTYILILFFSWILVLSVFGCSPGIAWTIVNLAHFLVTYHFFHWKKGTPFADDQGIYNRLTWWEQVDNGKQLTRNRKFLTVVPLVLYLIASHTTDYEHPMLFFNTVAVFVLVVAKFPHMHKVRIFGINADK

SEQ ID NO: 7520 - protein, 157 aa, Humulus lupulus
MANLYVKAVPPPDLNRNTEWFTYPGVWTSYILILFFAWLIVLSIIGCSPGMAWTIVNLGHFLVTYHFFHWKKGTPFPDDQGIYNGLTWWEQIDSGKQLTRNRKFLTVVPVVLYLIASHTTDYQHPMLFLNTIAVVILVIAKFPNMHKVRIFGINADK

SEQ ID NO: 7521 - protein, 157 aa, Lupinus angustifolius
MANLYVKAVPPPDLNRNTEWFTYPGVWTTYILILFFSWILVLSVFGCSPGIAWTTVNVAHFAVTYHFFHWKKGTPFADDQGMYNRLTWWEQIDNGKQLTRNRKFLTVVPLVLYLIASHTTDYQHPMLLFNTLAVIVLVVAKFPNMHKVRIFGINADK

SEQ ID NO: 7522 - protein, 157 aa, Tropaeolum majus
MANLYVKAVQPVDLNKNTEWFMYPGVWTTYILILLFAWLLVLSVFGCSPGMAWTLVNLGHFLVTYHFFHWKKGTPFADDQGIYNRLTWWEQIDSGKQLTRNRKFLTVVPLVLYLIASHTTDYQHPMLLFNTLAVIVLVVAKFPNMHKVRIFGINGDT

SEQ ID NO: 7523 - protein, 157 aa, Olea europaea
MANLYVQAVPPTDMNRNTEWFTYPGVWTTYILILFFSWLVVLSVFGCSPGMAWTIVHLSHFLVTYHCFHWKKGTPFSEDQGIYNRLTWWEQIDNGKQLTRNRKFLTVVPVVLYLIASHTTDYQHPMLFFNTLAVFILVVAKFPNMHKVRIFGINADQ

SEQ ID NO: 7524 - protein, 156 aa, Chenopodium quinoa
MANLYVKASPPADLNRNTEWFTYPGVWTTYILFLFFSWLLVLSVFGCSPGMAWTVVNLAHFLVTYHFFHWKKGTPFSDDQGIYNRLTWWEQVDNGKQLTRNRKFLTVVPVVLYLIASHTTDYQHPMLFFNTIAMIILVVAKFPHMHKVRIFGINGE

SEQ ID NO: 7525 - protein, 158 aa, Malus domestica
MASLYVKAVPPADLNRNTEWFMYPGVWTTYILILFFSWLLVLSIFGCSPGMAWTIVNLSHFAITYHFFHWKKGTPFAEDQGIYNGLTWWEQMDSGKQLTRNRKFLTVVPVVLYLIASHTTDYQHPMLFFNSLAVIVLVIAKFLNMHKVRIFGINGEDK

SEQ ID NO: 7526 - protein, 157 aa, Artemisia annua
MAKLYVQAEPPTDLNRNTEWFMYPGVWTTYILILFFAWLVVLSVTGCSPGMAWTVVNLGHALVTYHFFHWKKGTPFADDQGIYNRLTWWEQIDSGKQLTRNRKFLTVVPVVLYLIASHTTDYQNPMLFLNTLAVFVLVIAKFPHMHKVRIFGINAEE

SEQ ID NO: 7527 - protein, 157 aa, Coffea canephora
MAKLYVKAVPPADLNRNTEWFTYPGVWTTYILILFFSWLLVLSIFGCTPGMAWTIVNLSHFVVTYQFFHWKKGTPFADDQGIYNALTWWEQIDNGKQLTRNRKFLTVVPVVLYLIASHTTDYQNPMLFFNTVAVLVLVVAKFPNMHKVRIFGINGEQ

SEQ ID NO: 7528 - protein, 157 aa, Echinacea purpurea
MANLYVQAVPPTDLNRNTEWFMYPGVWTTYILILFFAWLVVLSVTGCSPGMAWTTVNLIHALVTYHFFHWKKGTPFADDQGIYNRLTWWEQIDSGKQLTRNRKFLTVVPVVLYLIASHTTDYQNPMLFFNTLAVFVLVIAKFPHMHKVRIFGINAEE

SEQ ID NO: 7529 - protein, 156 aa, Solanum melongena
MANLYVKAVPPADLNRNTDWFMYPGVWTTYILILFFSWLVLTAFGCSPGMAWTVVNLSHFVITYHFFHWKKGTPFADDQGIYNQLTWWEQIDNGKQLTRNRKFLTVVPVVLYLIASHTTDYQHPMLFLNTIAVTVLVIAKFPNMHKVRIFGINEDP

SEQ ID NO: 7530 - protein, 157 aa, Fraxinus spp
MANLYVQAEPTTDLNRNTEWFTYPGVWTTYILILFFSWLIVLSVFGCSPGMAWTIVHISHFLVTYHFFHWKKGTPFPEDQGVYNRLTWWEQIENGKQLTRNRKFLTVVPVVLYLIASHTTDYQHPMLFFNTLAVFVLVVAKFPRMHKVRIFGINADQ

SEQ ID NO: 7531 - protein, 157 aa, Actinidia deliciosa
MANLYVRAIPPTDLNRNTEWFTYPGVWSTYILILFFSWLVVLSVFGCSPGMAWTIVHLSHFLVTYQFFHWKKGTPFADDQGIYNRLTWWEQIENGKQLTRNRKFLTVVPVVLYLIASHTTDYQHPMLFFNTLAVFVLVVAKFPHMHKVRIFGINADQ

SEQ ID NO: 7532 - protein, 157 aa, Olea europaea
MAKLYVQAVPPTDLNRNTEWFTYPGVWTTYILILFFSWLIVLSVFGCSPGMAWTIVHLSHFLVTYHFFHWKKGTPFSEDQGIYNRLTWWEQIENGKQLTRNRKFLTVVPVVLYLIASHTTDYQHPMLFFNTLAVFILVVAKFPHMHKVRIFGINADQ

SEQ ID NO: 7533 - protein, 157 aa, Populus trichocarpa
MANLYVTAVPPADLNRNTEWFMYPGVWTTYILILFFSWLIVLSIFACSPGMAWTIVNLSHFAITYHFFHWKKGTPFAEDQGIYNRLTWWEQMDSGKQLTRNRKFLTVVPLVLYLIASHTTDYRHPMLFFNTVAVIVLVVAKFPNMHKVRIFGINADK

SEQ ID NO: 7534 - protein, 157 aa, Populus trichocarpa
MANLYVTAVPTADLNRNTEWFMYPGVWTTYILILFFFWLIVLAIFGCSPGLAWTIVNLSHFAITYHFFHWKKGTPFAEDQGIYNRLTWWEQIDKGKQLTRNRKFLTVVPVVLYLIASHTTDYQHPMLIFNTLAVMVLVVAKFPNMHKVRIFGINADK

SEQ ID NO: 7535 - protein, 157 aa, Glycine max
MAKLYVKAVPPADLNRNTEWFTYPGVWTTYILILFFSWILVLSVFGCSPGIAWTIVNLAHFAVTYHFFHWKKGTPFAEDQGIYNRLTWWEQVDNGKQLTRNRKFLTVVPLVLYLIASHTTDYQNPMLLFNTVAVIVLVVAKFPHMHKVRIFGINADK

SEQ ID NO: 7536 - protein, 157 aa, Glycine max
MANLYVKAVPPADLNRNTEWFTYPGVWTTYILILFFSWILVLSVFGCSPGIAWTIVNLAHFAVTYHFFHWKKGTPFAEDQGIYNRLTWWEQVDNGKQLTRNRKFLTVVPLVLYLIASHTTDYQNPMFLFNTVAVIVLVVAKFPHMHKVRIFGINADK

SEQ ID NO: 7537 - protein, 157 aa, Tabernaemontana elegans
MANLYVKADPPTDLNRNTEWFTYPGVWTTYILILFFSWLMVLSVFGCSPGMAWTVVHLSHFLVTYHFFHWKKGTPFADDQGIYNRLTWWEQVDSGKQLTPNRKFLTVVPVVLYLIASHTTDYQHPMLFLNTVAVFVLVVAKFPHMHKVRIFGINADQ

SEQ ID NO: 7538 - protein, 157 aa, Vinca minor
MASLYVKAVPPTDLNRNTEWFTYPGVWTTYILIVFFAWLMVLSVFGCSPGMAWTVVHLAHFLITYHFFHWKKGTPFADDQGIYNRLTWWEQVDSGKQLTRNRKFLTVVPVVLYLIASHTTDYQHPMLFFNTVAVFVLVVAKFPHMHKVRIFGINADQ

SEQ ID NO: 7539 - protein, 158 aa, Primula obconica
MAKLYVKAVQPADLNRNTEWFTYPGVWTTYILILFFAWLIVLSLFGCSPGMAWSIVNIGHFAVTYHFFHWKKGTPFADDQGMYNALTWWEQIDNGKQLTRNRKFLTVVPVVLYLIASHTTDYQHPMLFFNTLSVIVLVIAKFPNMHKVRIFGINGEDQ

SEQ ID NO: 7540 - protein, 85 aa, Amorphophallus konjac
MAKLYVEASPPPDLNKNTEWFMYPGVWTTYILILFFFWLIVLSVFGCAPGMAWTIVNLFHFVVTYHFFHWKRELPLLKTRVSITH

SEQ ID NO: 7541 - protein, 81 aa, Guizotia abyssinica
MSKRCHRRISTEIPSGSCIPASGPPTYSSCSSLGSSFSPSPAVLPAWLEPPSISVMLSLHITSFTGRREHLLLRTKVSTTG

SEQ ID NO: 7542 - protein, 157 aa, Chrysanthemum coronarium
MAKLYVQAVQPTDLNRNTEWFMYPGVWTTYILILFFAWLVVLSITGCSPGMAWTVVNLGHALVTYHFFHWKKGTPFADDQGIYNRLTWWEQIDSGKQLTRNRKFLTVVPVVLYLIASHTTDYQYPMLFLNTLAVFVLVIAKFPHMHKVRIFGINAEE

SEQ ID NO: 7543 - protein, 157 aa, Chrysanthemum coronarium
MAKLYVQAEQPTDLNRNTEWFMYPGVWTTYILILFFAWLVVLSVTGCSPGMAWTVVNLGHALVTYHFFHWKKGTPFADDQGIYNRLTWWEQIDSGKQLTRNRKFLTVVPVVLYLIASHTTDYQNPMLFLNTLAVFVLVIAKFPHMHKVRIFGINAEE

SEQ ID NO: 7544 - protein, 157 aa, Arnica chamissonis
MANLYVRAEPPTDLNRNTEWFMYPGVWTTYILILFFAWLVVLSVTGCSPGMAWTTVNLCHALITYHFFHWKKGTPFADDQGIYNRLTWWEQIDSGKQLTRNRKFLTVVPVVLYLMASHTTDYQNPMLFLNTLAVFVLVIAKFPNMHKVRIFGINAEE

SEQ ID NO: 7545 - protein, 157 aa, Beta vulgaris
MANLYVKASPPPDLNRNTEWFTYPGVWTTYILFLFFAWLLVLSVSGCTPGMAWTIVNLGHFAVTYHFFHWKKGTPFSDDQGIYNRLTWWEQIDNGKQLTRNRKFLTVVPVVLYLIASHTTDYEHPMLFFNTIAMIILVIAKFPHMHKVRIFGINGDQ

SEQ ID NO: 7546 - protein, 157 aa, Centaurea maculosa
  Sequence also found in Organisms: Cirsium arvense, Carthamus tinctorius
MANLYVQAVPPTDLNRNTEWFMYPGVWTTYILILFFAWLVVLSISGCSPGMAWTTVNLGHALVTYHFFHWKKGTPFADDQGIYNRLTWWEQIDSGKQLTRNRKFLTVVPVVLYLIASHTTDYQNPMLLLNTLAVFVLVIAKFPHMHKVRIFGINAEE

SEQ ID NO: 7547 - protein, 157 aa, Panax ginseng
MANYYVKATPPTDLNKNTEWFTYPGVWTTYILILFFAWLVVLSVLNCSPGMAWTIVHLSHFLITYHFFHWKKGTPFADDQGIYNGLTWWEQIDNGQQLTRNRKFLTVVPVVLYLIASHTTDYQHPMLFLNTLAVIVLVIAKFPNMHKVRIFGINGDQ

SEQ ID NO: 7548 - protein, 154 aa, Humulus lupulus
MYVQAVPPTDLNRNTEWFTYPGVWTTYILILFFSWLTVLSIFGCSSGMAWTIVHLAHFLVTYHFFHWKKGTPFADDQGIYNGLTWWEQIDNGKQLTRNRKFLTVVPVVLYLIASHTTDYEHPMLFFNTLAVFVLVVAKFPNMHKVRIFGINADH

SEQ ID NO: 7549 - protein, 157 aa, Ipomoea nil
MANLYVKAVPPADMNRNTEWFTYPGVWTTYILILFFSWLVVLSVFGCTPGTAWTIVNLSHFAITYHFFHWKKGTPFADDQGMYNRLTWWEQIDHGKQLTRNRKFLTVVPVVLYLIASHTTDYEHPMLFFNTLAVLVLVIAKFPNMHKVRIFGINGDQ

SEQ ID NO: 7550 - protein, 157 aa, Nicotiana benthamiana
MANLYVTAVPTTDLNRNTEWFTYPGVWTTYILILFFSWLVVLSIFGCSPGMAWTIVHLSHFLVTYQCFHWKKGTPFSDDQGIYNRLTWWEQIDNGKQLTRNRKFLTVVPVVLYLIASHTTDYQHPMLFFNTVAVFILVVAKFPNMHKVRIFGINADQ

SEQ ID NO: 7551 - protein, 157 aa, Elaeis guineensis
MAKLYVQAVPPADLNKNTEWFMYPGVWTTYILILFFSWLLVLSIFGCTPGMAWTIVNLFHFAITYHFFHWKKGTPFADDQGIYNTLTWWEQMDNGKQLTRNRKFLTVVPVVLYLIASHTTDYQHPMLFLNTLAVIVLVVAKLPNMHKVRIFGINAGN

SEQ ID NO: 7552 - protein, 157 aa, Elaeis guineensis
MAKLYVQAVPPADLNKNTEWFMYPGVWTTYILILFFSWLLVLSVFGCTPGMAWTVVNLFHFAVTYLFFHWKKGTPFAEDQGMYNSLTWWEQMDNGKQLTRNRKFLTVVPVVLYLLASHTTDYQNPMLFLNTLAVMVLVVAKFPNMHKVRIFGINADH

SEQ ID NO: 7553 - protein, 157 aa, Solanum lycopersicum
  Sequence also found in Organisms: Solanum tuberosum, Solanum phureja
MANYYVTAVPPTDLNRNTEWFTYPGVWTTYILILFFSWLVVLSVFGCSPGMAWTIVHLSHFLVTYQCFHWKKGTPFADDQGIYNRLTWWEQIDSGKQLTRNRKFLTVVPVVLYLIASHTTDYQHPMLFFNTIAVFVLVVAKFPNMHKVRIFGINADQ

SEQ ID NO: 7554 - protein, 157 aa, Sesamum indicum
MANLYVRAVMPTDLNRNTEWFTYPGVWTTYILILFFSWLVVLSVFGCSPGIAWTVVHLSHFVVTYQFFHWKKGTPFADDQGIYNRLTWWEQIDNGKQLTRNRKFLTVVPVVLYLIASHTTDYQHPMLFFNTLAVFILVVAKFPHMHKVRIFGINADQ

SEQ ID NO: 7555 - protein, 156 aa, Solanum lycopersicum
MANLYVKAVPPADLNRNTDWFMYPGVWTTYILILFFSWLVLTAFGCSPGMAWTVVNLSHFIVTYHFFHWKKGTPFADDQGMYNQLTWWEQIDNGKQLTRNRKFLTVVPVVLYLIASHTTDYQQPMLFFNTIAVTVLVVAKFPNMHKVRIFGINGDP

SEQ ID NO: 7556 - protein, 140 aa, Cajanus cajan
MSEINDGPSDAGGTTEDGENEDPRKEKDEDVGGPNAGVSEPLRVPVQIRRWHRLHVQIRHPNKQNHHRCAKPQLRDPNAKASTFQMGALMGAQNSKTQTETQPFLSLSLSLSLSFLSEAFCDAKIKIKKKKAKIILSFTR

SEQ ID NO: 7557 - protein, 157 aa, Cocos nucifera
MAKLYVQAVHPADLNKNTEWFMYPGVWTTYILILFFSWLLVLSIFGCTPGMAWTIVNLFHFAITYHFFHWKKGTPFADDQGIYNTLTWWEQMDNGKQLTRNRKFLTVVPVVLYLIASHTTDYQHPMLFLNTLAVIVLVVAKLPNMHKVRIFGINAGN

SEQ ID NO: 7558 - protein, 157 aa, Ananas comosus
MAKLYVQTAPPPDLNKNTEWFMYPGVWTTYILILFFSWLIVLSVFGCTPGMAWTVVNLFHFAVTYHFFHWKKGTPFAEDQGIYNTLTWWEQMDNGKQLTRNRKFLTVVPVVLYLIASHTTDYQHPMLFLNTLAVFVLVVAKFPNMHKVRIFGINAGS

SEQ ID NO: 7559 - protein, 157 aa, Arnica chamissonis
MANLYVQAEPPTDLNKNTEWFTYPGVWTTYILILFFAWLVVLSVFGCSPGMAWTTVNLSHALLTYQFFHWKKGTPFADDQGIYNRLTWWEQIDSGKQLTRNRKFLTLVPVVLYLIASHTTDYQNPMLFFNTVAVFVLVVAKFPNMHKVRIFGINAEE

SEQ ID NO: 7560 - protein, 157 aa, Bupleurum chinense
MANYYVKATPPADLNKNTEWFTYPGVWTTYILILFFAWLVVLSILNCSPGMAWTIVHLSHFLVTYHFFHWKKGTPFADDQGIYNGLTWWEQVDNGKQLTRNRKFLTVVPVVLYLIASHTTDYQHPMLLLNTIAVAVLVIAKFPNMHKVRIFGINGEQ

SEQ ID NO: 7561 - protein, 154 aa, Cannabis sativa
MYVQAVPPTDLNRNTEWFTYPGVWTTYILILFFSWLTVLSIFGCSSGMAWTIVHLAHFLVTYHFFHWKKGTPFADDQGIYNGLTWWEQIDSGKQLTRNRKFLTVVPVVLYLIASHTTDYEHPMLFFNTLAVFVLVVAKFPNMHKVRIFGINADH

SEQ ID NO: 7562 - protein, 157 aa, Cichorium intybus
MANLYVQAVPPTDLNRNTEWFMYPGVWTTYILILFFAWLVVLSVSGCSPGMAWTTVNLGHALVTYHFFHWKKGTPFADDQGIYNRLTWWEQIDSGKQLTRNRKFLTVVPVVLYLIASHTTDYQNPMLFLNTVAVFVLVIAKFPHMHKVRIFGINAEE

SEQ ID NO: 7563 - protein, 155 aa, Cleome gynandra
MANLYVKAVPPADLNRNTEWFMYPGVWTTYILILFFAWLVFLSVFGCSPGMAWTVVNLAHFAVTYHFFHWKKGTPFAEDQGMYNSLTWWEQMDEGKQLTRNRKFLTVVPVVLYLIASHTTDYKHPWLFLNTLAVIILVVAKFPNMHKVRIFGING

SEQ ID NO: 7564 - protein, 157 aa, Taraxacum officinale
MANLYVQAVPPTDLNRNTEWFMYPGVWTTYILILFFAWLVVLSVSGCSPGMAWTTVNLCHALVTYHFFHWKKGTPFADDQGIYNRLTWWEQIDSGKQLTRNRKFLTVVPVVLYLIASHTTDYQNPMLFLNTVAVFVLVIAKFPHMHKVRIFGINAEE

SEQ ID NO: 7565 - protein, 157 aa, Fagopyrum esculentum
MANLYVKAVPTTDLNRNTEWFMYPGVWTTYILILFFAWLVVLSVFGCTPGMAWTIVNLVHFAVTYHFFHWKKGTPFSEDQGIYNRLTWWEQVDNGKQLTRNRKFLTVVPIVLYLIASHTTDYQHPMLFFNTLAVFILVVAKFPHMHKVRIFGINGDQ

SEQ ID NO: 7566 - protein, 157 aa, Flaveria ramosissima
MANLYVQAEPPTDLNRNTEWFMYPGVWTTYILILFFAWLVVLAVTGCSPGMAWTTVNLCHALITYHFFHWKKGTPFADDQGIYNRLTWWEQIDSGKQLTRNRKFLTVVPVVLYLIASHTTDYQNPMLFLNTLAVFVLVIAKFPHMHKVRIFGINAEE

SEQ ID NO: 7567 - protein, 157 aa, Panax ginseng
MANYYVKATPPTDLNKNTEWFTYPGVWTTYILILFFAWLVVLSVLNCSPGMAWTIVHLSHFLITYHFFHWKKGTPFADDQGIYNGLTWWEQIDNGQQLTRNRKFLTVVPVVLYLIASHTTDYRHPMLFLNTLAVIVLVIAKFPNMHKVRIFGINGDQ

SEQ ID NO: 7568 - protein, 157 aa, Lactuca sativa
MANLYVQAVPPTDLNRNTEWFMYPGVWTTYILILFFAWLVVLSVSGCSPGMAWTTVNLCHALVTYHFFHWKKGTPFADDQGIYNRLTWWEQIDSGKQLTRNRKFLTVVPVVLYLIASHTTDYQNPMLFLNTIAVFVLVIAKFPHMHKVRIFGINAEE

SEQ ID NO: 7569 - protein, 154 aa, Tropaeolum majus
MYVRAVPPTDVNRNTEWFTYPGVWTTYILILFFAWLLVLSVFGCSPGMAWTIVHLSHFLVTYQFFHWKKGTPFADDQGIYNGLTWWEQIENGKQLTRNRKFLTVVPVVLYLIASHTTDYQHPMLFFNTLAVFVLVVAKFPHMHKVRIFGINADH

SEQ ID NO: 7570 - protein, 157 aa, Nicotiana benthamiana
MANLYVTAVPTTDLNRNTEWFTYPGVWTTYILILFFSWLVVLSVFGCSPGMAWTIVHLSHFLVTYQCFHWKKGTPFSDDQGIYNRLTWWEQIDNGKQLTRNRKFLTVVPVVLYLIASHTTDYQHPMLFFNTVAVFILVVAKFPNMHKVRIFGINADQ

SEQ ID NO: 7571 - protein, 157 aa, Elaeis guineensis
MAKLYVQAVPPADLNKNTEWFMYPGVWTTYILILFFSWLLVLSVFGCTPGMAWTIVNLFHFAITYHFFHWKKGTPFADDQGIYNTLTWWEQMDNGKQLTRNRKFLTVVPVVLYLIASHTTDYQHPMLFLNTLAVIVLVVAKLPNMHKVRIFGINAGN

SEQ ID NO: 7572 - protein, 157 aa, Senecio madagascariensis
MANLYVRAVPPTDLNRNTEWFMYPGVWTTYILILFFAWLVVLSVSGCSPGMAWTTVNLGHALVTYHFFHWKKGTPFADDQGIYNRLTWWEQIDSGKQLTRNRKFLTVVPVVLYLIASHTTDYQNPMLFLNTVAVFVLVIAKFPHMHKVRIFGINAEE

SEQ ID NO: 7573 - protein, 157 aa, Helianthus annuus
MANLYVQAVPPTDLNRNTEWFMYPGVWTTYILILFFAWLVVLSVTGCSPGMAWTTVNLCHALITYHFFHWKKGTPFADDQGIYNRLTWWEQIDSGKQLTRNRKFLTVVPVVLYLIASHTTDYQNPMLFLNTLAVFVLVIAKFPHMHKVRIFGINAEE

SEQ ID NO: 7574 - protein, 157 aa, Tragopogon dubius
MANLYVQAVPPTDLNRNTEWFMYPGVWTTYILILFFAWLVVLSVSGCSPGMAWTTVNLCHALVTYHFFHWKKGTPFADDQGIYNRLTWWEQIDSGKQLTRNRKFLTVVPVVLYLIASHTTDYQNPMLFMNTVAVFVLVIAKFPHMHKVRIFGINAEE

SEQ ID NO: 7575 - protein, 157 aa, Vinca minor
MVNLYVKAVPPTDLNRNTEWFTYPGVWTTYILIVFFSWLMVLSVFGCSPGLAWTVVHLCHFLVTYQFFHWKKGTPFADDQGIYNRLTWWEQVDSGKQLTRNRKFLTVVPVVLYLIASHTTDYQHPMLFFNTVAVFVLVVAKFPHMHKVRIFGINADQ

SEQ ID NO: 7576 - protein, 157 aa, Cocos nucifera
MAKLYVQAVPPADLNKNTEWFMYPGVWTTYILILFFSWLLVLSVFGCTPGMAWTIVNLFHFAITYHFFHWKKGTPFADDQGIYNTLTWWEQMDSGKQLTRNRKFLTVVPVVLYLIASHTTDYQHPMLFLNTLAVIVLVVAKLPNMHKVRIFGINAGN

SEQ ID NO: 7577 - protein, 157 aa, Ananas comosus
MAKLYVQAVPPADLNKNTEWFMYPGVWTTYILILFFSWLLVLSVFGCTPGTAWTIVNLGHFAITYHFFHWKKGTPFADDQGIYNRLTWWEQMDNGKQLTRNRKFLTVVPVVLYLIASHTTDYQHPMLFLNTLAVIVLVVAKLPNMHKVRIFGINAGD

SEQ ID NO: 7578 - protein, 157 aa, Ambrosia trifida
MANLYVQAEPPTDLNRNTEWFMYPGVWTTYILILFFAWLLVLAVTGCSPGMAWTTVNLSHALITYHFFHWKKGTPFADDQGIYNRLTWWEQIDSGKQLTRNRKFLTVVPVVLYLIASHTTDYENPMLFLNTVAVFVLVIAKFPHMHKVRIFGINAEE

SEQ ID NO: 7579 - protein, 157 aa, Amorphophallus konjac
MAKLYVQTAPPPDLNKNTEWFMYPGVWTTYILILFFSWLMVLSIFGCTPGMAWTIVNLFHFVVTYHFFHWKKGTPFAEDQGIYNTLTWWEQMDNGKQLTRNRKFLTVVPVVLYLIASHTTDYKQPMLFLNTLADIVLVVAKFPNMHKVRIFGINADN

SEQ ID NO: 7580 - protein, 157 aa, Antirrhinum majus
MANLYVRAVPPTDLNRNTEWFTYPGVWTTYILILFFSWLVVLSVFACSPGMAWTIVHLSHFLVTYHCFHWKKGTPFSDDQGIYNRLTWWEQIDSGNQLTRNRKFLTVVPVVLYLIASHTTDYQHPMLFLNTLAVFVLVVAKFPHMHKVRIFGINADQ

SEQ ID NO: 7581 - protein, 157 aa, Cirsium arvense
MANLYVQAVPPTDLNRNTEWFMYPGVWTTYILILFFAWLVVLSVTGCSPGMAWTTVNLGHALVTYHFFHWKKGTPFADDQGIYNRLTWWEQIDSGKQLTRNRKFLTVVPVVLYLIASHTTDYQNPMLLLNTVAVFVLVIAKFPHMHKVRIFGINAEE

SEQ ID NO: 7582 - protein, 157 aa, Cynara scolymus
MANLYVQAVPPTDLNRNTEWFMYPGVWTTYILILFFAWLVVLSVSGCSPGMAWTTVNLGHALVTYHFFHWKKGTPFADDQGIYNRLTWWEQIDSGKQLTRNRKFLTVVPVVLYLIASHTTDYQNPMLLLNTVAVFVLVIAKFPHMHKVRIFGINAEE

SEQ ID NO: 7583 - protein, 157 aa, Cynara scolymus
MANLYVQAEPPTDLNRNTEWFTYPGVWTTYILILFFAWLVVLSVFGCSPGMAWTTVNLSHALLTYHFFHWKKGTPFADDQGIYNRLTWWEQIDSGKQLTRNRKFITLVPVVLYLIASHTTDYQNPMLLLNTLAVFVLVVAKFPHMHKVRIFGINAEE

SEQ ID NO: 7584 - protein, 157 aa, Flaveria ramosissima
MANLYVQAEPPTDLNKNTEWFTYPGVWTTYILILFFAWLVVLSVFGCSPGMAWTIVNLSHALLTYQFFHWKKGTPFADDQGIYNRLTWWEQIDSGKQLTRNRKFLTLVPVVLYLIASHTTDYQNPMLFLNTVAVFVLVVAKFPNMHKVRIFGINAEE

SEQ ID NO: 7585 - protein, 157 aa, Panax ginseng
MAKYYVRAVPPTDLNKNTEWFTYPGVWTTYILILFFSWLVVLSVFNCSPGMAWTIVHLSHALVTYQCFHWKKGTPFADDQGIYNRLTWWEQIDNGKQLTRNRKFLTVVPVVLYLIASHTTDYQHPMLFFNTLAVFVLVVAKFPNMHKVRIFGINADQ

SEQ ID NO: 7586 - protein, 157 aa, Liriodendron tulipifera
MAKLYVNTMPPTDLNKNTEWFMYPGVWTTYILILFFSWLIVLSVFGCTPGMAWTIVHLSHFCVTYHFFHWKKGTPFAEDQGIYNGLTWWEQIDNGKQLTRNRKFLTVVPVVLYLIASHTTDYQHPMLFLNTLAVFVLVVAKFPNMHKVRIFGINADQ

SEQ ID NO: 7587 - protein, 157 aa, Plantago ovata
MANLYVTAEPTTDLNRNTEWFTYPGVWTTYILILFFSWLVVLSVFGCSPGMAWTIVHLSHSLVTYQCFHWKKGTPFSDDQGIYNRLTWWEQIDNGKQLTRNRKFLTVVPVVLYLIASHTTDYQNPMLFFNTFAVFVLVVAKFPHMHKVRIFGINADQ

SEQ ID NO: 7588 - protein, 156 aa, Solanum tuberosum
  Sequence also found in Organisms: Solanum phureja
MPNLYVKAVPPADLNRNTDWFMYPGVWTTYILILFFSWLVLTAFGCSPGMAWTVVNLSHFIVTYHFFHWKKGTPFADDQGMYNQLTWWEQIDNGKQLTRNRKFLTVVPVVLYLIASHTTDYQQPMLFFNTIAVTVMVVAKFPNMHKVRIFGINGDP

SEQ ID NO: 7589 - protein, 157 aa, Sesamum indicum
MGKLYVKMDPPADLNRNTEWFTYPGVWTTYILILFFSWLIVLSLTNCTPGMAWTILNLSHFAVTYHFFHWKKGTPFGDDQGIYNGLTWWEQIDNGKQLTRNRKFLTVVPVVLYLIASHTTDYQHPMLFFNTLAVLVLVIAKFPNMHKVRIFGINGDQ

SEQ ID NO: 7590 - protein, 157 aa, Silene vulgaris
MANLYVKAMPSADLNRNTEWFTYPGVWTTYILFLFIAWLVVLSVFGCSSGMAWTVVNLAHFAVTYHCFHWKKGTPFSEDQGIYNRLTWWEQVDSGKQLTRNRKFLTVVPVVLYLIASHTTDYQHPMLFLNTVAVTILVIAKFPHMHKVRIFGINGDQ

SEQ ID NO: 7591 - protein, 157 aa, Thalictrum flavum
MAKLYVQTVPPPDLNKNTEWFMYPGVWTTYILILFFAWLMVLSVFGCTPGMAWTIVNLCHFAVTYHFFHWKKGTPFAEDQGIYNGLTWWEQIDNGKQLTRNRKFLTVVPVVLYLIASHTTDYQQPMLFLNTLAVFILVVAKFPNMHKVRIFGINADQ

SEQ ID NO: 7592 - protein, 85 aa, Flaveria ramosissima
MANLYVQAEPPTDLNKNTEWFTYPGVWTTYILILFFAWLVVLSVFGCSPGMAWTIVNLSHALLTYQFFHWKRAHLLLMIRVSTTG

SEQ ID NO: 7593 - protein, 199 aa, Flaveria ramosissima
LGQNIVQFLNSIVQSIWGNCSSQSQFQFINNILVKLITIRKEHPDDVREGDSDNRFESKHRLVHVPRRMDNIHCILFFSWLLVLSVFGCTPGMAWTIVNLSHFIVTYHFFHWMKGTPFAEDQGIYNRLTWWEQIDNGKQLTRNRKFLTVVPVVLYLIASHTTDYQQPMLFLNTVAVIVLVIAKFPNMHKVRIFGINGDM

SEQ ID NO: 7594 - protein, 128 aa, Flaveria ramosissima
MANLYVQAEPPTDLNKNTEWFTYPGVWTTYILILFFAWLVVLSVFGCSPGMAWTIVNLSHALLTYQFFHWKKGTPFADDQGIYNRLTWWEQIDSGKQLTRNRKFLTLVPVVLYLIASHTTDYQNPMLF

SEQ ID NO: 7595 - protein, 84 aa, Fraxinus spp
MAKLYVQAVPPTDLNRNTERFTYPGVWTTYILILFFSWLIVLSVFGCSPGMAWTIVHITHFPRYLSLLSLEEGNTVFRRPGCLQ

SEQ ID NO: 7596 - protein, 157 aa, Chrysanthemum coronarium
MANLYVRAVPPTDLNRNTEWFTYPGVWTTYILILFFSWLVVLSVFGSSPGMAWTTVNLLHALLTYQFFHWKKGTPFADDQGIYNRLTWWEQIDSGKQLTRNRKFLTLVPVVLYLIASHTTDYQNPMLFFNTVAVFVLVVAKFPNMHKVRIFGINAEE

SEQ ID NO: 7597 - protein, 154 aa, Cichorium intybus
MYVKATPTTDLNRNTDWFTYPGVWTTYILILFFSWLLILSVSGCTPGMAWTIVNLSHFLVTYHFFHWMKGTPFAEDQGIYNRLTWWEQIDNGKQLTRNRKFLTVVPVVLYLIASHTTDYQHPMLFLNTVAVTVLVIAKFPNMHKVRIFGINGDM

SEQ ID NO: 7598 - protein, 157 aa, Cirsium arvense
MANLYVQAEPPTDLNRNTEWFTYPGVWTTYILILFFAWLVVLSVFGCSPGMAWTTVNLSHALLTYHFFHWKKGTPFADDQGIYNRLTWWEQIDSGKQLTRNRKFITLVPVVLYLIASHTTDYQNPMLLLNTVAVFVLVVAKFPHMHKVRIFGINAEE

SEQ ID NO: 7599 - protein, 154 aa, Taraxacum officinale
MYVKAAPTTDLNRNTDWFTYPGVWTTYILILFFSWLLILSVSGCTPGMAWTIVNLSHFLVTYHFFHWMKGTPFAEDQGIYNRLTWWEQIDNGKQLTRNRKFLTVVPVVLYLIASHTTDYEHPMLFLNTVAVIVLVIAKFPNMHKVRIFGINGDM

SEQ ID NO: 7600 - protein, 154 aa, Echinacea purpurea
MYVKATPTTDLNRNTDWFTYPGVWTTYIFIIFFSWLLILSVVGCTPGMAWTIVNLAHFLVTYHFFHWMKGTPFAEDQGIYNRLTWWEQIDNGKQLTRNRKFLTVVPVVLYLIASHTTDYQHPMLFFNTVAVIVLVIAKFPNMHKVRIFGINGDM

SEQ ID NO: 7601 - protein, 157 aa, Vitis vinifera
MAKLYVQALPPTDLNRNTEWFTYPGVWTTYILILFFSWLVVLSLLRCSSGAAWTILHLSHFLVTYHCFHWKKGTPFADDQGIYNRLTWWEQIDSGKQLTRNRKFLTVVPLVLYLIASHTTDYQHPMLFFNTLAVFVLVVAKFPNMHKVRIFGINADH

SEQ ID NO: 7602 - protein, 157 aa, Guizotia abyssinica
MPSLYVQAEPPTDLNRNTEWFMYPGVWTTYILILFFSWLLVLAVTGCSPGMAWTTVNLSHAIITYHFFHWKKGTPFADDQGIYNRLTWWEQIDSGKQLTRNRKFLTVVPVVLYLIASHTTDYQNPMLFLNTLAVFVLVIAKFPNMHKVRIFGINAEA

SEQ ID NO: 7603 - protein, 154 aa, Lactuca sativa
MYVKATPTTDLNRNTDWFTYPGVWTTYIFILFFSWLLILSVSGCTPGMAWTIVNLSHFLVTYHFFHWMKGTPFAEDQGIYNRLTWWEQIDNGKQLTRNRKFLTVVPVVLYLIASHTTDYQHPMLFLNTVAVIVLVIAKFPNMHKVRIFGINGDM

SEQ ID NO: 7604 - protein, 157 aa, Olea europaea
MPNLYVRAVPPTDLNRNTEWFTYPGVWITYILILFFSWLMVLSVFGCSSGMAWTIVHLCHFIVTYQFFHWKKGTPFAEDQGVYNRLTWWEQIENGKQLTRNRKFLTVVPVVLYLIASHTTDYQHPMLFFNTLAVFILVVAKFPHMHKVRIFGINADQ

SEQ ID NO: 7605 - protein, 157 aa, Lippia dulcis
MGKLYVQMQPPADLNKNTEWFTYPGVWTTYILILFFSWLIVLSVTNCTPGMAWTIVNLCHFMVTYHFFHWKKGTPFGDDQGIYNGLTWWEQIDNGKQLTRNRKFLTVVPVVLYLIASHTTDYQHPMLFFNTLAVLVLVIAKFPNMHKVRIFGINGDQ

SEQ ID NO: 7606 - protein, 157 aa, Helianthus annuus
MANLYVQAESPTDLNKNTEWFTYPGVWTTYILILFFSWLVVLSVFGCSPGMAWTIVNLSHALLTYQFFHWKKGTPFADDQGIYNRLTWWEQIDSGKQLTRNRKFLTLVPVVLYLIASHTTDYQNPMLFFNTVAVFVLVVAKFPNMHKVRIFGINAEE

SEQ ID NO: 7607 - protein, 159 aa, Artemisia annua
MANNYLYVRAVPPTDLNRNTEWFTYPGVWTTYILILFFSWLVVLSVFGCSPGMAWTTVNLVHALLTYQFFHWKKGTPFADDQGIYNRLTWWEQIDSGKQLTRNRKFLTLVPVVLYLIASHTTDYQNPMLFLNTLAVFVLVVAKFPNMHKVRIFGINAEE

SEQ ID NO: 7608 - protein, 158 aa, Chrysanthemum coronarium
MANYMYVRAVPPTDLNRNTEWFTYPGVWTTYILILFFSWLVFLSVFGCSPGMAWTTVNLLHALLTYQFFHWKKGTPFADDQGIYNRLTWWEQIDSGKQLTRNRKFLTVVPVVLYLIASHTTDYQNPMLFLNTLAVFVLVIAKFPHMHKVRIFGINAEE

SEQ ID NO: 7609 - protein, 158 aa, Cyclamen graecum
MAKLYVNAVQPVDMNRNTEWFTYPGVWTTYILILFFAWLIFLSLFACSPGIAWSIVNLSHFAVTYHFFHWKKGTPFADDQGMYNALTWWEQIDNGKQLTRNRKFLTVVPVVLYLIASHTTDYQHPMLFFNTLAVIVLVIAKFPNMHKVRIFGINGEDQ

SEQ ID NO: 7610 - protein, 158 aa, Antirrhinum majus
MGKQLYVKMAPPADLNRNTEWFTYPGVWTTYILILFFSWLVVLSVSNCTPGMAWTIVNLSHFLVTYIFFHWKKGTPFGDDQGIYNGLTWWEQMDNGKQLTRNRKFITVVPVVLYLIASHTTDYQHPMLFFNTLAVIVLVIAKFPNMHKVRIFGINGEQ

SEQ ID NO: 7611 - protein, 158 aa, Olea europaea
MIGKLYVQTVPPANLNRNTEWFMYPGVWTTYIFILFFCWLLVLSVFNCTPGMAWTVVNLCHFVVTYHFFHWKKGTPFADDQGIYNRLTWWEQIDDGKQLTRNRKFLTVVPVVLYLIASHTTDYQHPMLFFNTLAVLVLVVAKFPNMHKVRIFGINGDQ

SEQ ID NO: 7612 - protein, 155 aa, Musa acuminata
MAKLYVHTVPPPDLNKNTEWFMYPGVWTTYILILFFSWLLVLSVFGCTAGMAWTVVNLFHFAVTYYFFHWKKGTPFAEDQGIYNNLTWWEQMDNGKQLTRNRKFLTVVPVVLYLIASHTTDYQHPMLFLNTVSVAVLVIAKFPNMHKVRIFGING

SEQ ID NO: 7613 - protein, 157 aa, Chrysanthemum coronarium
MANLYVRAVPPTDLNRNTEWFTYPGVWTTYILILFFSWLVVLSVFGCSPGVAWTTVHLLHALLTYQFFHWKKGTPFADDQGIYNRLTWWEQIDSGKQLTRNRKFLTLVPVVLYLIASHTTDYQNPMLFFNTVAVFVLVVAKFPNMHKVRIFGINAEE

SEQ ID NO: 7614 - protein, 157 aa, Cocos nucifera
MAKLYVQAVPPADLNKNTEWFMYPGVWTTYILILFFSWLMVLSVFGCTPGMAWTAVNLFHFAVTYLFFHWKKGTPFAEDQGMYNSLTWWEQMDNGQQLTRNRKFLTIVPVILYLIASHTTDYQNPMLFLNTLAVLVLVVAKFPNMHKVRIFGINADH

SEQ ID NO: 7615 - protein, 157 aa, Aquilegia formosa
MAKLYVQTVPPPDLNKNTEWFMYPGVWTTYILIVFFAWLMVLSVLGCTPGMAWTIVNLCHFAVTYHFFHWKKGTPFAEDQGIYNGLTWWEQIDNGKQLTRNRKFLTVVPVVLYLIASHTTDYQQPMLFLNTLAVFILVVAKFPNMHKVRIFGINADQ

SEQ ID NO: 7616 - protein, 154 aa, Cirsium arvense
  Sequence also found in Organisms: Cynara scolymus
MYVKATPTTDLNRNTDWFTYPGVWTTYILILFFSWLLILSVIGCTPGMAWTIVNLSHFLVTYHFFHWMKGTPFAEDQGMYNRLTWWEQIDNGKQLTRNRKFLTVVPVVLYLIASHTTDYQHPMLFLNTVAVLVLVIAKFPNMHKVRIFGINGDM

SEQ ID NO: 7617 - protein, 157 aa, Solanum melongena
MANLYVRAAPTTDLNRNTEWFTYPGVWTIYIFILLFSWLVVLSVFGSSYGMAWTIVNLSHFIVTYHCFHWKKGTPFADDQGIYNRLTWWEQMDNGKQLTPNRKFLTVVPVVLYLIASHTTDYQHPMLFFNTLAVFVLVVAKFPNMHKVRIFGINADQ

SEQ ID NO: 7618 - protein, 154 aa, Eucalyptus grandis
MYVKAVPPTDLNRNTEWFTYPGVWTTYILILFISWLIVLSLFNCSPGMAWTIVNLSHFLVTYHFFHWKKGTPFSDDQGIYNALTWWEQIDSGKQLTRNRKFLTVVPVVLYLIASHTTDYKNPMLFLNTLAVFVLVVAKFPNMHKVRIFGINADH

SEQ ID NO: 7619 - protein, 157 aa, Capsicum annuum
MANLYVRAVPTTDLNRNTEWFTYPGVWTTYILILFFSWLIVLSLFGCSPGLAWTTVHLSHFIVTYQCFHWKKGTPFADDQGIYNRLTWWEQIDSGKQLTRNRKFLTVVPVVLYLIASHTTDYQHPMLFFNTIAVFILVVAKFPHMHKVRIFGINADQ

SEQ ID NO: 7620 - protein, 157 aa, Phalaenopsis aphrodite
MAKLYAQTVPPPDLNKNTEWFMYPGVWTTYILIIFFFWLVVLSVFGCTPGMAWTIVNLTHFAVTYHFFHWKKGTPFAEDQGIYNRLTWWEQVDNGKQLTDNRKFLTVAPVVLYLIASHTTDYQHPMLFLNTIAVIVLVIAKFPNMHKVRIFGINSDH

SEQ ID NO: 7621 - protein, 151 aa, Platanus occidentalis
HAVPPPDLNKNTEWFMYPGVWTTYILILFFAWLMVLSVFGCTPGMAWTIVNLCHFVVTYHFFHWKKGTPFAEDQGIYNGLTWWEQMDNGKQLTRNRKFLTVVPVVLYLIASHTTDYQHPMLFFNTLAVFVLVVAKFPNMHKVRIFGINADQ

SEQ ID NO: 7622 - protein, 154 aa, Populus trichocarpa
MYVKAEPTTDVNRNTEWFTYPGVWTTYMLIVFMSWLLVLSIFGCSPGMAWTIVHFCHFAVTYHFFHWKKGTPFADDQGIYNGLTWWEQIENGKQLTRNRKFLTVVPVVLYLIASHTTDYQNPMLFFNTLAVFVLVVAKFPNMHKVRIFGINADH

SEQ ID NO: 7623 - protein, 157 aa, Solanum lycopersicum
  Sequence also found in Organisms: Solanum tuberosum
MANLYVRAAPTTDLNRNTEWFTYPGVWTIYIFILLFSWLVVLSVFGSSSGMAWTIVNLAHFLVTYHCFHWKKGTPFAEDQGIYNRLTWWEQMDNGKQLTPNRKFLTVVPVVLYLIASHTTDYQHPMLFFNTFAVFILVVAKFPNMHKVRIFGINADQ

SEQ ID NO: 7624 - protein, 157 aa, Glycine max
MAKLYVKAVPPADLNRNTDWFTYPGVWTSYILILFFSWILVLSVFGCSPGIAWTIVNLAHFAVTYDFFHWKKGTPFAEDQGIYNRLTWWEQVDNGKQLTRNRKFLTVVPLVLYLIASHTTDYQNPMFLFNTVAVIVLVVAKFPHMHKVRIFRINADK

SEQ ID NO: 7625 - protein, 157 aa, Helianthus annuus
MANLYVQAEPPTDLNRNTEWFMYPGVWTTYILILFFAWLLVLAVTACSPGIAWTTVNLSHALITYHFFHWKKGTPFADDQGIYNRLTWWEQIDSGKQLTRNRKFLTVVPVVLYLIASHTTDYENPMLFLNTVAVFVLVIAKFPHMHKVRIFGINAEE

SEQ ID NO: 7626 - protein, 154 aa, Camellia sinensis
MYVKASHPPDMNRNTEWFTYPGVWTTYILILFFSWLIVLSLFGCSPGMAWTIVNLSHFAVTYHFFHWKKGTPFADDQGIYNGLTWWEQIDHGKQLTRNRKFLTVVPVVLYLIASHTTDYQHPMLFFNTLAVFVLVVAKFPNMHKVRIFGINGEQ

SEQ ID NO: 7627 - protein, 157 aa, Eutrema halophilum
MANLYVKAVPPPDMNRNTEWFMYPGVWTTYILILFFGWLVVLSVSGCSPGMAWTVVNLAHFVVTYHCFHWMKGTPFAEDQGIYNGLTWWEQMDNGQQLTRNRKFLTVVPVVLYLIASHTTDYRHPWLFLNTLAVMVLVVAKFPNMHKVRIFGINGDK

SEQ ID NO: 7628 - protein, 154 aa, Tragopogon dubius
MYVKATPTTDLNRNTDWFTYPGVWTAYILILFFSWLLILSVSGCTPGMAWTIVNLCHFLVTYHFFHWMKGTPFAEDQGIYNRLTWWEQIDNGKQLTRNRKFLTVVPVVLYLIASHTTDYQHPMLFLNTVAVTVLVIAKFPNMHKVRIFGINGDM

SEQ ID NO: 7629 - protein, 157 aa, Triphysaria pusilla
MANLYVRASPPTDLNRNTEWFTYPGVWTTYILILFFSWLMVLSVFGCSPGTAWTIVNLSHFIVTYHCFHWKKGTPFSDDQGIYNRLTWWEQIDNGKQLTPNRKFLTVVPVVLYLIAAHTTDYQYPMLIFNTLAVFVLVVAKFPHMHKVRIFGINAEQ

SEQ ID NO: 7630 - protein, 154 aa, Cichorium intybus
MYVKATPTTDLNKNTEWFTYPGVWTTYILILFFAWLLILSVSACTPGMAWTIVNLSHFLVTYHFFHWMKGTPFADDQGIYNRLTWWEQIDNGKQLTRNRKFLTVVPVVLYLIASHTTDYRHPMLFLNTVAVIVLVIAKFPNMHKVRIFGINGDM

SEQ ID NO: 7631 - protein, 69 aa, Centaurea maculosa
QHGGRRGFMDFPYVSSPHKDLMVDLVSTVETRLDSFLNPCTLPPDVQSYQNEPERLVLLSISDPAFTHR

SEQ ID NO: 7632 - protein, 72 aa, Fraxinus spp
MNRNTEWFTYPGVWTTYILILFFSWLVVLSVFGCSPGMAWTIVHLSHFLVTYHCFHWKKGTLFQMTRVSTIG

SEQ ID NO: 7633 - protein, 86 aa, Salvia sclarea
MGKLYVQMAPPADLNRNTEWFTYPGVWTTYILILFFSWLVVLSVTNCTPGMAWTIVNVCHFLVTYHFFHWKKGTPFGDDQGIYNSV

SEQ ID NO: 7634 - protein, 154 aa, Castanea mollissima
MYVKAVRPTDLNRNTEWFTYPGVWTTYILILFFSWLIVLSVLNCSSGLAWTIVHLAHFLVTYHFFHWKKGTPFADDQGIYNRLTWWEQIDSGKQLTRNRKFLTVVPVVLYLIASHTTDYQHPMLFFNTLAVFVLVVAKFPHMHKVRIFGINADQ

SEQ ID NO: 7635 - protein, 158 aa, Chrysanthemum coronarium
MANYMYVRAVPPTDLNRNTEWFTYPGVWTTYILILFFSWLVFLSVFGCSPGMAWTTVNLLHALLTYQFFHWKKGTPFADDQGIYNRLTWWEQIDSGKQLTRNRKFLTLVPVVLYLIASHTTDYQNPMLFLNTLAVFVLVVAKFPNMHKVRIFGINAEE

SEQ ID NO: 7636 - protein, 157 aa, Ambrosia trifida
MANLYVQAESSTDLNKNTEWFTYPGVWTTYILILFFSWLVVLSVFGCSPGMAWTTVNLSHALLTYQFFHWKKGTPFADDQGIYNRLTWWEQIDSGKQLTRNRKFLTLVPVVLYLIASHTTDYQNPMLFLNTVAVFVLVVAKFPNMHKVRIFGINAEE

SEQ ID NO: 7637 - protein, 157 aa, Brassica juncea
MANLYVKAAPPPDMNRNTEWFMYPGVWTTYILILFFGWLVVLSVSGCSPGMAWTVVNLSHFLVTYHSFHWMKGTPFADDQGVYNGLTWWEQMDNGQQLTRNRKFLTVVPVVLYLIASHTTDYRHPWLFLNTLAVMVLVVAKFPNMHKVRIFGINGDK

SEQ ID NO: 7638 - protein, 154 aa, Fagus grandifolia
MYVKAYRPTDLNRNTEWFTYPGVWTTYILILFFSWLIVLSVLNCSPGLAWTIVHIAHFLVTYHFFHWKKGTPFADDQGIYNRLTWWEQIDSGKQLTRNRKFLTVVPVVLYLIASHTTDYQHPMLFFNTLAVFVLVVAKFPHMHKVRIFGINADQ

SEQ ID NO: 7639 - protein, 157 aa, Bupleurum chinense
MANYYVKATPPPDLKQNTEWFTYPGVWTTYILILFFAWLVVLSILNCSPGMAWTIVHLSHFLVTYLLFHWKKGTPFAYDQGIYNGLTWWEQVDNGKQLTRNRKFLTVVPVVLYLIASHTTDYQHPMLLLNTIAVAVLVIAKFPNMHKVRIFGINGEQ

SEQ ID NO: 7640 - protein, 154 aa, Cichorium intybus
MYVKATPTTDLNKNTEWFTYPGVWTTYILILFFAWLLILSVSACTPGMAWTIVNISHFLVTYHFFHWMKGTPFADDQGIYNRLTWWEQIDNGKQLTRNRKFLTVVPVVLYLIASHTTDYRHPMLFLNTVAVIVLVIAKFPNMHKVRIFGINGDM

SEQ ID NO: 7641 - protein, 157 aa, Coffea canephora
MANLYVKAVPPTDLNRNTEWFTYPGVWTTYILILFFSWLMVLSVFGCSPGIAWSVVHLSHSLITYHCFHWKKGTPFSDDQGIYNRLTWWEQIDSGKQLTRNRKFLTVVPVVLYLIASHTTDYQHPMLLLNTVAVFVLVVAKFPHMHRVRIFGINADQ

SEQ ID NO: 7642 - protein, 157 aa, Conyza canadensis
MANLYVQAEQPTDLNRNTEWFTYPGVWTIYIFILFFAWLVVLSLFGCSPGMAWTIVNLSHAVLTYQFFHWKKGTPFADDQGIYNRLTWWEQIDSGKQLTRNRKFLTLVPVVLYLIASHTTDYQNPMLFLNTVAVFVLVVAKFPNMHKVRIFGINAEE

SEQ ID NO: 7643 - protein, 157 aa, Echinacea purpurea
MGKLYVQMSPPADLNRNTEWFTYPGVWTTYILILFFSWLVVLSVTNCTPGMAWTIVNVCHFLVTYHFFHWKKGTPFGDDQGIYNGLTWWEQIDNGKQLTRNRKFLTVVPVVLYLIASHTTDYQYPMLLFNTVAVLVLVIAKFPNMHKVRIFGINGDL

SEQ ID NO: 7644 - protein, 157 aa, Linum usitatissimum
MANLYVKAVPPADMNKNTEWFMYPGVWTSYMLILFFAWLVVLSVSGCSPGMAWTVVNLGHFAMTYHFFHWKKGTPFGDDQGIYNGLTWWEQMDNGKQLTRNRKFLTVVPVVLYLIASHTTDYEHPMLFLNTIAVLVLVVAKFPNMHKVRIFGINGDI

SEQ ID NO: 7645 - protein, 157 aa, Ipomoea nil
MANLYVRAAPTTDLNKNTEWFTYPGVWSTYILILFFSWLVFLSVFGCSPGTAWTIVNLSHFMITYHFFHWKKGTPFADDQGIYNRLTWWEQIDNGKQLTRNRKFLTVVPVVLYLIASHTTDYQHPMLFLNTVAVFILVVAKFPHMHKVRIFGINADQ

SEQ ID NO: 7646 - protein, 157 aa, Lactuca sativa
MANLYVQAAPPTDLNRNTEWFTYPGVWITYILILFFAWLAVLSVFGCSPGMAWTIVNLSHAVMTYHFFHWKKGTPFADDQGIYNRLTWWEQIDSGKQLTRNRKFLTLVPLVLYLIASHTTDYQNPMLLLNTLAVFVLVLAKFPHMHKVRIFGINAEE

SEQ ID NO: 7647 - protein, 157 aa, Mimulus guttatus
MGKLYVKMVPPADLNRNTEWFTYPGVWTTYILILFFAWLIVLSVTNCTPGMAWTIVNLSHFLVTYHFFHWKKGTPFGEDQGIYNGLTWWEQMDNGKQLTRNRKFLTVVPVVLYLIASHTTDYQYPLLYFNTFAVLVLVVAKFPNMHKVRIFGINGEY

SEQ ID NO: 7648 - protein, 154 aa, Quercus alba
MYVKAHRPTDLNRNTEWFTYPGVWTTYILILFFSWLIVLSVLNCSSGLAWTIVHLSHFLVTYHFFHWKKGTPFADDQGIYNRLTWWEQIDSGKQLTRNRKFLTVVPVVLYLIASHTTDYQHPMLFFNTLAVFVLVVAKFPHMHKVRIFGINADQ

SEQ ID NO: 7649 - protein, 157 aa, Oryza sativa
MAKLYVQAVPPPDLNRNTEWFMYPGVWTTYICILFFSWLLVLSVFGCTPGMAWTVVNLFHFAITYHFFHWKKGTPFADDQGMYNTLTWWEQMDNGKQLTRNRKFLVVVPVVLYLIASHTTDYQHPMLFLNTLAAAVLVVAKLPNMHKVRIFGINAGN

SEQ ID NO: 7650 - protein, 157 aa, Solanum phureja
MANLYVRAAPTTDLNRNTEWFTYPGVWTIYIFILLFSWLVVMSVFGSSSGMAWTIVNLAHFLVTYHCFHWKKGTPFAEDQGIYNRLTWWEQMDNGKQLTPNRKFLTVVPVVLYLIASHTTDYQHPMLFFNTFAVFILVVAKFPNMHKVRIFGINADQ

SEQ ID NO: 7651 - protein, 157 aa, Eutrema parvulum
MANLYVKAVPPPDMNRNTEWFMYPGVWTTYILILFFGWLVVLSVSGCSPGMAWTVVNLAHFVVTYHCFHWMKGTPFAEDQGIYNGLTWWEQMDNGQQLTRNRKFLTVVPVVLYLIASHTTDYRHPWLFLNTLAVMVLVVAKFPNMHKVRIFGINGEK

SEQ ID NO: 7652 - protein, 157 aa, Triphysaria pusilla
MANLYVRASPTTDLNRNTEWFTYPGVWTTYILILFFSWLMVLSVFGCSSGTAWTVVNLSHFIVTYQCFHWKKGTPFADDQGIYNRLTWWEQIDNGKQLTPNRKFLTVVPVVLYLIAAHTTDYQYPMLIFNTLAVFVLVVAKFPHMHKVRIFGINAEQ

SEQ ID NO: 7653 - protein, 146 aa, Ambrosia trifida
MANLYVQAVQPTDLNRNTEWFMYPGVWTTYILILFFSWLVVLSVTGCSPGMAWTTVNLCHALITYHFFHWKKGTPFADDQGIYNRLTWWEQIDSGKQLTRNRKFLTVVPVVLYLIASHTTDYQNPMLFFNTLAVFCASDRQVPTHA

SEQ ID NO: 7654 - protein, 104 aa, Bupleurum chinense
MANYYVKATPPADLNKNTEWFTYPGVWTTYILILFFAWLVALSILNCSPGWLGPSFISPTSSLPIYFFHWKKGTPFADDQGIYNGLTWWEQVDNGKQLTRNRKF

SEQ ID NO: 7655 - protein, 158 aa, Cyclamen graecum
MAKLYVNAVQPVDMNRNTEWFTYPGVWTTYMLILFFAWIVVLSIFGCSPGIAWSIVNLSHFAVTYHFFHWKKGTPFADDQGMYNALTWWEQIENGKQLTRNRKFLTVVPMVLYLIASHTTDYQHPMLFFNTVAVIVLVIAKFPNMHKVRIFGINGEDQ

SEQ ID NO: 7656 - protein, 76 aa, Bupleurum chinense
MANYYVKATPPPDLNKNTEWFTYPGVWTTYILILFFAWLVVLSILNCSPGMAWTIVHLSHFIVTYHFFTGRRNPIC

SEQ ID NO: 7657 - protein, 157 aa, Brassica napus
  Sequence also found in Organisms: Brassica oleracea
MANLYVKAAPPPDMNRNTEWFMYPGVWTTYILILFFGWLVVLSVSGCSPGMAWTVVNLAHFVVTYHSFHWMKGTPFADDQGVYNGLTWWEQMDNGQQLTRNRKFLTVVPVVLYLIASHTTDYRHPWLFLNTLAVMVLVVAKFPNMHKVRIFGINGDK

SEQ ID NO: 7658 - protein, 157 aa, Musa acuminata
MAKLYVQAVPPVDMNKNTEWFMYPGVWTTYILILFFSWLVFLSIFGCNPGTAWTIVNLVHFAITYHFFHWKKGTPFSDDQGIYNSLTWWEQIDNGKQLTRNRKFLTVVPVVLYLIASHTTDYRHPMLFLNTVAVIVLVIAKLPNMHKVRIFGINAGH

SEQ ID NO: 7659 - protein, 157 aa, Cichorium intybus
MANLYVQAAPPTDLNRNTEWFTYPGVWITYILILFFAWLTVLSVFGSSPGMAWTIVNLSHAVMTYHFFHWKKGTPFADDQGVYNRLTWWEQIDGGKQLTRNRKFLTLVPLVLYLIASHTTDYQNPMLLFNTLAVFVLVLAKFPHMHKVRIFGINAEE

SEQ ID NO: 7660 - protein, 157 aa, Echinochloa colona
MAKLYVQAVPPPDLNRNTEWFMYPGVWTTYILILFFSWLLVLSVFGCTPGTAWTVVNLFHFAITYHFFHWKKGTPFADDQGMYNALTWWEQMDNGKQLTRNRKFLIVVPVVLYLIALHTTDYQQPMLFLNTLAVSVLVVAKLPNMHKVRIFGINAED

SEQ ID NO: 7661 - protein, 154 aa, Malus domestica
MYVTAVRPTDLNRNTEWFTYPGVWTTYILMVFFSWLTVLCLFSCSPGMAWTVVHLSHFLVTYHFFHWKKGTPFADDQGIYNALTWWEQIDNGNQLTRNRKFLTVVPVVLYLIASHTTDYQNPMLIFNTLAVFVLVVAKFPNMHKVRIFGINADH

SEQ ID NO: 7662 - protein, 157 aa, Arabidopsis lyrata
MANLYVKAVPPPDMNRNTEWFMYPGVWTTYMLILFFGWLVVLSVSGCSPGMAWTVVNLAHFVVTYHSFHWMKGTPFADDQGIYNGLTWWEQMDNGQQLTRNRKFLTVVPVVLYLIASHTTDYRHPWLFLNTLAVMVLVVAKFPNMHKVRIFGINGDK

SEQ ID NO: 7663 - protein, 157 aa, Aristolochia fimbriata
MALLYVQTVPPPDMNKNTEWFMYPGVWTTYILILFFSWLIVLSVFGCTPGMAWTIVNLCHFVVTYHFFHWKKGTPFAEDQGIYNGLTWWEQMDNGKQLTRNRKFLTVVPVVLYLIASHTTDYQQPMLFLNTLAVFVLVVAKFPNMHRVRIFGINAEN

SEQ ID NO: 7664 - protein, 157 aa, Brassica rapa
MANLYVKAAPPPDMNRNTEWFMYPGVWTTYILILFFGWLVVLSLSGCSPGMAWTVVNLAHFVVTYHSFHWMKGTPFADDQGVYNGLTWWEQMDNGQQLTRNRKFLTVVPVVLYLIASHTTDYRHPWLFLNTLAVMVLVVAKFPNMHKVRIFGINGDK

SEQ ID NO: 7665 - protein, 154 aa, Manihot esculenta
MYVKAVPPTDLNRNTEWFTYPGVWTTYILMVFMSWLIVLSIFGCSPGMAWTIVHLSHFLITYHFFHWKKGTPFADDQGIYNGLTWWEQIENGKQLTRNRKFLTVVPVVLYLIASHTTDYQNPMLFCNTLAVFILVVAKFPHMHKVRIFGINADH

SEQ ID NO: 7666 - protein, 157 aa, Cenchrus ciliaris
MAKLYVQAFPPADLNKNTEWFMYPGVWTTYILILFFSWLLVLSVFGCTPGTAWTVVNLFHFAITYHFFHWKKGTPFADDQGMYNALTWWEQMDNGKQLTRNRKFLIVVPVVLYLIALHTTDYQQPMLFLNTLAVSVLVVAKLPNMHKVRIFGINAEN

SEQ ID NO: 7667 - protein, 154 aa, Centaurea maculosa
MYVNARPTTDVNRNTEWFTYPGVWTTYIFILFFSWLLILSILGCTPGMAWTIVNLSHFLVTYNFFHWMKGTPFAEDQGMYNRLTWWEQIDNGKQLTRNRKFLTVVPVVLYLIASHTTDYQHPMLFLNTVAVLVLVIAKFPNMHKVRIFGINGDM

SEQ ID NO: 7668 - protein, 154 aa, Citrus clementina
  Sequence also found in Organisms: Citrus sinensis
MYVRTVPPTDLNRNTEWFTYPGVWTTYLSILFISWLLVLSLFNCSSGMAWTLVHLSHFFVTYHFFHWKKGTPFADDQGIYNGLTWWEQIDNGKQLTRNRKFLTVVPVVLYLIASHTTDYQNPMLFFNTLAVFVLVVAKFPNMHKVRIFGINADH

SEQ ID NO: 7669 - protein, 154 aa, Cleome spinosa
MYVRAVPPTDVNRNTEWFTYPGVWTTYILILFFSWLIVLSVFGCSPGMAWTIVHLAHFVVTYHSFHWRKGTPFADDQGIYNRLTWWEQIDNGKQLTRNRKFLTVVPVVLYLIASHTTDYQHPMLFLNTLAVFILVVAKFPHMHKVRIFGINADQ

SEQ ID NO: 7670 - protein, 157 aa, Eschscholzia californica
MAKLYVQTVPPPDLNKNTEWFMYPGVWTTYMLILFFSWLMVLSIFGCNPGMAWTIVNLSHFVVTYQFFHWKKGTPFAEDQGIYRGLTWWEQIDNGKQLTRNRKFLTVVPVVLYLIASHTTDYQNPMLFLNTLAVFVLVVAKFPNMHKVRIFGINGEQ

SEQ ID NO: 7671 - protein, 157 aa, Ipomoea batatas
MANLYVRAAPSTDLNKNTEWFTYPGVWSTYILILFFSWLVVLSVFCSSPGTAWTIVNLSHFMITYHFFHWKKGTPFADDQGIYNRLTWWEQIDNGKQLTRNRKFLTVVPVVLYLIASHTTDYQHPMLFLNTVAVFILVVAKFPHMHKVRIFGINADQ

SEQ ID NO: 7672 - protein, 157 aa, Pennisetum glaucum
MAKLYVQAFPPADLNKNTEWFMYPGVWTTYILILFFSWLLVLSVFGCTPGTAWTVVNLFHFVITYHFFHWKKGTPFADDQGMYNALTWWEQMDNGKQLTRNRKFLIVVPVVLYLIALHTTDYQQPMLFLNTLAVSVLVVAKLPNMHKVRIFGINAEN

SEQ ID NO: 7673 - protein, 157 aa, Nicotiana benthamiana
MANYYVRAAPTTDLNRNTEWFTYPGVWTIYIFILFFSWMAVQSVLGVSPGIAWTIVNLSHFLVTYHFFHWKKGTPFAEDQGIYNRLTWWEQMDNGKQLTPNRKFLTVVPVVLYLIASHTTDYQHPMLFFNTFAVFILVVAKFPNMHKVRIFGINADQ

SEQ ID NO: 7674 - protein, 157 aa, Nicotiana benthamiana
MANYYVRAAPTTDLNRNTEWFTYPGVWTIYIFILFFSWMAVLSVLGVSPGIAWTIVNLSHFLVTYHFFHWKKGTPFAEDQGIYNRLTWWEQMDNGKQLTPNRKFLTVVPVVLYLIASHTTDYQHPMLFSNTFAVFILVVAKFPNMHKVRIFGINADQ

SEQ ID NO: 7675 - protein, 157 aa, Orobanche aegyptiaca
MGKLYVTMAPPADLNRNTEWFTYPGVWTTYILILFFSWLIVLSITNCTPGTAWTIVNLCHFLVTYHFFHWKKGTPFGDDQGIYNALTWWEQMDSGKQLTRNRKFLTVVPVVLYLIASHTTDYQHPMLFLNTLAVLILVVAKFPNMHKVRIFGINGDQ

SEQ ID NO: 7676 - protein, 157 aa, Petunia hybrida
MAKLYVTAVPPTDLNRNTEWFTYPGVWTSYILILFFSWLIVLSLFGCSSGMAWTIVHLSHFLVTYQCFHWMKGTPFSDDQGIYNRLTWWEQIDNGKQLTRNRKFLTVVPVVLYLIASHTTDYQHPMLFLNTVAVFILVVAKFPHMHKVRIFGINADQ

SEQ ID NO: 7677 - protein, 157 aa, Phalaenopsis aphrodite
MAKLYVETTPPPDLNKNTEWFMYPGVWTTYILILFFSWLLVLSVFGCTPGTAWTIVNLFHFAITYQFFHWRKGTPFAEDQGIYNNLTWWEQIDNGKQLTRNRKFLTVVPVVLYLIASHTTDYQQPMLFLNTVAVIILVVAKFPYMHKVRIFGINADR

SEQ ID NO: 7678 - protein, 157 aa, Platanus occidentalis
MGKLYVNAVLPPDMNKNTEWFMYPGVWTTYIFILFFSWLMVLSVFGCTPGMAWTIVNLCHFVVTYHFFHWKKGTPFAEDQGIYNGLTWWEQVDNGKQLTQNRKFLTVVPVVLYLIASHTTDYQHPMLFLNTLAVLVLVVAKFPNMHKVRIFGINADQ

SEQ ID NO: 7679 - protein, 154 aa, Populus trichocarpa
MYVKAEPATDVNRNTEWFTYPGVWTTYMLIVFMSLLLVLSIFGCSAGMAWTIVHLCHFAVTYHFFHWKKGTPFADDQGIYNGLTWWEQIENGKQLTRNRKFLTVVPVVLYLIASHTTDYQNPMLFFNTLAVFVLVVAKFPHMHKVRIFGINADH

SEQ ID NO: 7680 - protein, 157 aa, Raphanus sativus
MANLYVKAAPPPDMNRNTEWFMYPGVWTTYILILFFGWLVVLSLSGCSPGMAWTVVNLAHFVVTYHSFHWMKGTPFADDQGVYNALTWWEQMDNGQQLTRNRKFLTVVPVVLYLIASHTTDYRHPWLFLNTLAVMVLVVAKFPNMHKVRIFGINGDK

SEQ ID NO: 7681 - protein, 157 aa, Oryza sativa
MAKLYVQAVQPADLNKNTEWFMYPGVWTTYILILFFSWLLVLSVFGCTPGMAWTFVNLAHFAMTYHFFHWKKGTPFADDQGMYNRLTWWEQMDNGKQLTRNRKFLTVVPLVLYLIASHTTDYQHPMLFLNTIAVVVLVVAKLPNMHKVRIFGINAGN

SEQ ID NO: 7682 - protein, 157 aa, Sesamum indicum
MANLYVQATPTTDLNKNTEWFTYPAAWTTYILILFFSWLVVLSVFGCSAGMAWTVVHLSHFVVTYQFFHWKKGTPFSDDQGVYNRLTWWEQIDNGKQLTRNRKFLTVVPVVLYLIASHTTNYQHPMLFFNTIAVFILVVAKFPNMHKVRIFGINADQ

SEQ ID NO: 7683 - protein, 157 aa, Sorghum bicolor
MAKLYVQAVPPPDLNRNTEWFMYPGVWTTYILILFFCWILVLSVFGCAPGTAWTLVNLGHFAITYHFFHWKKGTPFADDQGMYNTLTWWEQMDNGKQLTRNRKFLTAVPVVLYLIASHTTDYQHPMLFLNTLAVIVLVVAKLPNMHKVRIFGINAGS

SEQ ID NO: 7684 - protein, 157 aa, Saccharum officinarum
MAKLYVQAFPPADLNKNTEWFMYPGVWTTYILIVFFSWLLVLSVFGCTPGTAWTVVNLFHFAITYHFFHWKKGTPFADDQGMYNRLTWWEQMDNGKQLTRNRKFLIVVPVVLYLIALHTTDYQQPMLFLNTLAVSVLVVAKLPNMHKVRIFGINAEN

SEQ ID NO: 7685 - protein, 154 aa, Helianthus annuus
MYVKATPTTDLNRNTDWFTYPGVWTTYIFIIFFSWLLILSVSGCSPGMAWTIVHFSHFLVTYHFFHWMKGTPFADDQGIYNRLTWWEQIDNGKQLTRNRKFLTVVPVVLYLIASHTTDYQHPMIFFNTVAVIVLVIAKFPNMHKVRIFGINGDM

SEQ ID NO: 7686 - protein, 157 aa, Triphysaria pusilla
MGKLYVQMTPPADLNRNTEWFTYPGVWTTYILILFFSWLIVLSITNCTPGMAWTVVNLCHFLVTYHFFHWKKGTPFGDDQGIYNALTWWEQMDSGNQLTRNRKFLTVVPVVLYLIASHTTDYQHPMLFLNTLAVLILVVAKFPNMHKVRIFGINGEQ

SEQ ID NO: 7687 - protein, 153 aa, Utricularia gibba
MGKLYVKMVPPPDLNRNTEWFTYPGVWTTYILIVFFSWLIVLSVTNCTPGMAWTIVNLSHFLVTYHFFHWKKGTPFGDDQGIYNGLTWWEQIDNGKQLTRNRKFLTVVPVVLYLIASHTTDYQHPMLLLNTLAVLVLVIAKFPNMHKVRIFGI

SEQ ID NO: 7688 - protein, 80 aa, Curcuma longa
KLYVHTVPPPDLNKNTEWFMYPGVWTTYIFILFFSWLLVLSFFGCSAGMAWTVVNLFHFSVTLLLPLEKGYSLRRRSGYI

SEQ ID NO: 7689 - protein, 155 aa, Musa acuminata
MAKLYVQTVPPPDLNKNTEWFMYPGVWSTYILILFFSWLLVLSVFGCTPGMAWTVVNLFHFAITYYFFHWKKGTPFAEDQGIYNNLTWWEQMDNGKQLTRNRKFLTVVPVVLYLMALHTTDYQHLMLFLNTLAVAILVIAKFPNMHKVRIFGINE

SEQ ID NO: 7690 - protein, 157 aa, Avena sativa
MAKLYVQAVPPPDLNKNTEWFMYPGVWTTYIIILFVSWLLVLSIFGCTPGMAWTIVNLGHFAMTYHFFHWKKGTPFADDQGMYNRLTWWEQMDNGKQLTRNRKFLVVVPVVLYLIASHTTDYQHPMLFFNTIAVTILVVAKLPNMHKVRIFGINAGN

SEQ ID NO: 7691 - protein, 154 aa, Malus domestica
MYVTAVRPTDLNRNTEWFTYPGVWTTYILVVFFSWLTVLCLFSCSPGMAWTVVHLSHFFVTYHFFHWKKGTPFADDQGIYNALTWWEQIDNGNQLTRNRKFLTVVPVVLYLIASHTTDYQNPMLIFNTLAVFVLVVAKFPNMHKVRIFGINADH

SEQ ID NO: 7692 - protein, 157 aa, Arabidopsis thaliana
MANLYVKAVPPPDMNRNTEWFMYPGVWTTYMLILFFGWLVVLSVSGCSPGMAWTVVNLAHFVVTYHSFHWMKGTPFADDQGIYNGLTWWEQMDNGQQLTRNRKFLTLVPVVLYLIASHTTDYRHPWLFLNTLAVMVLVVAKFPNMHKVRIFGINGDK

SEQ ID NO: 7693 - protein, 154 aa, Vaccinium corymbosum
MYVKAEATTDLNRNTEWFTYPGVWTIYILILFISWLVVLSLFGCSPGMAWTIVHLSHFVVTYQCFHWKKGTPFAEDQGIYNRLTWWEQMDNGKQLTRNRKFITVVPVVLYLIASHTTDYQQPMLFFNTLAVFVLVVAKFPHMHKVRIFGINADQ

SEQ ID NO: 7694 - protein, 157 aa, Brachypodium distachyon
MAKLYVQAVPPPDLNKNTEWFMYPGVWTTYIFILFVSWLLVLSVFGCTPGMAWTLVNLGHFAITYHFFHWKKGTPFADDQGMYNRLTWWEQMDNGKQLTRNRKFLAVVPVVLYLIASHTTDYQHPMLFFNTIAVTVLVVAKLPNMHKVRIFGINAGN

SEQ ID NO: 7695 - protein, 156 aa, Chelidonium majus
MAKLYVQAVHPPDLNKNTEWFMYPGVWTTYILILFFSWLMVLSIFGCTPGMAWTIVNLCHFIVTYHFFHWKKGTPFSEDQGIYNHMTWWEQIDSGKQLTRNRKFLTVVPVVLYLIASHTTDYQQPVLFLNTLAVFVLVVAKFPNMHKVRIFGINGE

SEQ ID NO: 7696 - protein, 154 aa, Cleome gynandra
MYVRAVPPTDVNRNTEWFTYPGVWTTYILILFFSWLIVLSIFGCSPGMAWTIVHLSHFIVTYHSFHWKKGTPFGDDQGIYNRLTWWEQIDNGKQLTRNRKFLTVVPVVLYLIASHTTDYQQPMIFLNTLAVFILVVAKFPHMHKVRIFGINADQ

SEQ ID NO: 7697 - protein, 154 aa, Euonymus alatus
MYVRAVRTTDLNRNTEWFTYPGVWTTYIFILFLSWLIVLSVFGCLPGTAWTVVHLAHFLVTYHFFHWKKGTPFADDQGIYNGLTWWEQIENGKQLTRNRKFLTVVPVVLYLIASHTTDYQQPMLIFNTLAVFVLVVAKFPNMHKVRIFGINADH

SEQ ID NO: 7698 - protein, 154 aa, Euphorbia peplus
MYVKAVPPTDLNRNTEWFTYPGVWTTYMLIVFISWLIVLSVFGCSPGMAWTIVHLAHFVITYHFFHWKKGTPFGDDQGIYNGLTWWEQIENGKQLTRNRKFLTVVPVVLYLIASHTTDYQNPMLFFNTLAVFVLVVAKFPHMHKVRIFGINADH

SEQ ID NO: 7699 - protein, 157 aa, Flaveria ramosissima
MVNLYVQAVLPTDLNRNTEWFMYPGVWTIYITILFFAWLVVLSVTGCSTGMAWTTVNLSHALITYHFFHWKKGTPFADDQGIYNRLTWWEQIDSGKQLTRNRKFLTVVPVVLYLIASHTTDYENPMLFLNTLAVFVLVIAKFPHMHKVRIFGINAEE

SEQ ID NO: 7700 - protein, 157 aa, Setaria italica
MAKLYVQTFPPADLNKNTEWFMYPGVWTTYILILFFSWLLVLSVFGCTPGTAWTVVNLFHFAITYHFFHWKKGTPFADDQGMYNALTWWEQMDNGKQLTRNRKFLIVVPVVLYLIALHTTDYQQPMLFLNTLAVSVLVVAKLPNMHKVRIFGINAEN

SEQ ID NO: 7701 - protein, 157 aa, Setaria italica
MAKLYVQAVPPPDLNRNTEWFMYPGVWTTYILILFFSWILVLSVFGCAPGTAWTLVNLGHFAITYHFFHWKKGTPFADDQGMYNTLTWWEQMDNGKQLTRNRKFLTAVPVVLYLIASHTTDYQHPMLFLNTLAVTVLVVAKLPNMHKVRIFGINAGS

SEQ ID NO: 7702 - protein, 156 aa, Guizotia abyssinica
MANLYVQAEPPTDLNKNTEWFTYPGVWTTYILILFFARSVDLSVFGCSPGMAWTTVNLSHALLTYQFFHWKKGTPFADDQGIYNRLTWWEQIDSGKQLTRNRKFLTLVPVVLYLIASHTTDYQNPMLFLNTVAVFVLIVAKFRNMHKVRIFGINAE

SEQ ID NO: 7703 - protein, 157 aa, Zea mays
MAKLYVQAFPPADLNKNTEWFMYPGVWTTYILIVFFSWLLVLSVFGCTPGTAWTVVNLFHFAITYHFFHWKKGTPFADDQGMYNALTWWEQMDNGKQLTRNRKFLIVVPVVLYLIALHTTDYQQPMLFLNTLAVSVLVVAKLPNMHKVRIFGINAEN

SEQ ID NO: 7704 - protein, 157 aa, Mimulus guttatus
MANLYVQAVPTTDLNRNTEWFTYPGVWTIYILILMFSWLVFVSVFGCSAGMAWTVVHLAHSIVTYHFFHWKKGTPFSDDQGIYNRLTWWEQIENGKQLTRNRKFLTLVPIVLYLIASHTTDYQHPMLFFNTLAVFILVVAKFPNMHKVRIFGINADQ

SEQ ID NO: 7705 - protein, 155 aa, Arachis hypogaea
ILYVKAVPPADLNRNTEWFMYPGVWTSYILIIFFAWLLVLSILHCTPGIAWTIINLAHFAITYHYFHWKKGTPFAEDQGIYNQLTWWEQIDSGKQLTRNRKFLTVVPVVLYLIASHTTDYRHPMLLFNTLAVIVLLIAKSPNMHKVRIFGINSDN

SEQ ID NO: 7706 - protein, 157 aa, Phalaenopsis aphrodite
MAKLYVETTPPPDLNKNTEWFMYPGVWTTYILILFFLWLLVLSVFGCTAGIAWTIVNLAHFAITYQFFHWRKGTPFAEDQGIYNNLTWWEQIDNGKQLTRNRKFLTVVPVVLYLIASHTTDYQQPMLFLNTVAVFVLVVAKFPNMHKVRIFGINADR

SEQ ID NO: 7707 - protein, 157 aa, Papaver somniferum
MGKLYVETVPPPDLNKNTEWFMYPGVWTTYILIVFFAWLMVLSVFGCNPGMAWTIVNLAHFVITYQFFHWKKGTPFAEDQGIYNGLTWWEQIDNGKQLTRNRKFLTCVPVVLYLIASHTTDYQNPMLFLNTLAVFVLVVAKFPNMHKVRIFGINAEQ

SEQ ID NO: 7708 - protein, 154 aa, Rosa hybrid cultivar
MYVTAVRPTDLNRNTEWFTYPGVWTTYILIVFFSWLIVLCLFSCSPGMAWTIVHLAHFLVTYHFFHWKKGTPFADDQGIYNALTWWEQIDNGNQLTRNRKFLTVVPVVLYLIASHTTDYQNPMLFFNTLAVFVLVVAKFPNMHKVRIFGINGDL

SEQ ID NO: 7709 - protein, 154 aa, Sequoia sempervirens
MGNLYVQAVPPPDLNKNTSWFMYPGVWTTYILILFFAWLIVLSVFGCTPGTAWTVVNLCHFAVTYHFFHWKKGTPFSEDQGIYNKLTWWEQIDNGKQLTRNRKFLTVVPVVLYLMASHTTDYQNPCLLLNTIAVLVLVIAKFPNMHKVRIFGIN

SEQ ID NO: 7710 - protein, 157 aa, Silene vulgaris
MANLYVKAMPSSDTNRNTDWFTYPGVWTTYILFILFTWLVVLSIFRCTSGMAWTIVNLAHFALTYHFFHWTKGTPFPEDQGIYNRLTWWEQIDNGKQLTRNRKFLTVVPVVLYLIASHTTDYEHPMLFLNTLAVIILVIAKFPHMHKVRIFGINGDQ

SEQ ID NO: 7711 - protein, 157 aa, Sorghum bicolor
  Sequence also found in Organisms: Triticum aestivum
MAKLYVQAFPPADLNKNTEWFMYPGVWTTYILIVFFSWLLVLSVFGCTPGTAWTVVNLFHFAITYHFFHWKKGTPFADDQGMYNGLTWWEQMDNGKQLTRNRKFLIVVPVVLYLIALHTTDYQQPMLFLNTLAVSVLVVAKLPNMHKVRIFGINAEN

SEQ ID NO: 7712 - protein, 154 aa, Fragaria vesca
MYVTAVRPTDLNRNTEWFTYPGVWTTYILIVFFSWLIVLCLFSCSPGMAWTVVHLAHFLVTYQFFHWKKGTPFADDQGIYNALTWWEQIDNGNQLTRNRKFLTVVPVVLYLIASHTTDYQNPMLFFNTLAVFVLVVAKFPNMHKVRIFGINGDL

SEQ ID NO: 7713 - protein, 154 aa, Eutrema halophilum
MYVRAVPTTDVNRNTEWFTYPGVWTTYILILFFGWLLVLSIFNCSPGMAWTIVHLAHFSVTYHFFHWKKGTPFGDDQGIYNRLTWWEQIDNGKQLTRNRKFLTLVPVVLYLIASHTTDYQHPMLFLNTLAVFIMVVAKFPHMHKVRIFGINADQ

SEQ ID NO: 7714 - protein, 154 aa, Juglans hindsii x Juglans regia
MYVRAVPPTDLNRNTEWFTYPGVWTTYILIVFFSWLVVLSVFNCSPGMAWTIVHLSHFLVTYHSFHWKKGTPFPDDQGIYNRLTWWEQIDNGKHLTRNRKFLTVVPVVLYLIASHTTDYQHPMLFLNTVAVFVLVVAKFPHMHKVRIFGINADQ

SEQ ID NO: 7715 - protein, 106 aa, Fagopyrum esculentum
MAWTVVNLGHFLVTYEFFHWKKGTPFADDQGIYNGLTWWEQFDNGKQLTRNRKFLTIVPVVLYLIASHTTDYQNPMLFLNTIAVFVLVVAKFPHMHKVRLFGINGE

SEQ ID NO: 7716 - protein, 81 aa, Carpinus betulus
MYVRAVPPTDLNRNTEWFTYPGVWTTYILILFFSGSSYSPSSTAPPAWPGPSSTSSISALLIISSTEKEHHLLKTKVSTIG

SEQ ID NO: 7717 - protein, 85 aa, Phalaenopsis aphrodite
MAKLYVETTPPPDLNKNTEWFMYPGVWTTYILILFFLWLLVLSVFGCTAGIAWTIVNLAHFAITYQFFIGGREHPLLKIRVYTII

SEQ ID NO: 7718 - protein, 159 aa, Distylium racemosum
MGNLYVQAVPPPDLNKNTSWFTYPGVWTTYILILFFTWLIVLALFGCTPGTAWTIVNLCHFAVTYHFFHWKKGTPFSEDQGIYNKLTWWEQIDNGKQLTRNRKFLTVVPVVLYLIASHTTDYQNPWLFLNTIAVLVLVIAKFPNMHKVRIFGINSDYPI

SEQ ID NO: 7719 - protein, 159 aa, Podocarpus macrophillus
MGNLYVQAVPPPDLNKNTSWFMYPGVWTTYILILFFTWLTVLSVFGCKAGTAWTIVNLCHFAVTYHFFHWKKGTPFSEDQGIYNKLTWWEQIDNGKQLTRNRKFLTVVPVVLYLIASHTTDYQNPWLFLNTIAVLVLVIAKFPNMHKVRIFGINADYAI

SEQ ID NO: 7720 - protein, 149 aa, Bupleurum chinense
DTTDGSEQNTEWFTYPGVWTTYILILFFAWLVVLSLLNCSPGMAWTIVNLSHFLVTYHFFHWKKGTPFADDQGIYNGLTWWEQVDNGKQLTRNRKFLTVVPVVLYLIASHTTDYQHPMLLLNTIAVTVLVIAKFPNMHKVRIFGINGEQ

SEQ ID NO: 7721 - protein, 157 aa, Cocos nucifera
MAKLYVQTVSPVDLNKNTEWFMYPGVWTTYILILFFSWLLVLSIFGCTPGMAWTVVNLFHFAVTYHFFHWKKGTPFAEDQGIYNNLTWWEQMDNGKQLTRNRKFLTILPVVLYLISSHTTDYQNPMLLLNTFAVLVLVVAKLPNMHRVRILGINADR

SEQ ID NO: 7722 - protein, 157 aa, Echinochloa colona
MAKLYVQAFPPPDLNKNTEWFMYPGVWTTYILTLFFSWLLVLSVFGCTPGTAWTVVNLFHFAITYHFFHWKKGTPFADDQGMYNALTWWEQMDNGKQLTRNRKFLIVVPVVLYLIALHTTDYQQPMLFLNTLAVSVLVVAKLPNMHKVRIFGINAED

SEQ ID NO: 7723 - protein, 155 aa, Musa acuminata
MAKLYVQTVPPPDLNKNTEWFMYPGVWSTYILILFFSWLLVLSVFRCTPGMAWTVVNLFHFAITYYFFHWKKGTPFAEDQGIYNNLTWWEQMDNGKQLTRNRKFLTVVPVVLYLMALHTTDYQHLMLFLNTLAVAILVIAKFPNMHKVRIFGINE

SEQ ID NO: 7724 - protein, 157 aa, Bupleurum chinense
MANYYVRAVPPPDLNKNTEWFTYPGVWTTYILILFFSWLVVLSVLNCSPGIAWTIVHLTHAFITYQCFHWKKGTPFSEDQGIYNRLTWWEQIDNGNQLTRNRKFLTVVPVVLYLIASHTTDYQNPMLFFNTVAVFVLVVAKFPNMHKVRIFGINADQ

SEQ ID NO: 7725 - protein, 157 aa, Taraxacum officinale
MANLYVQAAPPTDLNRNTEWFTYPGVWITYILTLFFAWLAVLSVFGCSPGVAWTIVNLAHAVMTYHFFHWKKGTPFADDQGIYNRLTWWEQIDSGKQLTRNRKFLTLVPLVLYLIASHTTDYQNPMLILNTVAVFVLVVAKFPHMHKVRIFGINAEE

SEQ ID NO: 7726 - protein, 154 aa, Guizotia abyssinica
MYVKATPTTDLNRNTDWFTYPGVWTTYIFIILFSWFLILSVSGCTPGMAWTIVNLSHFLVTYHFFHWMKGTPFAEDQGIYNRLTWWEQIDNGKQLTRNRKFLTVVPVVLYLIALHTTDYQHPMLFLNTIAVIVLVIVKFPNMHKVRIFGINGDM

SEQ ID NO: 7727 - protein, 157 aa, Lolium multiflorum
MAKLYVQAVPPPDLNKNTEWFMYPGVWTTYIFILFVSWLLVLSVFGCTPGMAWTIVNLGHFAITYHFFHWKKGTPFADDQGMYNRLTWWEQMDNGKQLTRNRKFLVVVPVVLYLIASHTTDYQHPMLFLNTIAVTVLVVAKLPNMHKVRIFGINAGN

SEQ ID NO: 7728 - protein, 157 aa, Zea mays
MAKLYVQAFPPADLNKNTEWFMYPGVWTTYIIIVFFSWLLVLSVFGCTPGTAWTVVNLFHFAITYHFFHWKKGTPFADDQGMYNTLTWWEQMDNGKQLTRNRKFLIVVPVVLYLIALHTTDYQQPMLFLNTLAVSVLVVAKLPNMHKVRIFGINAES

SEQ ID NO: 7729 - protein, 157 aa, Pennisetum glaucum
MVKLYVQAVPPPDLNRNTEWFMYPGVWTTYILILFFSWILVLSVFGCAPGTAWTLVHLGHFAITYHFFHWKKGTPFADDQGMYNTLTWWEQMDNGKQLTRNRKFLTAVPVVLYLIASHTTDYQHPMLFLNTLAVIVLVVAKLPNMHKVRIFGINAGS

SEQ ID NO: 7730 - protein, 157 aa, Pseudoroegneria spicata
  Sequence also found in Organisms: Secale cereale, Triticum aestivum
MAKLYVQAVPPPDLNKNTEWFMYPGVWTTYIFILFVSWLLILSIFGCTPGMAWTLVNLGHFAITYHFFHWKKGTPFADDQGMYNRLTWWEQMDNGKQLTRNRKFLVVVPVVLYLIASHTTDYQHPMLFLNTIAVTVLVVAKLPNMHKVRIFGINAGN

SEQ ID NO: 7731 - protein, 157 aa, Panicum virgatum
MAKLYMQAVPPPDLNRNTEWFMYPGVWTTYILILFFSWILVLSVFGCAPGTAWTLVNLGHFAITYHFFHWKKGTPFADDQGMYNTLTWWEQMDNGKQLTRNRKFLTAVPVVLYLIASHTTDYQHPMLFLNTLAVTVLVVAKLPNMHKVRIFGINAGS

SEQ ID NO: 7732 - protein, 157 aa, Panicum virgatum
MAKLYVQAVPPPDLNRNTEWFMYPGVWTTYILILFFSWILVLSVFGCAPGTAWTLVNLGHFAITYHFFHWKKGTPFADDQGMYNTLTWWEQMDNGKQLTRNRKFLTAVPVVLYLIASHTTDYQHPMLFLNTLAVTVLFVAKLPNMHKVRIFGINAGS

SEQ ID NO: 7733 - protein, 154 aa, Eutrema halophilum
MYVRAVPTTDVNRNTEWFTYPGVWTTYILILFFSWLLVLSVFHCSPGIAWTVVHLAHFTVTYHSFHWKKGTPFGDDQGIYNRLTWWEQIDNGKQLTRNRKFLTLVPVVLYLIASHTTDYQHPMLFLNTLAVFVMVVAKFPHMHKVRIFGINADQ

SEQ ID NO: 7734 - protein, 148 aa, Utricularia gibba
PPPDLNRNTEWFTYPGVWTTYILILFFSWLVVLSVTNCTPGMALTIVNLSHFLITYHFFHWKKGTPFGDDQGIYNRLTWWEQIDNGKQLTRNRKFLTVVPVVLYLIASHTTDYQHPMLLFNTLAVLVLVIAKFPNMHKVRIFGINGDQ

SEQ ID NO: 7735 - protein, 148 aa, Utricularia gibba
PPPDLNRNTEWFTYPGVWTTYILILFFAWLVVLSVTNCTPGMAWTIVNLSHFLITYHFFHWKKGTPFGDDQGIYNSLTWWEQIDNGKQLTRNRKFLTVVPVVLYLIASHTTDYQHPMLLFNTLAVLVLVIAKFPNMHRVRIFGINGDQ

SEQ ID NO: 7736 - protein, 83 aa, Malus domestica
MYVTAVRPTDLNRNTEWFTYPGVWTTYILMVFFSWLTVLCLFSCSPGMAWTVVHLSHFLVFVITFFTGRKEHHLQMIRVSTMH

SEQ ID NO: 7737 - protein, 319 aa, Panax ginseng
DFAQVYESSTLHQRNIELVKSLSIPPPGSKELYFPTRFSQNGWGQFKSCLWKQHLSYWRSPSYNLMRSMHMIFTSLLFGLLFWDQGQKIDNQQSLFSIFGSMFSATIFAGINNASSVLPYVSTERNVLYRERFAGMYAPWAYALAQVTIEVPYLFAQSLVYVIITYPMIGYYWSPYKVFWFFYSMFCTLLYFTYMGMMIVSITPTFPVAAILQSSFYTMFNLFSGFIIPQPQIPKWWLWFYYLIPTSWTLNGMLSSQYGDIEKKILAFGERKTVAAFLKDYFGFHHDRLPLVGVIMMLYPIVFASIFAYCIGKLNFQRR

SEQ ID NO: 7738 - protein, 155 aa, Musa acuminata
MVKLYVKTVPPTDLNKNTEWFMYPGVWTTYILILFFCWLLVLSVVGCTPGMAWTAVNLLHFAVTYYFFHWKKGTPFAEDQGIYNNLTWWEQMDDGRQLTRNRKFLIVVPVVLYLIASHTTDYRHPMLFLNTLAVAILVIAKFPNMHKVRIFGING

SEQ ID NO: 7739 - protein, 157 aa, Daucus carota
MANYYVRAVPPPDLNKNTEWFTYPGVWTTYILILFFSWLVVLSVLNCSPGIAWTVVHLAHAFITYQCFHWKKGTPFSDDQGIYNRLTWWEQIDNGNQLTRNRKFLTVVPVVLYLIASHTTDYQNPMLFLNTVAVFVLVVAKFPNMHKVRIFGINADQ

SEQ ID NO: 7740 - protein, 157 aa, Avena sativa
MAKLYVQAVPPPDLNKNTEWFMYPGVWTTYIFILFVSWLLVLSVFGCTPGMAWTIVNLGHFAMTYHFFHWKKGTPFADDQGMYNRLTWWEQMDNGKQLTRNRKFLVVVPVVLYLIASHTTDYQHPMLFFNTIAVTILVVAKLPNTHKVRIFGINAGN

SEQ ID NO: 7741 - protein, 155 aa, Avena sativa
MAKLYVQAVPPPDLNKNTEWFMYPGVWTTYIIILFVSWLLVLSIFGCTPGMAWTIVNLGHFAMTYHFFHWKKGTPFADDQGMYNRLTWWEQMDNGKQLTRNRKFLVVVPVVLYLIASHTTDYQHPMLFSTPSLSLYWLSPNYRTCTRSVFRNQCR

SEQ ID NO: 7742 - protein, 157 aa, Allium cepa
MAKLYVETMPPADMNKNTEWFMYPGVWTTYILILFLSWLIVLSVFRCTPGMAWTVVNLTHFAITYHFFHWKKGTPFAEDQGIYRALTWWEQMDSGKQLTRNRKFLTVVPIVLYLIASHTTDYQNPMLFLNTLAVFILVIAKLPNMHKVRILGINADH

SEQ ID NO: 7743 - protein, 157 aa, Petroselinum crispum
MANYYVRAVPPPDLNKNTEWFTYPGVWTTYILILFFSWLVVLSVLNCSPGIAWTVVHLTHAFITYQCFHWKKGTPFSDDQGIYNRLTWWEQIDNGNQLTRNRKFLTVVPVVLYLIASHTTDYQNPMLFLNTVAVFVLVVAKFPNMHKVRIFGINADQ

SEQ ID NO: 7744 - protein, 154 aa, Arabidopsis lyrata
  Sequence also found in Organisms: Eutrema parvulum
MYVRALPTTDVNRNTEWFTYPGVWTTYILILFFSWLLVLSVFHCSPGIAWTIVHLAHFTVTYHSFHWKKGTPFGDDQGIYNRLTWWEQIDNGKQLTRNRKFLTVVPVVLYLIASHTTDYQHPMLFLNTLAVFVMVVAKFPHMHKVRIFGINGDQ

SEQ ID NO: 7745 - protein, 157 aa, Brassica juncea
MAKVYVKTVPAPDMNRNTEWFMYPGVWTTYILIIFFGWLAVLSVSGCSPGMAWTVVNLSHFLVTYHSFHWMKGTPFGEDQGIYNALTWWEQMDNGQQLTRNRKFLTVVPVVLYLIASHTTDYRHPWLFLNTLAVMVLVVAKFPNMHKVRIFGINGDK

SEQ ID NO: 7746 - protein, 154 aa, Brassica rapa
MYVRALPTTDVNRNTEWFTYPGVWTTYILILFFSWLLVLSVFHCSPGMAWTIVHLAHFTVTYHSFHWKKGTPFGDDQGIYNRLTWWEQIDNGKQLTRNRKFLTVVPIVLYLIASHTTDYQHPMLFLNTLAVFVMVVAKFPHMHKVRIFGINGDQ

SEQ ID NO: 7747 - protein, 155 aa, Musa acuminata
MVKLYVKTVPPPDLNKNTEWFMYPGVWTTYILILFFCWLLVLSVVGCTPGMAWTAVNLLHFAVTYYFFHWKKGTPFAEDQGIYNNLTWWEQMDDGRQLTRNRKFLIVVPVVLYLIASHTTDYRHPMLFLNTLAVAILVIAKFPNMHKVRIFGING

SEQ ID NO: 7748 - protein, 157 aa, Brachypodium distachyon
MAKLYVQAVPPADLNKNTEWFMYPGVWTTYILILFFSWLLVLSVFGCTAGMAWTVVNLFHFAITYHFFHWKKGTPFADDQGVYNTLTWWEQMDSGQQLTRNRKFLAVVPVVLYLIALHTTDYQHPMLSLNTLAVTVLVVAKLPNMHKVRIFGINGGI

SEQ ID NO: 7749 - protein, 154 aa, Manihot esculenta
MYVKAVPPTDLNRNTEWFTYPGVWTTYILMVLMSWLIVLSLFGCSHGMAWTIVHLAHFLITYHFFHWKKGTPFADDQGIYNGLTWWEQIENGKQLTRNRKFLTVAPVVLYLIASHTTDYQNPMLFFNTLAVFVLVVAKFPHMHKVRIFGINADQ

SEQ ID NO: 7750 - protein, 154 aa, Gossypium hirsutum
  Sequence also found in Organisms: Gossypium raimondii
MYVRAVPPTDLNKNTEWFTYPGVWTAYILIVFFSWLMVLSVFGTSPGIAWTIVHLTHFFVTYHFFHWKKGTPFADDQGIYNGLTWWEQIDNGKQLTPNRKFLTVVPVVLYLIASHTTGYQNPLLFFNTLAVFVLVVAKFPNMHKVRIFGINADH

SEQ ID NO: 7751 - protein, 155 aa, Curcuma longa
MAMLYVQTVQPTDLNKNTEWFMYPGVWTIYILILFFYWLLVLSVFGCSPGMAWTVVNLSHFAVTYYFFHWEKGTPFADDQGIYNNLTWWEQIDNGKQLTRNRKFMIVVPVVLYLIASHTTNYHHPMLFLNTLAVAILVIAKFPNMHKVRIFGING

SEQ ID NO: 7752 - protein, 154 aa, Euphorbia peplus
  Sequence also found in Organisms: Euphorbia esula
MYVKAVPPTDLNRNTEWFTYPGVWTTYMLMVFISWLIVLSLFGCSPGMAWTIVHLAHFVITYHFFHWKKGTPFGDDQGIYNGLTWWEQIENGKQLTRNRKFLTVVPVVLYLIASHTTDYQNPMLFFNTLAVFVLVVAKFPNMHKVRIFGINGEH

SEQ ID NO: 7753 - protein, 157 aa, Gerbera hybrid cultivar
MANLYVQAMPPTDLNRNTEWFTYPGVWTIYIFILFFSWLVFLSVFGCSPGVAWTIVNLSHALLTYHFFHWKKGTPFADDQGIYNRLTWWEQIDSGKQLTRNRKFLTLVPLVLYLIASHTTDYQNPMLLLNTVAVFVLVVAKFPHMHKVRIFGINAGE

SEQ ID NO: 7754 - protein, 152 aa, Heritiera littoralis
MYVRASPTTDLNKNTEWFTYPGVWTTYILIVFFSWLIVLSLFGSSPGTAWTIVHLSHFFVTYHFFHWKKGTPFADDQGIYNGLTWWEQIDNGKQLTRNRKFLTVVPVVLYLIASHTTDYQNPMLFFNTLAVFVLVVAKFPDMHKVRIFGINA

SEQ ID NO: 7755 - protein, 155 aa, Tropaeolum majus
MYVRAVPPTDVNRNTEWFTYPGVWTIYIFILFFAWLIVLSVFGCAPGMAWTIVHLSHFLVTYQFFHWKKGTPFADDQGIYNGLTWWEQIENGKQLTPNRKFLTVVPVVLYLISSHTTDYQHPMLFLTRWQFLYWWLPSSRTCTRFVYLESMLIIE

SEQ ID NO: 7756 - protein, 150 aa, Elaeis guineensis
TVPPVDLNKNTEWFMYPGVWTTYILILFFSWLLVLSIFGCTPGMAWTVVNLFHFAVTYHFFHWKKGTPFAEDQGIYNNLTWWEQMDNGKQLTRNRKFLTIVPVVLYLISSHTTDYQNPMLSLNTLAVIVLVVAKLPNMHRVRILGINADR

SEQ ID NO: 7757 - protein, 154 aa, Carica papaya
MYVQAVPTTDVNRNTEWFTYPGVWTTYILILFFSWLIVLCIFGCSPGMAWTIVHLSHFIVTYQCFHWKKGTPFADDQGIYNGLTWWEQIDNGKQLTRNRKFLTVVPVVLYLIASHTTDYENPMLFLNTLAVFILVVAKFPHMHKVRIFGINADH

SEQ ID NO: 7758 - protein, 157 aa, Papaver somniferum
MAKLYVQAVHPPDLNKNTEWFLYPGVWTTYILILFFSWLMVLSLFGCNPGTAWTIVNLSHFVITYHFFHWMKGTPFSEDQGIYNGLTWWEQIDNGKQLTRNRKFLTVVPVVLYLIASHTTDYQQPILFLNTLAVFVLVVAKFPNMHKVRIFGINGEK

SEQ ID NO: 7759 - protein, 154 aa, Prunus persica
  Sequence also found in Organisms: Prunus mume
MYVTAVRTTDLNRNTEWFTYPGVWTTYILTVFFSWLVVLCLFSCSPGMAWTIVHLCHFLVTYHFFHWKKGTPFADDQGIYNALTWWEQIDNGNQLTRNRKFLTVVPVVLYLIASHTTDYQNPNLIFNTLAVFVLVVAKFPNMHKVRIFGINADH

SEQ ID NO: 7760 - protein, 157 aa, Saccharum officinarum
MAKLYVQAVPPPDLNRNTEWFMYPGVWTTYILILFFCWILVLSVFGCAPGTAWTLVNLGHFAITYHFFHWKKGTPFADDQGMYNTLTWWEQMDNGKQLTRNRKFLTAVPVVLYLIASHTTDYQRPMLFLNTIAVTVLVVAKLPNMHKVRIFGINAGS

SEQ ID NO: 7761 - protein, 155 aa, Zostera marina
MAKLYVQTTQPTDLNKNTEWFMYPGVWTTYILILFFSWLLVLSVFGCTPGMAWTIINLSHFIITYQFFHWKKGTPFAEDQGIYNALTWWEQMDNGKQLTKNRKFLTVVPVVLYLIASHTTDYQQPMLLLNTLAVIVLVVAKFPNMHKVRIFGING

SEQ ID NO: 7762 - protein, 158 aa, Panax ginseng
MANYYYVNATPPTDLNKNTEWFTYPGVWSIYIFILFFAWIVVLSLFNCSPGMAWTILHLSHFLVTYHFFHWKKGTPFSDDQGIYNGLTWWEQIDNGKQLTLNRKFLTVIPVVLFLIASHTTDYQNPVLFLNTLAVIVLVIAKFPNMHKVRIFGINGDQ

SEQ ID NO: 7763 - protein, 155 aa, Brassica oleracea
MMYVRALPTTDVNRNTEWFTYPGVWTTYILILFFSWLLVLSIFNCSPGMAWTIVHLAHFAATYHLFHWKKGTPFGDDQGIYNRLTWWEQIDNGKQLTRNRKFLTLVPVVLYLIASHTTDYQNPMLFLNTLAVFIMVVAKFPHMHKVRIFGINADQ

SEQ ID NO: 7764 - protein, 154 aa, Brassica napus
  Sequence also found in Organisms: Brassica oleracea
MYVRALPTTDVNRNTEWFTYPGVWTTYIIILFFSWLLVLSVFHCSPGMAWTIVHLAHFTVTYHSFHWKKGTPFGDDQGIYNRLTWWEQIDNGKQLTRNRKFLTVVPIVLYLIASHTTDYQHPMLFLNTLAVFVMVVAKFPHMHKVRIFGINGDQ

SEQ ID NO: 7765 - protein, 156 aa, Amborella trichopoda
MGNLYVQAVPPPDLNKNTEWFMYPGVWTIYILILFFAWLIVLSVFGCSAGMAWTIVNLSHFAVTYRCFHWQKGTPFAEDQGIYNALTWWEQMDNGKQLTRNRKFLMVVPVVLYLIASHTTDYRNPWLLLNTIAVFVLVIAKFPNMHKVRIFGINAE

SEQ ID NO: 7766 - protein, 154 aa, Ambrosia trifida
MYVKATQTTDLNRNTDWFTYPGVWIAYIFIIFFSWLLILSLSGCSPGMAWTILHFSHFLVTYHFFHWMKGTPFAEDQGIYNRLTWWEQIDNGKQLTRNRKFLTVVPVVLYLIASHTTDYQHPMLFLNTVAVTVLVIAKFPNMHKVRIFGINGDM

SEQ ID NO: 7767 - protein, 154 aa, Arabidopsis thaliana
MYVRALPTTDVNRNTEWFTYPGVWTTYILILFFSWLLVLSVFHCSPGIAWTIVHLAHFTVTYHSFHWKKGTPFGDDQGVYNRLTWWEQIDNGKQLTRNRKFLTVVPVVLYLIASHTTDYQHPMLFLNTLAVFVMVVAKFPHMHKVRIFGINGDQ

SEQ ID NO: 7768 - protein, 154 aa, Brassica napus
  Sequence also found in Organisms: Brassica rapa
MYVRALPTTDVNRNTEWFTYPGVWTTYILILFFSWLLVLSIFNCSPGMAWTIVHLAHFAATYHLFHWKKGTPFGDDQGIYNRLTWWEQIDNGKQLTRNRKFLTLVPVVLYLIASHTTDYQNPMLFLNTLAVFIMVVAKFPHMHKVRIFGINADQ

SEQ ID NO: 7769 - protein, 157 aa, Brassica napus
MAKLYVKAVAPPDMNRNTEWFMYPGVWTTYILIIFFGWLAVLSVSGCSPGMAWTVVNLSHFLVTYHSFHWMKGTPFGEDQGIYNALTWWEQMDNGQQLTSNRKFLTVVPIVLYLIASHTTDYRHPWLLLNTLALMVLVVAKFPNMHKVRIFGINADM

SEQ ID NO: 7770 - protein, 154 aa, Ricinus communis
MYVKAVPTTDVNRNTEWFTYPGVWTTYILMVFISWLIVLSLFGCSPGMAWTIVHLSHFVITYQFFHWKKGTPFADDQGIYNGLTWWEQIENGKQLTRNRKFLTVVPVVLYLIASHTTDYQNPMLFFNTLAVFVLVVAKFPHMHKVRIFGINAGH

SEQ ID NO: 7771 - protein, 154 aa, Gossypium hirsutum
MYVRAVPPTDLNKNTEWFTYPGVWTAYILIVFFSWLMVLSVFGTSPGIAWTIVHLTHFFVTYHFFHWKKGTPFAVDQGIYNGLTWWEQIDNGKQLTPNRKFLTVVPVVLYLIASHTTGYQNSLLFFNTLAVFVLVVAKFPNMHKVRIFGINADH

SEQ ID NO: 7772 - protein, 154 aa, Gossypium hirsutum
  Sequence also found in Organisms: Gossypium raimondii
MYVRAVPTTDLNKNTEWFTYPGVWTTYILMVFISWLLVLSLFGTSAGTAWTIVHLAHFFVTYHFFHWKKGTPFADDQGIYNGLTWWEQIDNGKQLTRNRKFLTVVPVVLYLIASHTTDYQNPMLFFNTLAVFVLVVAKFPNMHKVRIFGINGEH

SEQ ID NO: 7773 - protein, 157 aa, Eschscholzia californica
MAKLYVQAIPPPDLNKNTEWFMYPGVWTTYILILFFSWLVVLSLFNCTPGMAWTIVNLSHFIVTYYFFHWMKGTPFSEDQGMYNGLTWWEQIDSGKQLTRNRKFLTVVPVVLYLMASHTTDYQQPILFLNTLAVFVLVVAKFPNMHKVRIFGINGDK

SEQ ID NO: 7774 - protein, 154 aa, Raphanus sativus
MYVRALPTTDVNRNTEWFTYPGVWTTYILILFFSWLLVLSVFHCSPGIAWTIVHLAHFTVTYHSFHWKKGTPFGDDQGIYNRLTWWEQIDNGKQLTRNRKFLTVVPIVLYLIASHTTDYQHPMLFLNTLAVFVMVVAKFPHMHKVRIFGINGDQ

SEQ ID NO: 7775 - protein, 157 aa, Tragopogon dubius
MANLYVQAAPPTDLNRNTEWFTYPGVWITYILILFFSWLVVLSVFGCSPGIAWTIVNLSHALMTYHFFHWKKGTPFADDQGIYNRLTWWEQIDSGKQLTRNRKFLTLVPLVLYLIASHTTEYKNPMLLLNTISVFVLVLAKFPHMHKVRIFGINAEE

SEQ ID NO: 7776 - protein, 154 aa, Tripterygium wilfordii
MYVRAVPTTDLNRNTEWFTYPGVWTTYIFIVFISWLIVLSVFGCSAGTAWTIVHLAHFFVTYHFFHWKKGTPFSDDQGIYNGLTWWEQIENGKQLTRNRKFLTVAPVVLYLIASHTTDYQHPMLFFNTLAVFVMVVAKFPNMHKVRIFGINADH

SEQ ID NO: 7777 - protein, 1061 aa, Brassica oleracea
MSGSSRNNQQRKKADLATILRKSWYHLRLSVRHPTRVPTWDAILLTAASPEQAELYDWQLRRAKRMGRIADSTVTLAVPDPDGKRIGSGAATLNAIYALALHYQKLGFDPIASEEEVANGRCAQSSPMSWVRFLSEKHVLMLHAGGDSKRVPWANPMGKVFLPLPFLASDDPDGPVPLLFDHILALASSARHAFGDQGGLFIMTGDVLPCFDAFKMTLPEDSASIVTVPITLDIASNHGVIVTSKSESLAEGFTVSLVNDLLQKPTVEELVKKDAILHDGRTLLDTGIISARGRAWLDLVALGCSCQPMISELLGSKKEMSLYEDLVAAWVPSRHDWLRTRPLGDHLVNSLGRQKMYSYCTYDLQFLHFGTSSEVLDHLSGDASGIVGRRHLCSIPATTVSDIAASCVILSSEIAPGVSIGEDSLIYDSTVSGAVQIGSQSVVVGIHIPSEAPESFRFMLPDRHCLWEVPLVGHKERVIVYCGLHDNPKNSIHKDATFCGKPLEKVLCDLGIEESDLWNFKASSQERCLWNAKMFPILTYSEMLKLASWLMGLDDGRSKEKIALWRSAKRVSLEELHGSINFPEMCSGSSNHQADLAAGIAKACVNYGMLGRNLSQLCHEILQKESLGLEICKKFLDQCPKFQEQNSRILPKSRAYQVEVDLLRACGDEAKALDLEHRVWEAVAEETASAVRYGFREHLLESSGKPPSEKNHISLSQPRRTKVELPVRVDFVGGWSDTPPWSLERAGCVLNMAITLEGSLPIGTIIETTNEKSGISIQDDAGNALHIEDPRTIKTPFEVNDPFRLVKSALLVTGVVQEHSTGLAIKTWANVPRGSGLGTSSILAAAVVKGLLQISDGDESNENVARLVLVLEQLMGTGGGWQDQIGGLYPGIKFTSSFPGIPLRLQVVPLLASPQLISELQQRLLVVFTGQVRLAHQVLHKVVTRYLQRDNLLISSIKRLTELAKSGREALMNCEVDELGEIMSEAWRLHQELDPYCSNEFVDRLFAFSQPYSSGFKLVGAGGGGFSLILAKDAEKAKELRQRLEEHPEFDVKIYDWSISL

SEQ ID NO: 7778 - protein, 171 aa, Abies balsamea
MAEGGLSFPNMGIGNLYVQAVPPPDLNKNTSWFMYPGVWTTYILILFFTWIIVLCLFGCTVGTAWTIVNLAHFAVTYHFFHWKKGTPFSEDQGIYNKLTWWEQIDNGKQLTRNRKFLTVVPVVLYLIASHTTDYQNPCLFLNTIAVLVLVIAKFPNMHKVRIFGINSDYPK

SEQ ID NO: 7779 - protein, 171 aa, Pinus pinaster
MAEGGLSFPNMGIGNLYVQAVPPPDLNKNTSWFMYPGVWTTYILILFFTWIIVLSLFGCTAGTAWTMVNLAHFAVTYHFFHWKKGTPFSEDQGIYNKLTWWEQIDNGKQLTRNRKFLTVVPVVLYLIASHTTDYRNPWLFLNTIAVLVLVIAKFPNMHKVRIFGINSDYPI

SEQ ID NO: 7780 - protein, 171 aa, Pinus taeda
MAEGGLSFPNMGIGNLYVQAVPPPDLNKNTSWFMYPGVWTTYILILFFTWIIVLSLFGCTAGTAWTIVNLAHFAVTYHFFHWKKGTPFSEDQGIYNKLTWWEQIDNGKQLTRNRKFLTVVPVVLYLIASHTTDYRNPWLFLNTIAVLVLVIAKFPNMHKVRIFGINSDYPI

SEQ ID NO: 7781 - protein, 169 aa, Pseudotsuga menziesii
MAEGGLSFPNIGNLYVQAVPPPDLNKNTSWFMYPGVWTTYILILFFTWIIVLSLFGCTAGTAWTIVHLVHFAVTYHFFHWKKGTPFSEDQGIYNKLTWWEQIDNGKQLTRNRKFLTVVPVVLYLIASHTTDYQNPWLFLNTIAVLVLVIAKFPNMHKVRIFGINSDYPI

SEQ ID NO: 7782 - protein, 164 aa, Brassica juncea
MYVRALPTTDVNRNTEWFTYPGVWTTYILILFFSWLLVLSIFNCSPGMAWTIVHLAHFSVTYHLFHWKKGTPFGDDQGIYNRLTWWEQIDNGKQLTRNRKFLTLVPVVLYLIASHTTDYQNPMLFLNTLAVFIMVVAKFPHMHKVRIFGINAERRGSGHGTLHS

SEQ ID NO: 7783 - protein, 159 aa, Cephalotaxus harringtonia
MGDLYVHAVPPPDLNKNTSWFMYPGVWTSYILILFFAWLIALAVSGCTPGTAWSVVNLCHFAVTYHFFHWKKGTPFSEDQGIYNKLTWWEQIDNGKQLTRNRKFLTVVPVVLYLIASHTTDYQNPWLFLNTIAVLVLVIAKFPNMHKVRIFGINADYPM

SEQ ID NO: 7784 - protein, 159 aa, Sciadopitys verticillata
MKNLYVDAVPPVDLNKNTSWFQYPGVWTTYILILFFTWLIVLSLFGCNAGMAWTIVHLAHFAVTYHFFHWKKGTPFSEDQGIYNKLTWWEQMDNGKQLTRNRKFLTAVPVVLYLIASHTTDYKNPWLFLNTIAVIVLVIAKFPNMHKVRILGINADYPI

SEQ ID NO: 7785 - protein, 159 aa, Sciadopitys verticillata
MGNLYVQAVPPPDLNKNTAWFMYPGVWTTYILILFFTWLIVISVSGCSPGTAWTIVNLCHFAVTYHFFHWKKGTPFSEDQGIYNKLTWWEQIDNGKQLTRNRKFLTIVPVVLYLIASHTTDYQNPWLFLNTISVLVLVVAKFPNMHKVRIFGINADYAI

SEQ ID NO: 7786 - protein, 158 aa, Fagopyrum esculentum
MLNLLYVRADPSADLNKNTEWFTYPGVWTTYIILVFFSWLLVLSLLGCSPGMAWTIVHLIHFFVTFHFFHWKKGTPFAEDQGIYNGLTWWEQIDNGNQLTRNRKFLTVVPVVLYLIASHTTDYQNPMLFLNTLAVFIMVVAKFPQMHKVRIFGINGEY

SEQ ID NO: 7787 - protein, 171 aa, Picea glauca
MAEGGLSFPNIGIGNLYVQAVPPPDLNKNTSWFMYPGVWTTYILILFFTWIIVLSLFRCTAGTAWTIVNLFHFAVTYHFFHWKKGTPFSEDQGIYNKLTWWEQVDNGKQLTRNRKFLTVVPVVLYLIASHTTDYRNPWLFLNTIAVLVLVIAKFPNMHKVRIFGINSDYPI

SEQ ID NO: 7788 - protein, 93 aa, Tripterygium wilfordii
MANLYVKAVPPADLNRNTEWFMYPGVWTTYILILFFSWLLVLSIFGCSPGMAWTIVNLAHFGVTYQFFHWKKGTPFAEDRGDLQQADLVGANR

SEQ ID NO: 7789 - protein, 154 aa, Ambrosia trifida
MYVKATQTTDLNRNTDWFTYPGVWIAYIFIIFFSWLLILSLSGCSPGMAWTILHFSHFLVTYHFFHWMKGTPFADDQGIYNRLTWWEQIDNGKQLTRNRKFLTVVPVVLYLIASHTTDYQHPMLFLNTVAVTVLVIAKFPNMHKVRIFGINGDM

SEQ ID NO: 7790 - protein, 154 aa, Brassica oleracea
MYVRALPTTDVNRNTEWFTYPGVWTTYILILFFSWLLVQSIFNCSPGMAWTIVHLAHFAVTYHLFHWKKGTPFGDDQGIYNRLTWWEQIDNGKQLTRNRKFLTLVPVVLYLIASHTTDYQNPMLFLNTLSVFIMVVAKFPHMHKVRIFGINADQ

SEQ ID NO: 7791 - protein, 159 aa, Flaveria ramosissima
MYVKATPTTDLNRNTDWFTYPGVWTTYIVILFFSWLLILSVFGCTPGMAWTIVNLSHFIVTYQFFHWMKGTPFAEDQGIYNRLTWWEQIDNGKQLTRNRKFLTVVPVVLYLIASHTTDYQHPMLFLNTVAVIVLVIARFPNMHKVRIFGLMEICDSRSQ

SEQ ID NO: 7792 - protein, 154 aa, Linum usitatissimum
MYVTADPPTDVNRNTEWFTYPGVWTTYIIILFTSWFMVLCLFGCSPGTAWTVVHLAHFLVTYHCFHWKKGTPFADDQGIYNGLTWWEQIENGKQLTRNRKFLTVVPVVLYLIASHTTDYQNPMLFFNTVAVFVLVVAKFPHMHKVRIFGINGDF

SEQ ID NO: 7793 - protein, 154 aa, Raphanus sativus
MYVRALPTTDVNRNTEWFTYPGVWTTYILILFFSWLLVLSIFNCSPGMAWTIVHLAHFAVTYHLFHWKKGTPFGDDQGVYNRLTWWEQIDNGKQLTRNRKFLTLVPVVLYLIASHTTDYQNPMLFLNTLAVFIMVVAKFPHMHKVRIFGINAEQ

SEQ ID NO: 7794 - protein, 110 aa, Brassica rapa
MYVRALPTTDVNRNTEWFTYPGVWTTYILILFFSWLLVLSVFHCSPGMAWTIVHLAHFTVHLYHSFHWKKGTPFGDDQGIYNRLTWWEQIDNGKQLTRNRKFLTVVPIVL

SEQ ID NO: 7795 - protein, 162 aa, Brachypodium distachyon
MGRRVASYYVEAAPPVDVNKNTEWFMYPGVWTTYILLLFFAWLLVLSVSACSPGAAWTAVNLGHFAITYHFFHWKKGTPFAADDQGIYNRLTWWEQIDNGQQLTRNRKFLTVVPVVLYLIASHLTDYNQPMLFLNTVAVLVLVVAKLPNMHKVRIFGINADI

SEQ ID NO: 7796 - protein, 164 aa, Oryza sativa
MGRRAGSYPYYVEAAPPVDVNKNTEWFMYPGVWTTYILLLFFAWLLVLSVSACSPGIAWTVVNLAHFAITYHFFHWKKGTPFAADDQGIYNRLTWWEQIDNGQQLTRNRKFLTVVPVVLYLIASHLTDYKQPMLFLNTIAVLVLVVAKLPNMHKVRIFGINADI

SEQ ID NO: 7797 - protein, 157 aa, Allium cepa
MGKMYVKTMPPPDINKNTEWFMYPGVWTTYILILFFSWLIVLSIFRCTPGIAWTIVSLSHFVITYHCFHWKKGTPFAEDQGVYSTLTWWEQIDNGKQLTRSRKFLTVVPVVLYLIASHTTDYQHPMLIFNTIAVIVLVIAKLPNMHKVRIFGINSGI

SEQ ID NO: 7798 - protein, 145 aa, Arnica chamissonis
DLNRNTDWFTYPGVWTTYISILFFSWFFILSVSGCTPGMAWTILNLSHFLVTYHFFHWMKGTPFAEDQGVYNRLTWWEQIDNGKQLTRNRKFLTVVPVVLYLIASHTTDYQHPMLFLNTVAVIVLVIAKFPNMHKVRIFGINGDM

SEQ ID NO: 7799 - protein, 157 aa, Brassica rapa
MAKQYVKAVAAPDMNRNTEWFMYPGVWTTYILIIFFGWLAVLSVSGCSPGMAWTVVNLSHFLVTYHSFHWMKGTPFGEDQGIYNALTWWEQMDNGQQLTSNRKFLTVVPIVLYLIASHTTDYRHPWLLLNTLALMVLVVAKFPNMHKVRIFGINADK

SEQ ID NO: 7800 - protein, 162 aa, Lolium multiflorum
MGRRGASYYVEAAPPVDVNKNTEWFMYPGVWTTYILILFFAWLLVLSVSGCSPGAAWTTVNLGHFAITYHFFHWKKGTPFAADDQGIYNRLTWWEQIDNGQQLTRNRKFLTVVPVVLYLIASHLTDYNQPMLFLNTVAVLVLVIAKMPNMHKVRIFGINADI

SEQ ID NO: 7801 - protein, 149 aa, Rhizophora mangle
MYVRAVPATDVNRNTEWFTYPGVWTTYILILFVSWLIVLSLFGCSAGMAWTIVHLSHFLVTYHFFHWKKGTPFADDQGIYNGLTWWEQIENGKQLTRNRKFLTVVPVVLYLIASHTTDYQNPVLFFNTLAVFVLVVAKFPHMHKVRIFG

SEQ ID NO: 7802 - protein, 157 aa, Utricularia gibba
MANLYVQADPPTDLNRNTEWFMYPGVWTAYVLILLFAWLVVLSVFGCSAGVAWTIVHLFHSAVTFHFFHWKKGTPFAEDQGIYNRLTWWEQIDNGKQLTHNRKFLTVIPVLLFLIASHTTSYRSPMLVINTLAVCVLVVAKFPNMHKVRVFGINGDQ

SEQ ID NO: 7803 - protein, 157 aa, Zostera marina
MGKMYVQTTSPTDLNKNTEWFMYPGVWTTYILIVFFSWLLVLSVFGCSPGMAWTIINLSHFLVTYQFFHWKKGTPFAEDQGIYNALTWWEQMDNGKQLTTNRKFLTVVPVVLYLIGSHTTNYEQPMLLFNTLAVVILVIAKFPYMHKVRIFGINAES

SEQ ID NO: 7804 - protein, 165 aa, Theobroma cacao
MYVRAVPPTDLNRNTEWFTYPGVWTTYILILFFSWLIVLSLFGSSPGTAWTIVHLSHFFVTYHFFHWKKGTPFGDDQGIYNGLTWWEQIDNGKQLTRNRKFLTVVPVVLYLIASHTTDYQNPMLFFNTLAVFVLVVAKFPNMHKDRGVTFEFKFSVPFLMWKKEN

SEQ ID NO: 7805 - protein, 159 aa, Gnetum gnemon
MKNLRVEVTPPADLNKNTAWFQYPGVWTSYILIIFFAWLIVLSLFGCSAGMAWTIVHLVHFLVTYRFFHWKKGTPFSEDQGVYNKLTWWEQIDNGKQLTRNRKFLTVVPVVLYLITSHTTDYKNPWLFLNTVAVLVLVVAKLPNMHKVRILGINADHAI

SEQ ID NO: 7806 - protein, 159 aa, Taxus baccata
MGDLYVQVVPPPDLNKNTSWFMYPGVWTTYILILFFAWLIALCVSGCTPGTAWSLVNLCHFAVTYHFFHWKKGTPFSEDQGIYNKLTWWEQIDNGKQLTRNRKFLTVVPVVLYLIASHTTDYQNPWLFLNTIAVLVLVIAKFPNMHKVRILGINADYPM

SEQ ID NO: 7807 - protein, 161 aa, Avena sativa
MGRRGAYYVEAAPPVDVNKNTEWFMYPGVWTTYILLLFFAWLLVLSVSGCSPGAAWTAVNLGHFAITYHFFHWKKGTLFAADDQGIYNRLTWWEQIDNGQQLTRNRKFLTVVPVVLYLIASHLTDYNQPMLFLNTVAVLVLVVAKLPNMHKVRIFGINADI

SEQ ID NO: 7808 - protein, 162 aa, Pennisetum glaucum
  Sequence also found in Organisms: Setaria italica
MGRRGEPYYVEAAPPVDVNKNTEWFMYPGVWTTYILLLFFAWLLVLSVSGCSPGAAWTVVNLAHFAITYHFFHWKKGTPFAADDQGIYSRLTWWEQIDNGQQLTRNRKFLTVVPVVLYLIASHLTDYKQPMFFLNTVAVFVLVVAKLPNMHKVRIFGINADI

SEQ ID NO: 7809 - protein, 162 aa, Zea mays
MGRRGEPYYVEAVPPVDVNKNTEWFMYPGVWTTYILMLFFAWLLVLSVSGCSPGAAWTVVNLAHFAITYHFFHWKKGTPFAADDQGIYSRLTWWEQIDNGQQLTRNRKFLTVVPVVLYLIASHLTDYKQPMFFLNTIAVFVLVVAKLPNMHKVRIFGINADI

SEQ ID NO: 7810 - protein, 162 aa, Saccharum officinarum
MGRRGEPYYVEAAPPVDVNKNTEWFMYPGVWTTYILLLFFAWLLVLSVSGCSPGAAWTVVNLAHFAITYHFFHWKKGTPFAADDQGIYSRLTWWEQIDNGQQLTRNRKFLTVVPVVLYLIASHLTDYKQPMFFLNTMAVFVLVVAKLPNMHKVRIFGINADI

SEQ ID NO: 7811 - protein, 162 aa, Panicum virgatum
MGRRGEPYYVEAAPPVDVNKNTEWFMYPGVWTTYILLLFFAWLLVLSVSGCSPGAAWTVVNLAHFAITYHFFHWKKGTPFAADDQGIYSRLTWWEQIDNGQQLTRNRKFLTVVPVVLYLIASHLTDYKQPMFFLNTVAVFVLVVAKLPNMHKVRIFGINADF

SEQ ID NO: 7812 - protein, 149 aa, Euphorbia peplus
MYVKAVPPTDLNRNTEWFTYPGVWTTYMLMVFISWLIVLSLFGCSPGMAWTIVHLAHFVITYHFFHWKKGTPFGDDQGIYNGLTWWEQIENGKQLTRNRKFLTVVPVVLYLIASHTTDYQNPMLFFNTLAVFVLVVAKFPHMHKVRIFG

SEQ ID NO: 7813 - protein, 159 aa, Cephalotaxus harringtonia
MKNLYVEAVLPVDLNKNTSWFQYPGVWTTYILILFFSWLIVLSLFSCTAGMAWTIVHLAHSAVTYHFFHWKKGTPFSEDQGIYNKLTWWEQMDNGKQLTRNRKFLTAVPLVLYLIASHTTDYKYPWLFFNTVAVIVLVIAKFPNMHKVRILGINSDYPI

SEQ ID NO: 7814 - protein, 154 aa, Euonymus alatus
MYVRTVPTTDLNRNTEWFTYPAVWTTYILIVFMSWLIVLSVLGCSPGTAWTIVHLAHFLFTYTCFHWKKGTPFADDQGIYNGLTWWEQIENGKQLTPNRKFLTVVPLVLYLIASHTTDYQTPMLFFNTLAVFVLVVAKFPNMHKVRIFGINADY

SEQ ID NO: 7815 - protein, 422 aa, Sorghum bicolor
MARKKIREYDSKRLLREHLKRLAGIDLQILSAQVTQSTDFTELANQEPWLSSMKLVVKPDMLFGKRGKSGLVALNLDLAQVRQFVKERLGVEVEMGGCKAPITTFIVEPFVPHDQEYYLSIVSERLGSTISFSECGGIEIEENWDKVKTIFLPTEKQMTPDACAPLIATLPLEVRTKIGGFIRGVFSVFQDLDFSFLEMNPFTLVNGEPYPLDMRGELDDTAAFKNFNKWGDIEFPLPFGRVLSPSESFIHELDEKTSASLKFTVLNPKGRIWTMVAGGGASVIYADTVGDLGYASELGNYAEYSGAPKEEEVLQYARVLLDCATADPDGRKRALLIGGGIANFTDVAATFNGIIRALREKESKLKAARMNIYVRRGGPNYQTGLAKMRTLGTELGVPIEVYGPEATMTGICKEAIDCIMAA

SEQ ID NO: 7816 - protein, 422 aa, Setaria italica
MARKKIREYDSKRLLREHLKRLAGIDLQILSAQVTQSTDFTELANQEPWLSSMKLVVKPDMLFGKRGKSGLVALNLDLAQVRQFVKERLGVEVEMGGCKAPITTFIVEPFVPHDQEYYLSIVSERLGCTISFSECGGIEIEENWDKVKTIFLPTEKQMTPDACAPLIATLPLEVRTKIGDFIRGVFSVFQDLDFSFLEMNPFTLVNGEPYPLDMRGELDDTAAFKNFNKWGNIEFPLPFGRVLSPSESFIHELDEKTSASLKFTVLNPKGRIWTMVAGGGASVIYADTVGDLGYASELGNYAEYSGAPNEEEVLQYARVVLDCATADPDGRKRALLIGGGIANFTDVAATFSGIIRALREKESKLKAARMNIYVRRGGPNYQTGLAKMRTLGAELGVPIEVYGPEATMTGICKEAIECIMAA

SEQ ID NO: 7817 - protein, 422 aa, Pennisetum glaucum
MARKKIREYDSKRLLREHLKRLAGIDLQILSAQVTQSTDFTELANQEPWLSSMKLVVKPDMLFGKRGKSGLVALNLDLAQVRQFVKERLGVEVEMGGCKAPITTFIVEPFVPHDQEYYLSIVSERLGCTISFSECGGIEIEENWDKVKTIFLPTEKQMTPDACAPLIATLPLEVRTKIGDFIRGVFSVFQDLDFSFLEMNPFTLVNGEPYPLDMRGELDDTAAFKNFKKWGNIEFPLPFGRVLSPSESFIHELDEKTSASLKFTVLNPKGRIWTMVAGGGASVIYADTVGDLGYASELGNYAEYSGAPNEEEVLQYARVLLDCATADPDGRKRALLIGGGIANFTDVAATFSGIIRALREKESKLKAARMNIYVRRGGPNYQTGLAKMRTLGAELGVPIEVYGPEATMTGICKEAIECITAA

SEQ ID NO: 7818 - protein, 422 aa, Saccharum officinarum
MARKKIREYDSKRLLREHLKRLAGIDLQILSAQVTQSTDFTELANQEPWLSSMKLVVKPDMLFGKRGKSGLVALNLDLAQVRQFVKERLGVEVEMGGCKAPITTFIVEPFVPHDQEYYLSIVSERLGSTISFSECGGIEIEENWDKVKTIFLPTEKQMTPDACAPLIATLPLEVRTKIGAFIRGVFSVFQDLDFSFLEMNPFTLVNGEPYPLDMRGELDDTAAFKNFNKWGNIDFPLPFGRVLSPAESFIHELDEKTSASLKFTVLNPKGRIWTMVAGGGASVIYADTVGDLGYASELGNYAEYSGAPKEEEVLQYARVVLDCATADPDGRKRALLIGGGIANFTDVAATFNGIIQALREKESKLKAARMNIYVRRGGPNYQTGLAKMRTLGAELGVPIEVYGPEATMTGICKEAIDCIMAA

SEQ ID NO: 7819 - protein, 422 aa, Echinochloa colona
MARKKIREYDSKRLLREHLKRLAGIDLQILSAQVTQSTDFTELANQEPWLSSMKLVVKPDMLFGKRGKSGLVALNLDLAQVRQFVKERLGVEVEMGGCKAPITTFIVEPFVPHDQEYYLSIVSERLGCTISFSECGGIEIEENWDKVKTIFLPTEKQMTPDACAPLIATLPLEVRTKIGDFIRGVFSVFQDLDFSFLEMNPFTLVNGEPYPLDMRGELDDTAAFKNFNKWGNIEFPLPFGRVLNPSESFIHELDEKTSASLKFTVLNPKGRIWTMVAGGGASVIYADTVGDLGYASELGNYAEYSGAPNEEEVLQYARVVLDTATADPDGRKRALLIGGGIANFTDVAATFSGIIRALREKESKLKAARMNIYVRRGGPNYQTGLAKMRTLGAELGVPIEVYGPEATMTGICKEAIECIMAA

SEQ ID NO: 7820 - protein, 422 aa, Panicum virgatum
MARKKIREYDSKRLLREHLKRLAGIDLQILSAQVTQSTDFTELANQEPWLSSMKLVVKPDMLFGKRGKSGLVALNLDLAQVRQFVKERLGVEVEMGGCKAPITTFIVEPFVPHDQEYYLSIVSDRLGCTISFSECGGIEIEENWDKVKTIFLPTEKQMTPDACAPLIATLPLEVRTKIGDFIRGVFSVFQDLDFSFLEMNPFTLVNGEPYPLDMRGELDDTAAFKNFNKWGNIEFPLPFGRVLSPSESFIHELDEKTSASLKFTVLNPKGRIWTMVAGGGASVIYADTVGDLGYASELGNYAEYSGAPNEEEVLQYARVVLDCATADPDGRKRALLIGGGIANFTDVAATFSGIIRALREKESKLKAARMNIYVRRGGPNYQTGLAKMRTLGAELGVPIEVYGPEATMTGICKQAIECIMAA

SEQ ID NO: 7821 - protein, 422 aa, Cynodon dactylon
MARKKIREYDSKRLLREHLKRLAGIDLQILSAQVNQSTDFTELANQEPWLSSMKLVVKPDMLFGKRGKSGLVALNLDLAQVRQFVKERLGNEVEMGGCKAPITTFIVEPFVPHDQEYYLSIVSERLGCTISFSECGGIEIEENWDKVKTIFLPTEKQMTPDACAPLIATLPLEVRNKIGDFIRGVFSVFQDLDFSFLEMNPFTLVNGEPYPLDMRGELDDTAAFKNFKKWGNIEFPLPFGRVLSPSESFIHELDEKTSASLKFTVLNPKGRIWTMVAGGGASVIYADTVGDLGYASELGNYAEYSGAPNEEEVLQYARVVLDCATADPDGRKRALLIGGGIANFTDVAATFSGIIRALREKESKLKAARMNIYVRRGGPNYQTGLAKMRTLGAELGVPIEVYGPEATMTGICKQAIDCIMAA

SEQ ID NO: 7822 - protein, 422 aa, Panicum virgatum
MARKKIREYDSKRLLREHLKRLVGIDLQILSAQVTQSTDFTELANQEPWLSSMKLVVKPDMLFGKRGKSGLVALNLDLAQVRQFVKERLGVEVEMGGCKAPITTFIVEPFVPHDQEYYLSIVSERLGCTISFSECGGIEIEENWDKVKTIFLPTEKQMIPDACAPLIATLPLEVRTKIGDFIRGVFSVFQDLDFSFLEMNPFTLVNGEPYPLDMRGELDDTAAFKNFNKWGNIEFPLPFGRVLSPSESFIHELDEKTSASLKFTVLNPKGRIWTMVAGGGASVIYADTVGDLGYALELGNYAEYSGAPNEEEVLQYARVVLDCVTADPDGRKRALLIGGGIANFTDVAATFSGIIRALREKESKLKAARVNIYVRRGGPNYQTGLAKMRTLGAELGVPIEVYGPEATMTGICKQAIDCIMAA

SEQ ID NO: 7823 - protein, 423 aa, Oryza sativa
MARKKIREYDSKRLLREHLKRLAAIDLHILSAQVTESTDFTELVNQEPWLSSMKLVVKPDMLFGKRGKSGLVALNLDLAQVRQFVKERLGVEVEMGGCKAPITTFIVEPFVPHDQEYYLSIVSERLGSTISFSECGGIEIEENWDKVKTVFLPTEKAMTPDACAPLIATLPLEVRTKIGDFIRGVYSVFQDLDFSFLEMNPFTMVNGEPYPLDMRGELDDTAAFKNFKKWGNIQFPLPFGRVLSPSESFIHELDEKTSSSLKFTVLNPKGRIWTMVAGGGASVIYADTVGDLGYASELGNYAEYSGAPNEEEVLQYARVVLDCATADPDGRKRALLIGGGIANFTDVAATFSGIIRALREKESKLKAARMNIYVRRGGPNYQTGLAKMRTLGAELGVPIEVYGPEATMTGICKQAIDCIMAEA

SEQ ID NO: 7824 - protein, 423 aa, Avena sativa
MARKKIREYDSKRLLREHLKRLAGIDLQILSAQVTESTDFTELANQEPWLSSMKLVVKPDMLFGKRGKSGLVALNLDLAQVRQFVKERLGVEVEMGGCKAPITTFIVEPFVPHDQEYYLSIVSDRLGCTISFSECGGIEIEENWDKVKTIFLPTEKTMTLDACAPLIATLPLEVRTKIGDFIRGSFSVFQDLDFSFMEMNPFTLVNGEPYPLDMRGELDDTAAFKNFKKWGNLEFPLPFGRVMSPSESYIHELDEKTSASLKFTVLNPKGRIWTMVAGGGASVIYADTVGDLGYASELGNYAEYSGAPKEEEVLQYARVVLDCVTADPDGRKRALLIGGGIANFTDVAATFSGIIRALREKESKLKAARVNIYVRRGGPNYQTGLAKMRALGAELGLPIEVYGPEATMTGICKQAIDYVMAEA

SEQ ID NO: 7825 - protein, 423 aa, Avena sativa
MARKKIREYDSKRLLREHLKRLAGIDLQILSAQVTESTDFTELANQEPWLSSMKLVVKPDMLFGKRGKSGLVALNLDLAQVRQFVKERLGVEVEMGGCKAPITTFIVEPFVPHDQEYYLSIVSDRLGCTISFSECGGIEIEENWDKVKTIFLPTEKTMTLDACAPLIATLPLEVRTKIGDFIRGSFSVFQDLDFSFMEMNPFTLVNGEPYPLDMRGELDDTAAFKNFKKWGNLDFPLPFGRVMSPSESYIHELDEKTSASLKFTVLNPKGRIWTMVAGGGASVIYADTVGDLGYASELGNYAEYSGAPKEEEVLQYARVVLDCVTADPDGRKRALLIGGGIANFTDVAATFSGIIRALREKESKLKAARVNIYVRRGGPNYQTGLAKMRALGAELGLPIEVYGPEATMTGICKQAIDYVMAEA

SEQ ID NO: 7826 - protein, 423 aa, Hordeum vulgare
  Sequence also found in Organisms: Pseudoroegneria spicata
MARKKIREYDSKRLLKEHLKRLAGIDLQILSAQVTQSTDFTELSNQEPWLSSMKLVVKPDMLFGKRGKSGLVALNLDLAQVRQFVKERLGVEVEMGGCKAPITTFIVEPFVPHDQEYYLSIVSDRLGCTISFSECGGIEIEENWDKVKTIFLPTEKPMTLDACAPLIATLPLEVRTKIGDFIRGSFSVFQDLDFSFMEMNPFTLVNGEPYPLDMRGELDDTAAFKNFKKWGNIEFPLPFGRVLSPSESYIHELDEKTSASLKFTVLNPKGRIWTMVAGGGASVIYADTVGDLGYASELGNYAEYSGAPKEEEVLHYARVVLDCATADPDGRKRALLIGGGIANFTDVAATFSGIIRALREKESKLKAARVNIYVRRGGPNYQTGLAKMRALGSELGLPIEVYGPEATMTGICKQAIDYVMAEA

SEQ ID NO: 7827 - protein, 423 aa, Avena sativa
MARKKIREYDSKRLLREHLKRLAGIDLQILSAQVTESTDFTELANQEPWLSSMKLVVKPDMLFGKRGKSGLVALNLDLAQVRQFVKERLGVEVEMGGCKAPITTFIVEPFVPHDQEYYLSIVSDRLGCTISFSECGGIEIEENWDKVKTIFLPTEKTMTLDVCAPLIATLPLEVRTKIGDFIRGSFSVFQDLDFSFMEMNPFTLVNGEPYPLDMRGELDDTAAFKNFKKWGNLDFPLPFGRVMSPSESYIHELDEKTSASLKFTVLNPKGRIWTMVAGGGASVIYADTVGDLGYASELGNYAEYSGAPKEEEVLQYARVVLDCVTADPDGRKRALLIGGGIANFTDVAATFSGIIRALREKESKLKAARVNIYVRRGGPNYQTGLAKMRALGAELGLPIEVYGPEATMTGICKQAIDYVMAEA

SEQ ID NO: 7828 - protein, 423 aa, Brachypodium distachyon
MARKKIREYDSKRLLKEHLKRLAGIDLQILSAQVTQSTDFTELVNQEPWLSSMKLVVKPDMLFGKRGKSGLVALNLDLAQVRQFVKERLGVEVEMGGCKAPITTFIVEPFVPHDQEYYLSVVSDRLGCTISFSECGGIDIEENWDKVKTIALTTEKPMTLDACAPLIATLPLEVRTKIGDFIRGVFSVFQDLDFSFLEMNPFTLVNGEPYPLDMRGELDDTAAFKNFKKWGNIEFPLPFGRVMSPSESYIHELDEKTSASLKFTVLNPKGRIWTMVAGGGASVIYADTVGDLGYASELGNYAEYSGAPNEEEVLQYARVVLDCATADPDGRKRALLIGGGIANFTDVASTFSGIIRALREKESKLKAARMNIYVRRGGPNYQTGLAKMRALGSELGLPIEVYGPEATMTGICKQAIDCVMSEA

SEQ ID NO: 7829 - protein, 423 aa, Avena sativa
MARKKIREYDSKRLLREHLKRLAGIDLQILSAQVTESTDFTELANQEPWLSSMKLVVKPDMLFGKRGKSGLVALNLDLAQVRQFVKERLGVEVEMGGCKAPITTFIVEPFVPHDQEYYLSIVSDRLGCTISFSECGGIEIEENWDKVKTIFLPTEKTMTLDACAPLIATLPLEVRTKIGDFIRGSFSVFQDLDFSFMEMNPFTLVNGEPYPLDMRGELDDTAAFKNFKKWGNLEFPLPFGRVMSPSESYIHELDEKTSASLKFTVLNPKGRIWTMVAGGGASVIYADTVGDLGYASELGNYAEYSGAPKEEEVLQYARVLLDCVTADPDGRKRALLIGGGIANFTDVAATFSGIIRALREKESKLKAARVNIFVRRGGPNYQTGLAKMRALGSELGLPIEVYGPEATMTGICKQAIDYVMAEA

SEQ ID NO: 7830 - protein, 423 aa, Secale cereale
MARKKIREYDSKRLLKEHLKRLAGIDLQILSAQVTQSTDFTELSNQEPWLSSTKLVVKPDMLFGKRGKSGLVALNLDLAQVRQFVKERLGVEVEMGGCKAPITTFIVEPFVPHDQEYYLSIVSDRLGCTISFSECGGIEIEENWDKVKTIFLPTEKPMTLDACAPLIATLPLEVRTKIGDFIRGSFSVFQDLDFSFMEMNPFTLVNGEPYPLDMRGELDDTAAFKNFKKWGDIEFPLPFGRVLSPSESYIHELDEKTSASLKFTVLNPKGRIWTMVAGGGASVIYADTVGDLGYASELGNYAEYSGAPKEEEVLHYARVVLDCATADPDGRKRALLIGGGIANFTDVAATFSGIIRALREKESKLKAARVNIYVRRGGPNYQTGLAKMRALGSELGLPIEVYGPEATMTGICKQAIDCVMAEA

SEQ ID NO: 7831 - protein, 423 aa, Triticum aestivum
MARKKIREYDSKRLLKEHLKRLAGIDLQILSAQVTQSTDFTELSNQEPWLSSMKLVVKPDMLFGKRGKSGLVALNLDLAQVRQFVKERLGVEVEMGGCKAPITTFIVEPFVPHDQEYYLSIMSDRLGCTISFSECGGIEIEENWDKVKTIFLPTEKPMTLDACAPLIATLPLEVRTKIGDFIRGSFSVFQDLDFSFMEMNPFTLVNGEPYPLDMRGELDDTAAFKNFKKWGDIEFPLPFGRVLSPSESYIHELDEKTSASLKFTVLNPKGRIWTMVAGGGASVIYADTVGDLGYASELGNYAEYSGAPKEEEVLHYARVVLDCATADPDGRKRALLIGGGIANFTDVAATFSGIIRALREKESKLKAARVNIYVRRGGPNYQTGLAKMRALGSELGLPIEVYGPEATMTGICKQAIDCVMAEA

SEQ ID NO: 7832 - protein, 423 aa, Secale cereale
MARKKIREYDSKRLLKEHLKRLAGIDLQILSVQVTQSTDFTELSNQEPWLSSTKLVVKPDMLFGKRGKSGLVALNLDLAQVRQFVKERLGVEVEMGGCKAPITTFIVEPFVPHDQEYYLSIVSDRLGCTISFSECGGIEIEENWDKVKTIFLPTEKPMTLDACAPLIATLPLEVRTKIGDFIRGSFSVFQDLDFSFMEMNPFTLVNGEPYPLDMRGELDDTAAFKNFKKWGDIEFPLPFGRVLSPSESYIHELDEKTSASLKFTVLNPKGRIWTMVAGGGASVIYADTVGDLGYASELGNYAEYSGAPKEEEVLHYARVVLDCATADPDGRKRALLIGGGIANFTDVAATFSGIIRALREKESKLKAARVNIYVRRGGPNYQTGLAKMRALGSELGLPIEVYGPEATMTGICKQAIDCVMAEA

SEQ ID NO: 7833 - protein, 423 aa, Leymus cinereus x Leymus triticoides
MARKKIREYDSKRLLKEHLKRLAGIDLQILSAQVTQSTDFTELSNHEPWLSSMKLVVKPDMLFGKRGKSGLVALNLDLAQVRQFVKERFGVEVEMGGCKAPITTFIVEPFVPHDQEYYLSVVSDRLGCTISFSECGGIEIEENWDKVKTIFLPTEKSMTLDACAPLIATLPLEVRTKIGDFIRGSFSVFQDLDFSFMEMNPFTLVNGEPYPLDMRGELDDTAAFKNFKKWRNIDFPLPFGRVLSPSESYIHELDEKTSASLKFTVLNPKGRIWTMVAGGGASVIYADTVGDLGYASELGNYAEYSGAPNEEEVLHYARVVLDCATADPDGRKRALLIGGGIANFTDVAATFSGIIRALREKESKLKAARVNIYVRRGGPNYQTGLAKMRALGSELGLPIEVYGPEATMTGICKQAIDCVMAEA

SEQ ID NO: 7834 - protein, 423 aa, Lolium multiflorum
MARKKIREYDSKRLLREHLKRLAAIDLHILSAQVTESTDFTELANQEPWLSSMKLVVKPDMLFGKRGKSGLVALNLDLAQVRQFVKERLGVEVEMGGCKAPITTFIVEPFVPHEQEYYLSIVSDRLGCTISFSECGGIEIEENWDKVKTITLPTEKTMTLDACAPLIATLPLEVRTKIGDFIRGSFSVFQDLDFSFMEMNPFTLVNGEPYPLDMRGELDDTAAFKNFKKWGNLEFPLPFGRVMSPSESYIHELDEKTSASLKFTVLNPKGRIWTMVAGGGASVIYADTVGDLGYAAELGNYAEYSGAPKEEEVLQYARVVLDCVTADPDGRKRALLIGGGIANFTDVAATFSGIIRALREKESKLKAARVNIYVRRGGPNYQTGLAKMRALGSELGLPIEVYGPEATMTGICKQAIDYVMAEA

SEQ ID NO: 7835 - protein, 423 aa, Festuca arundinacea
MARKKIREYDSKRLLREHLKRLAAIDLHILSAQVTESTDFTELANQEPWLSSMKLVVKPDMLFGKRGKSGLVALNLDLAQVRQFVKERLGVEVEMGGCKAPITTFIVEPFVPHEQEYYLSIVSDRLGCTISFSECGGIEIEENWDKVKTITLPTEKTMTLDACAPLIATLPLEVRMKIGDFIRGSFSVFQDLDFSFMEMNPFTLVNGEPYPLDMRGELDDTAAFKNFKKWGNLEFPLPFGRVMSPSESYIHELDEKTSASLKFTVLNPKGRIWTMVAGGGASVIYADTVGDLGYAAELGNYAEYSGAPKEEEVLQYARVVLDCVTADPDGRKRALLIGGGIANFTDVAATFSGIIRALREKESKLKAARVNIYVRRGGPNYQTGLAKMRALGSELGLPIEVYGPEATMTGICKQAIDYVMAEA

SEQ ID NO: 7836 - protein, 423 aa, Oryza sativa
MARKKIREYDSKRLLKEHLKRLAGIDLQILSAQVTQSTDFTELVNQQPWLSTMKLVVKPDMLFGKRGKSGLVALNLDIAQVKEFVKERLGVEVEMGGCKAPITTFIVEPFVPHDQEYYLSIVSERLGSTISFSECGGIEIEENWDKVKTIFLPTEKPMTPDACAPLIATLPLEARGKIGDFIKGVFAVFQDLDFSFLEMNPFTIVNGEPYPLDMRGELDDTAAFKNFKKWGNIEFPLPFGRVLSSTEGFIHDLDEKTSASLKFTVLNPKGRIWTMVAGGGASVIYADTVGDLGYASELGNYAEYSGAPNEEEVLQYARVVLDCATADPDGRKRALLIGGGIANFTDVGATFSGIIRALREKESKLKAARMHIYVRRGGPNYQTGLAKMRKLGAELGVPIEVYGPEATMTGICKQAIECVMAAA

SEQ ID NO: 7837 - protein, 423 aa, Festuca arundinacea
MARKKIREYDSKRLLREHLKRLAGIDLQILSAQVTEATDFTELANQEPWLSSTKLVVKPDMLFGKRGKSGLVALNLDLAQVRQFVKERLGVEVEMGGCKAPITTFIVEPFVPHEQEYYLSIVSDRLGCTISFSECGGIEIEENWDKVKTISLPTEKTMTLDACAPLIATLPLEVRTKIGDFIRGAFSVFQDLDFSFMEMNPFTLVNGEPYPLDMRGELDDTAAFKNFKKWGNLEFPLPFGRVMSPSESYIHELDEKTSASLKFTVLNPKGRIWTMVAGGGASVIYADTVGDLGYAAELGNYAEYSGAPKEEEVLQYARVVLDCVTADPDGRKRALLIGGGIANFTDVAATFSGIIRALREKESKLKAARVNIYVRRGGPNHQTGLAKMRALGSELGLPIEVHGPEATMTGICKQAIDYVMAEA

SEQ ID NO: 7838 - protein, 75 aa, Festuca arundinacea
MARKKIREYDSKRLLREHLKRLAAIDLHILSAQVTESTDFTELANQEPWLSSMKLVVKPDMLFGKRGKSGRGPST

SEQ ID NO: 7839 - protein, 423 aa, Elaeis guineensis
MARKKIREYDSKRLLREHLKRLAAIDLQICSAQVTESTDFAELVNKEPWLSSMKLVVKPDMLFGKRGKSGLVALKLDMAQVAQFVKERLGVEVEMGGCKAPITTFIVEPFVPHDQEYYLSIVSERLGCTISFSECGGIEIEENWDKVKTIFLPTEKPMTSEACAPLIATLPLEVRGKIGDFIKGVFAVFQDLDFTFLEMNPFTLVNGEPYPLDMRGELDDTAAFKNFKKWGNIEFPLPFGRVLSPTESFIHELDEKTSASLKFTVLNPKGRIWTMVAGGGASVIYADTVGDLGYASELGNYAEYSGAPNADEVLQYARVVLDCATADPDGRKRALLIGGGIANFTDVAATFSGIIRALKEKESKLKAARMHIFVRRGGPNYQTGLAKMRALGDELGIPLEVYGPEATMTGICKQAIDCIMSAA

SEQ ID NO: 7840 - protein, 422 aa, Olea europaea
MARKKIREYDSKRLLKEHLKRLANIDLQIRSAQVTQTTDFAELTNKEPWLSSTKLVVKPDMLFGKRGKSGLVALNLDLAQVAEFVKERLGVEVEMGGCKAPITTFIVEPFVPHNQEYYLSIVSERLGSTISFSECGGIEIEENWDKVKTIFLPTEKQMTIEACAPLIATLPLEVRGKIGDFIMGVVSVFQDLDFSFLEMNPFTLVNGEPYALDMRGELDDTAAFKNFKKWGAIEFPLPFGRVLSPTENFIHSLDEKTSASLKFTVLNPKGRIWTMVAGGGASVIYADTVGDLGYASELGNYAEYSGAPNEEEVLQYARVVIDCATADPDGRKRALLIGGGIANFTDVATTFNGIIRALKEKESKLKAARMHLYVRRGGPNYQTGLAKMRTLGEELGVPIEVYGPEATMTGICKQAIDCIMST

SEQ ID NO: 7841 - protein, 423 aa, Orobanche aegyptiaca
MARKKIREYDSKRLLKEHLKRLSGIDLQICSAQVTQSTDFTELTNKEPWLSSTKLVVKPDMLFGKRGKSGLVALNLDLAQVAGFVKERLGVEVEMGGCKAPITTFIVEPFVPHDQEYYLSIVSERLGCTISFSECGGIEIEENWDKVKTIFLPTEKPMNLEACAPLIATLPLEVRGKIGDFILGVFAVFQDLDFSFLEMNPFTLVNGEPYPLDMRGELDDTAAFKNFKKWGDIEFPLPFGRVLSPTESFIHSLDEKTSASLKFTVLNPKGRIWTMVAGGGASVIYADTVGDLGYASELGNYAEYSGAPNEEEVLQYARVVIDCATSDPDGRKRALLIGGGIANFTDVAATFNGIIRALKEKEAKLKAARMHLYVRRGGPNYQTGLARMRALGEELGVPIDVYGPEATMTGICKQAIDCIMSAA

SEQ ID NO: 7842 - protein, 423 aa, Saccharum officinarum
MARKKIREYDSKRLLKEHLKRLAGIDLTILSAQITQSTDFAELLSQQPWLSTMKLVVKPDMLFGKRGKSGLVALNLDFDQVKEFVKERLGVEVEMGGCKAPITTFIVEPFVPHDQEYYLSIVSERLGSTISFSECGGIEIEENWDKVKTIFLPTEKPMTPDSCAPLIATLPLEARGKIGDFIKGVFAVFQDLDFSFLEMNPFTMVNGEPYPLDMRGELDDTAAFKNFKKWGGIEFPLPFGRVLSPTESFIHELDEKTSASLKFTVLNPKGRIWTMVAGGGASVIYADTVGDLGYASELGNYAEYSGAPNEEEVLNYARVVLDCATADPDGRKRALLIGGGIANFTDVAATFNGIIRALREKESKLKASRMHIYVRRGGPNYQSGLAKMRKLGAELGVPIEVYGPEATMTGICKQAIQCIMAAA

SEQ ID NO: 7843 - protein, 423 aa, Aristolochia fimbriata
MARKKIREYDSKRLLKEHLKRLAGINLEICSAQVTESTDFTELANQEPWLSANRLVVKPDMLFGKRGKSGLVALNLDLAQVAQFVKERLGVEVEMGGCKAPITTFIIEPFVPHDQEYYLSIVSDRLGSTISFSECGGIEIEENWDKVKTISLPTEKPMTSEACAPLIATLPLEVRGKIGDFIKGVFAVFQDLDFSFLEMNPFTLVNGEPYPLDMRGELDDTAAFKNFKKWGNIMFPLPFGRVLSPSENFIHSLDEKTSASLKFTVLNPKGRIWTMVAGGGASVIYADTVGDLGYASELGNYAEYSGAPNEEEVLQYARVVIDCATANPDGRKRALLIGGGIANFTDVAATFNGIIRALREKESKLKAARMHIYVRRGGPNYQTGLTKMRALGEELGVPLEVYGPEATMTGICKQAIDCIMSAD

SEQ ID NO: 7844 - protein, 423 aa, Manihot esculenta
MARKKIREYDSKRLLKEHLKRLANIDLQICSAQVTESTDFTELTNQEPWLSSSKLVVKPDMLFGKRGKSGLVALNLDLAQVAEFVKGRLGVEVEMGGCKAPITTFIVEPFVPHDQEFYLSIVSERLGSTISFSECGGIEIEENWDKVKTIFLPTEKPMTLEACAPLIATLPLEIRSKIGGFITGIFAVFQDLDFTFLEMNPFTLVNGEPYPLDMRGELDDTAAFKNFKKWGNIEFPLPFGRVLSPTESFIHSLDEKTSASLKFTVLNPKGRIWTMVAGGGASVIYADTVGDLGYASELGNYAEYSGAPNEEEVLQYARVVIDCSTADPDGRKRALLIGGGIANFTDVAATFNGIIRALREKESKLKAARMHIYVRRGGPNYQTGLAKMRSLGQELGVPLEVYGPEATMTGICKQAIDCIMSTA

SEQ ID NO: 7845 - protein, 423 aa, Cocos nucifera
MARKKIREYDSKRLLREHLKRLAAIDLQICSAQVTESTDFTELVNKEPWLSSMKLVVKPDMLFGKRGKSGLVALKLDMAQAAQFVKERLGVEVEMGGCKAPITTFIVEPFVPHDQEYYLSIVSERLGCTISFSECGGIEIEENWDKVKTIFLPTDKPMMSEACAPLIATLPLEVRGKIGDFIKGVFAVFQDLDFTFLEMNPFTLVNGEPYPLDMRGELDDTAAFKNFKMWGNIEFPLPFGRVLSPTESFIHELDEKTSASLKFTVLNPRGRIWTMVAGGGASVIYADTVGDLGYASELGNYAEYSGAPNADEVLQYARVVLDCATADPDGRKRALLIGGGIANFTDVAATFSGIIRALREKESKLKAARMHIFVRRGGPNYQTGLAKMRALGDELGIPLEVYGPEATMTGICKQAIDCIMSAA

SEQ ID NO: 7846 - protein, 421 aa, Ocimum basilicum
MARKKIREYDSKRLLKEHLKRLSGIDLQIRSAQVTESTDFAELTNKEPWLSSTRLVVKPDMLFGKRGKSGLVALNLDLAQVAAFVKERLGVEVEMGGCKAPITTFIVEPFVPHDQEYYLSIVSERLGNTISFSECGGIEIEENWDKVKTVFLPTEKSMNLEACAPLIATLPLEVRGKIGEFINGVFSVFQDLDFSFLEMNPFTLVNGEPYPLDMRGELDDTAAFKNFKKWGDIEFPLPFGRVLSPTESFIHSLDEKTSASLKFTVLNPKGRIWTMVAGGGASVIYADTVGDLGYASELGNYAEYSGAPNEEEVLQYARVVLDCATADPDGRKRALLIGGGIANFTDVAATFNGIIRALKEKESKLKAARMHLFVRRGGPNYQTGLARMRALGEALGVPIEVYGPEATMTGICKQAIDCIMS

SEQ ID NO: 7847 - protein, 423 aa, Zea mays
MARKKIREYDSKRLLREHLKRLAGIDLTILSAQITQSTDFAELVSQQPWLSTMKLVVKPDMLFGKRGKSGLVALNLDFDQVKEFVKERLGVEVEMGGCKAPITTFIVEPFVPHDQEYYLSIVSERLGSTISFSECGGIEIEENWDKVKTIFLPTEKPMTSDSCAPLIATLPLEARGKIGDFIKGVFAVFLDLDFSFLEMNPFTMVNGEPYPLDMRGELDDTAAFKNFKKWGGIEFPLPFGRVLSPTESFIHELDEKTSASLKFTVLNPKGRIWTMVAGGGASVIYADTVGDLGYASELGNYAEYSGAPNEEEVLNYSRVVLDCATADPDGRKRALLIGGGIANFTDVATTFNGIIRALREKESKLKASRMHIYVRRGGPNYQSGLAKMRKLGAELGVPIEVYGPEATMTGICKQAIECIMAAA

SEQ ID NO: 7848 - protein, 423 aa, Mimulus guttatus
MARKKIREYDSKRLLKEHLKRLSGIDLQICSAQVDQSTDFTELTNKEPWLSSTKLVVKPDMLFGKRGKSGLVALNLDLAQVAAFVKERLGVEVEMGGCKAPITTFIVEPFVPHDEEYYLSIVSERLGCTISFSECGGIEIEENWDKVKTIFLPTEKPMNLEACAPLIATLPLEVRGKIGDFIMAVFSVFQDLDFSFLEMNPFTLVNGEPYPLDMRGELDDTAAFKNFKKWGDIEFPLPFGRVLSATEGFIHTLDEKTSASLKFTVLNQKGRIWTMVAGGGASVIYADTVGDLGYASELGNYAEYSGAPNEEEVLQYARVVIDCATADPDGRKRALLIGGGIANFTDVAATFNGIIRALKEKESKLKAARMHLYVRRGGPNYQTGLARMRALGEELGVPIEVYGPEATMTGICKEAIDCIMSEA

SEQ ID NO: 7849 - protein, 423 aa, Sorghum bicolor
MARKKIREYDSKRLLREHLKRLAGIDLTILSAQITQSTDFAELVSQQPWLSTMKLVVKPDMLFGKRGKSGLVALNLDFDQVKEFVKERLGVEIEMGGCKAPITTFIVEPFVPHDQEYYLSIVSERLGSTISFSECGGIEIEENWDKVKTIFLPTEKPMTPDSCAPLIATLPLEARGKIGDFIKGVFAVFQDLDFSFLEMNPFTMVNGEPYPLDMRGELDDTAAFKNFKKWGDIEFPLPFGRVLSSTESFIHELDEKTSASLKFTVLNPKGRIWTMVAGGGASVIYADTVGDLGYASELGNYAEYSGAPNEEEVLNYARVVLDCATADPDGRKRALLIGGGIANFTDVAATFNGIIRALREKESKLKASRMHIYVRRGGPNYQSGLAKMRKLGAELGVPIEVYGPEETMTGICKQAIECIMAAA

SEQ ID NO: 7850 - protein, 423 aa, Saccharum officinarum
MARKKIREYDSKRLLREHLKRLAGIDLTILSAQITQSTDFAELVSQQPWLSTMKLVVKPDMLFGKRGKSGLVALNLDFDQVKEFVKERLGVEVEMGGCKAPITTFIVEPFVPHDQEYYLSIVSERLGSTISFSECGGIEIEENWDKVRMIFLPTEKPMTSDSCAPLIATLPLEARGKIGDFIKGVFAVFQDLDFSFLEMNPFTMVNGEPYPLDMRGELDDTAAFKNFKKWGGIEFPLPFGRVLSPTESFIHELDEKTSASLKFTVLNPKGRIWTMVAGGGASVIYADTVGDLGYASELGNYAEYSGAPNEEEVLNYARVVLDCATADPDGRKRALLIGGGIANFTDVAATFNGIIRALREKESKLKASRMHIYVRRGGPNYQSGLAKMRKLGAELGVPIEVYGPEATMTGICKQAIECIMAAA

SEQ ID NO: 7851 - protein, 423 aa, Allium cepa
MARKKIREYDSKRLLKEHLKRLAGIELQIQSAQVTESTDFTELVNKEPWLSSTKLVVKPDMLFGKRGKSGLVALNLDLAQVSEFVKERLGVEVEMSGCKAPITTFIVEPFVPHDEEYYLNIVSERLGCTISFSECGGIDIEENWDKVKTIFLPSEKPMTSDACAPLIATLPLEVKEKLGNFIQAVFSVFQDVDMSFLEMNPFTLVNGEPYPLDMRGELDDTAAFKNFKKWGNIEFPLPFGRVLSPTESFIHGLDEKTSASLKFTVLNPKGRIWTMVAGGGASVIYADTVGDLGYANELGNYAEYSGAPNEDEVLQYARVVLDCATSDPDGRKRALLIGGGIANFTDVAATFSGIIRALREKESKIKASRMHIYVRRGGPNYQTGLAKMRALGDELGVPLEVYGPEATMTGICKEAINCIMAEA

SEQ ID NO: 7852 - protein, 423 aa, Panax ginseng
MARKKIREYDSKRLLKEHLKRLAAIDLQIYSAQVTESTDFTELTNKEPWLSSAKLVVKPDMLFGKRGKSGLVALNLDLAQVAQFVKGRLGVEVEMGGCKAPITTFIIEPFIPHDQEYYLSIVSERLGCTISFSECGGIEIEENWDKVKTVFLPTEKPMTLEACAPLIATLPLEVRPKIGDFIMGVFSVFKDLDFSFLEMNPFTLVNGEPYPLDMRGELDDTAAFKNFKKWGKIEFPLPFGRVMSPTESFIHSLDDKTSASLKFTVLNPKGRIWTMVAGGGASVIYADTVGDLGYASELGNYAEYSGAPNEEEVLQYARVVIDCATADPDGRKRALLIGGGIANFTDVAATFNGIIRALREKESKLKASRMHIYVRRGGPNYQTGLAKMRTLGEELGVPLEVYGPEATMTGICKQAIECVMAAA

SEQ ID NO: 7853 - protein, 423 aa, Platanus occidentalis
MARKKIREYDSKRLLKEHLKRLAGIQLEICSVQVTESTDFTELKNREPWLSTTKLVVKPDMLFGKRGKSGLVALNLDLAQVAKFVKERLGVEVEMGGCKAPITTFIVEPFVPHHQEYYLSIVSERLGSTISFSECGGIEIEENWDKVKTIFLPSEKPMTSEACAPLIATLPLEVRGKIGDFIKGVFSVFQDLDFSFLEMNPFTLVNGEPYPLDMRGELDDTAAFKNFKKWGSIEFPLPFGRVLSPTESFIHSLDEKTSASLKFTVLNPKGRIWTMVAGGGASVIYADTVGDLGYASELGNYAEYSGAPNEEEVLQYARVVIDCATVDPDGRKRALLIGGGIANFTDVAATFNGIIRALREKESKLKASRMHIYVRRGGPNYQTGLAKMRTIGEELGVPLEVYGPEATMTGICKQAIECIMSAA

SEQ ID NO: 7854 - protein, 423 aa, Solanum lycopersicum
MARKKIREYDSKRLLREHLKRLAGIDLQICSAQVTESTDFTELTNKEPWLSSTKLVVKPDMLFGKRGKSGLVALNLDLAGVAEFVKTRLGVEVEMGGCKAPITTFIVEPFVPHDQEYYLSIVSERLGCTISFSECGGIEIEENWDKVKTIFLPTEKPMTLEACAPLIATLPLEVRGKIGNFLMGVFDVFQDLDFSFIEMNPFTLVNGEPYPLDMRGELDDTAAFKNFKKWGSIEFPLPFGRVLSPTESFIHSLDEKTSASLKFTVLNPKGRIWTMVAGGGASVIYADTVGDLGYASELGNYAEYSGAPNEEEVLQYARVVLDCATANPDGRKRALIVGGGIANFTDVAATFNGIIRALREKEAKLKAARMHIYVRRGGPNYQTGLAKMRALGEELGVPLEVYGPEATMTGICKGAIDCIMSEA

SEQ ID NO: 7855 - protein, 423 aa, Triphysaria pusilla
MARKKIREYDSKRLLKEHLKRLTGIDLQICSAQVTESTDFSDLTNKEAWLSSTKLVVKPDMLFGKRGKSGLVALNLDLAQVAGFVKERLGVEVEMGGCKAPITTFIVEPFVPHDQEYYLSIVSERLGCTISFSECGGIEIEENWDKVKTIFLPTEKPMNLDACAPLIATLPLEVRSKIGDFIMGVFSVFQDLDFSFIEMNPFTLVNGEPYPLDMRGELDDTAAFKNFKKWGSIEFPQPFGRVMSPTESFIHSLDEKTSASLKFTVLNPKGRIWTMVAGGGASVIYADTVGDLGYASELGNYAEYSGAPNEEEVLQYARIVIDCATSDPDGRKRALLIGGGIANFTDVAATFNGIIRALREKESKLKAARMNLYVRRGGPNYQTGLARMRTLGEELGLPIEVYGPEATMTGICKQAIDCIISAA

SEQ ID NO: 7856 - protein, 423 aa, Citrullus lanatus
MARKKIREYDSKRLLKEHLKRLANIDLQICSAQVNQSTDFAELTNNEPWLSSTKLVVKPDMLFGKRGKSGLVALNLDLAQVAEFVKTRLGVQVEMGGCKAPITTFIVEPFVPHDQEYYLSIVSERLGCTISFSECGGIEIEENWDKVKTIFLPTEKPFTLEACAPLIATLPLEIRGKIGDFIMGVFSVFQDLDFSFLEMNPFTLVNGEPYPLDMRGELDDTAAFKNFKKWGNIEFPLPFGRVLNPTESFVHSLDEKTSASLKFTVLNPKGRIWTMVAGGGASVIYADTVGDLGYASELGNYAEYSGAPNEEEVLQYARVVIDCATSDPDGRKRALLIGGGIANFTDVAATFNGIIRALREKESKLKAARMHIYVRRGGPNYQTGLAKMRALGEELGVPLEVFGPEATMTGICKQAIECIMSAA

SEQ ID NO: 7857 - protein, 153 aa, Amorphophallus konjac
MARKKIREYDSKRLLKEHLKRLAGIDIQICSAQVTESTDFTELTNNEPWLSSTRLVVKPDMLFGKRGKSGLVALNLDLAQVSQFVKERLGVEVEMGGCKAPITTFIVEPFVPHNQEFYLSIVSERLGSTISFSECGGIEIEENWDKVKTVFSN

SEQ ID NO: 7858 - protein, 101 aa, Triphysaria pusilla
MARKKIREYDSKRLLKEHLKRLTGIDLQICSAQVTESTDFSDLTNKEAWLSSTKLVVKPDMLFGKRGKSGLVALNLDLAQVAGFVKEVLALRLRWEVAKHR

SEQ ID NO: 7859 - protein, 423 aa, Musa acuminata
MARKKIREYDSKRLLKEHLKRLAGIDLQIRSVQVTESTDFNELVNKEPWLSSMKLVVKPDMLFGKRGKSGLVALNLDLAQAAQFVKERLGVEVEMGGCKAPITTFIIEPFVPHDQEYYLSIVSERLGCTVSFSECGGIEIEENWDKVKTVYLPTEKPMTGEACAPLIATLPLEVRGKIGDFIKGVFTVFQDLDFSFIEMNPFTLVNGEPYPLDMRGELDDTAAFKNFKKWGGIDFPLPFGRVLSPTEKFVHELDEKTSASLKFTVLNPKGRIWTMVAGGGASVIYADTVGDLGYASELGNYAEYSGAPNEEEVLQYARVVLDCATADPDGRKRALLIGGGIANFTDVAATFNGIIRALKEKESKLKAARMHIYVRRGGPNYQTGLAKMRKVGEELGVPLEVYGPEATMTGICKEAIDCVMSAA

SEQ ID NO: 7860 - protein, 423 aa, Ricinus communis
MARKKIREYDSKRLLKEHLKRLAGLDIQICSAQVTESTDFTELTNQEPWLSSSRLVVKPDMLFGKRGKSGLVALNLDLAQVAEFVKARLGVEVEMSGCKAPITTFIVEPFVPHDQEFYLSIVSERLGCTISFSECGGIEIEENWDKVKTVFLPTEKPMNLEACAPLIATLPLEIRGKIGAFIMGVFAVFQDLDFSFIEMNPFTLVNGEPYPLDMRGELDDTAAFKNFKKWGNIEFPLPFGRVLSPTESFIHSLDEKTSASLKFTVLNPKGRIWTMVAGGGASVIYADTVGDLGYASELGNYAEYSGAPNEEEVLQYARVVIDCATADPDGRKRALLIGGGIANFTDVAATFNGIIRALREKESKLKAARMHIYVRRGGPNYQTGLAKMRTLGEEVGVPLEVYGPEATMTGICKQAIDCIMSAA

SEQ ID NO: 7861 - protein, 423 aa, Avena sativa
MARKKIREYDSKRLLKEHLKRLAAIDLHILSAQVTESTDFTELVNEQPWLSSTKLVVKPDMLFGKRGKSGLVALNLDIAQVKEFVKERLGVEVEMGGCKAPITTFIVEPFVPHDQEYYLSIVSERLGSTISFSECGGIEIEENWDKVKTVFLPTEKPMTPETCAPLIATLPLEARGKIGDFIKGVFAVFQDLDFSFIEMNPFTMVNGEPYPLDMRGELDDTAAFKNFKKWGNLEFPLPFGRVLSSTESFIQDLDDKTSASLKFTVLNPKGRIWTMVAGGGASVIYADTVGDLGYASELGNYAEYSGAPKEEEVLQYARVVLDCATSDPDGRKRALLIGGGIANFTDVAATFNGIIRALREKESKLKASRMHLYVRRGGPNYQTGLAKMRKLGAEIGVPIEVYGPEATMTGICKQAIECIMAAA

SEQ ID NO: 7862 - protein, 423 aa, Brachypodium distachyon
MARKKIREYDSKRLLREHLKRLAAIDLQILSAQVTQSTDFEELVNQYPWLSTMKLVVKPDMLFGKRGKSGLVALNLDIVQVKEFVKERLGVEVEMGGCKAPITTFIVEPFVPHDQEYYLSIVSERLGSTISFSECGGIEIEENWDKVKTVFLPTEKPMAPDACAPLIATLPLEARGKISDFIKGVFAVFQDLDFSFIEMNPFTMVNGEPYPLDMRGELDDTASFKNFKKWGNVEFPLPFGRVLSSTESFIHDLDDKTSASLKFTVLNPKGRIWTMVAGGGASVIYADTVGDLGYASELGNYAEYSGAPNEEEVLQYARVVLDCATADPDGRKRALLIGGGIANFTDVAATFSGIIRALREKESKLKASRMHLYVRRGGPNYRTGLAKMRKLGAEIGVPIEVYGPEATMTGICKQAIECIMAAA

SEQ ID NO: 7863 - protein, 423 aa, Brachypodium distachyon
MARKKIREYDSKRLLREHLKRLAAIDLQILSAQVTQSTDFEELVNQYPWLSTMKLVVKPDMLFGKRGKSGLVALNLDIVQVKEFVKERLGVEVEMGGCKAPITTFIVEPFVPHDQEYYLSIVSERLGSTISFSECGGIEIEENWDKVKTVFLPTEKPMAPDACAPLIATLPLEARGKISDFIQGVFAVFQDLDFSFIEMNPFTMVNGEPYPLDMRGELDDTASFKNFKKWGNVEFPLPFGRVLSSTESFIHDLDDKTSASLKFTVLNPKGRIWTMVAGGGASVIYADTVGDLGYASELGNYAEYSGAPNEEEVLQYARVVLDCATADPDGRKRALLIGGGIANFTDVAATFSGIIRALREKESKLKASRMHLYVRRGGPNYRTGLAKMRKLGAEIGVPIEVYGPEATMTGICKQAIECIMAAA

SEQ ID NO: 7864 - protein, 423 aa, Setaria italica
MARKKIREYDSKRLLKENLKRLAGIDLTILSAQITQSTDFAELLSQQPWLSTTKLVVKPDMLFGKRGKSGLVALNLDFDQVKEFVKERLGVEVEMGGCKAPITTFIVEPFVPHDQEYYLSIVSERLGSTISFSECGGIEIEENWDKVKTVFLPTEKPMTQDACAPLIATLPLEARGKIGDFIKGVFAVFQDLDFSFLEMNPFTMVNGEPYPLDMRGELDDTAAFKNFKKWGAIEFPLPFGRVLSATESFIHELDEKTSASLKFTVLNPKGRIWTMVAGGGASVIYADTVGDLGYASELGNYAEYSGAPNEEEVLHYARVVLDCATADPDGRKRALLIGGGIANFTDVAATFNGIIRALREKESKLKASRMHIYVRRGGPNYQTGLAKMRKLGAELGVPIEVYGPEATMTGICKQAIECVMAAA

SEQ ID NO: 7865 - protein, 421 aa, Ipomoea nil
MARKKIREYDSKRVLKEHLKRLSGIDLQICSAQVTESTDFAELTNKEPWLSSTKLVVKPDMLFGKRGKSGLVALKLDLAEVAEFVKARLGVEVEMGGCKAPITTFIVEPFVPHAEEYYLSIVSERLGCTISFSECGGIEIEENWDKVKTVFLPTEKPMTLEVCAPLIATLPLEVRGKIGNFILGVFSVFQDLDFSFLEMNPFTLVNGEPYPLDMRGELDDTAAFKNFQKWGNIEFPLPFGRVLSPTESFIHSLDEKTSASLKFTVLNPKGRIWTMVAGGGASVIYADTVGDLGYASELGNYAEYSGAPNEEEVLQYARVVLDCATADPDGRKRALIIGGGIANFTDVAATFNGIIRALREKESKLKAARMNIYVRRGGPNYQTGLAKMRALGEELGVPLEVYGPEATMTGICKRAIDCVMS

SEQ ID NO: 7866 - protein, 423 aa, Populus trichocarpa
MARKKIREYDSKRLLKEHLKRLSGIDLQICSAQVTEGTDFTELTNKEPWLSSTKLVVKPDMLFGKRGKSGLVALNLDLAQVAEFVKARLGAEVEMGGCKAPITTFIVEPFVPHDQEFYISIVSERLGSTISFSECGGIEIEENWDKVKTIFLPTEKPMTLEACAPLIATLPLEIRGKIGDFIIGVFSVFQDLDFSFLEMNPFTLVNGEPYPLDMRGELDDTAAFKNFKKWGNVEFPLPFGRVLSSTESFIHSLDEKTSSSLKFTVLNPKGRIWTMVAGGGASVIYADTVGDLGYASELGNYAEYSGAPNEDEVLQYARVVIDCATSDPDGRKRALLIGGGIANFTDVAATFNGIIRALREKESKLKAARMHIYVRRGGPNYQTGLAKMRTLGEELGVPLEVYGPEATMTGICKQAIDCIMSTA

SEQ ID NO: 7867 - protein, 423 aa, Panicum virgatum
MARKKIREYDSKRLLKENLKRLAGIDLTILSAQITQSTDFAELVSQQPWLSTTKLVVKPDMLFGKRGKSGLVALNLDFDQVKEFVKERLGVEVEMGGCKAPITTFIVEPFVPHDQEYYLSIVSERLGSTISFSECGGIEIEENWDKVKTVFLPTEKPMTPDACAPLIATLPLEARGKIGDFIEGVFAVFQDLDFSFMEMNPFTMVNGEPYPLDMRGELDDTAAFKNFKKWGAIEFPLPFGRVLSPTESFIHELDEKTSASLKFTVLNPKGRIWTMVAGGGASVIYADTVGDLGYASELGNYAEYSGAPNEEEVLHYARVVLDCATADPDGRKRALLIGGGIANFTDVAATFNGIIRALREKESKLKASRMHIYVRRGGPNYQSGLAKMRKLGAELGIPIEVYGPEATMTGICKQAIECIMAAA

SEQ ID NO: 7868 - protein, 423 aa, Avena sativa
MARKKIREYDSKRLLKEHLKRLAAIDLHILSAQVTESTDFTELVNEQPWLSSTKLVVKPDMLFGKRGKSGLVALNLDIAQVKEFVKERLGVEVEMGGCKAPITTFIVEPFVPHDQEYYLSIMSERLGSTISFSECGGIEIEENWDKVKTVFLPTEKPMTPETCAPLIATLPLEARGKIGDFIKGVFAVFQDLDFSFIEMNPFTMVNGEPYPLDMRGELDDTAAFKNFKKWGNLEFPLPFGRVLSSTESFIQDLDDKTSASLKFTVLNPKGRIWTMVAGGGASVIYADTVGDLGYASELGNYAEYSGAPKEEEVLQYARVVLDCATSDPDGRKRALLIGGGIANFTDVAATFNGIIRALREKESKLKASRMHLYVRRGGPNYQTGLAKMRKLGAEIGVPIEVYGPEATMTGICKQAIECIMAAA

SEQ ID NO: 7869 - protein, 422 aa, Hordeum vulgare
MARKKIREYDSKRLLKEHLKRLAAIDLHILSAQVTQSTDFAELVNQHPWLSTTKLVVKPDMLFGKRGKSGLVALNLDVAQVKEFVKDRLGVEVEMGVCKAPITTFIVEPFVPHDQEYYLSIVSERLGSTISFSECGGIEIEENWDKVKTVFLPTEKPMTPDACAPLIATLPLEARGKIGDFIKGVFAVFQDLDFSFIEMNPFTMVNEEPYPLDMRGELDDTASFKNFKKWGNVEFPLPFGRVLSSTESFIHELDDKTSASLKFTVLNTKGRIWTMVAGGGASVIYADTVGDLGYASELGNYAEYSGAPNEEEVLQYARVVLDCATADPDGRKRALLIGGGIANFTDVAATFSGIIRALREKESKLKASRMYLYVRRGGPNYQTGLAKMRKLGAEIGVPIEVYGPEATMTGICKQAIECIMAA

SEQ ID NO: 7870 - protein, 423 aa, Gossypium hirsutum
MARKKIREYDSKRLLKQHLKRLANIDLQICSAQVTQSTDFTELTNEQPWLSSTRLVVKPDMLFGKRGKSGLVALNLDLAQVAEFVKARLGTEVEMGGCKAPITTFIVEPFVPHEQEYYLSIVSERLGSTISFSECGGIDIEENWDKVKTIFLPTEKPMTLDTCAPLIATLPLEVRGKIGDFIMGVFSVFQDLDFSFLEMNPFTLVNGEPYPLDMRGELDDTAAFKNFNKWGNIEFPLPFGRVLSSTESFIHSLDEKTSASLKFTVLNPKGRIWTMVAGGGASVIYADTVGDLGYASELGNYAEYSGAPNEEEVLQYARVVIDCATANPDGRKRALLIGGGIANFTDVAATFNGIIRALREKEAKLKAARMHIYVRRGGPNYQTGLARMRALGEELGVPLEVYGPEATMTGICKQAIDCIMSEA

SEQ ID NO: 7871 - protein, 423 aa, Actinidia deliciosa
MARKKIREYDSKRLLKEHLKRLAAIDLQICSAQVNENTDFTELTNKEPWLSSTKLVVKPDMLFGKRGKSGLVALNLDLAAVAEFVKARLGVEVEMGGCKAPITTFIVEPFVPHDQEYYLSIVSERLGSTISFSECGGIEIEENWDKVKTIFLPSEKPMSLEACAPLIATLPLEVRGKIADFILGVFAVFQDLDFSFLEMNPFTLVNGEPYPLDMRGELDDTAAFKNFKKWSNIEFPLPFGRVLSPTESFIHSLDEKTSASLKFTVLNPKGRIWTMVAGGGASVIYADTVGDLGYASELGNYAEYSGAPNEEEVLQYARVVIDCATADPDGRKRALLIGGGIANFTDVAATFNGIIRALREKESKLKASRMHIYVRRGGPNYQTGLAKMRALGEELGVPLEVYGPEATMTGICKEAIDCIMSSA

SEQ ID NO: 7872 - protein, 423 aa, Pennisetum glaucum
MARKKIREYDSKRLLKENLKRLAGIDLTILSAQITESTDFAELVSQQPWLLTTKLVVKPDMLFGKRGKSGLVALNLDFDQVKEFVKERLGVEVEMGGCKAPITTFIVEPFVPHDQEYYLSIVSERLGSTISFSECGGIEIEENWDKVKTVFLPTEKPMTQDACAPLIATLPLEARGKIGEFIKGVFAVFQDLDFSFLEMNPFTMVNGEPYPLDMRGELDDTAAFKNFKKWGAIEFPLPFGRVLSASESFIHELDEKTSASLKFTVLNPKGRIWTMVAGGGASVIYADTVGDLGYASELGNYAEYSGAPNEEEVLHYARVVLDCATADPDGRKRALLIGGGIANFTDVAATFNGIIRALREKESKLKASRMHIYVRRGGPNYQTGLAKMRKLGAELGVPIEVYGPEATMTGICKQAIECVMAAA

SEQ ID NO: 7873 - protein, 423 aa, Carica papaya
MARKKIREYDSKKLLKEHLKRLAGIDLQICSAQVTQSTDFTELTNQEPWLSSTRLVVKPDMLFGKRGKSGMVALNLDLAQVAEFVKSRLGVEVEMGGCKAPITTFIVEPFVPHDQEYYLSIISERLGCTISFSECGGIEIEENWDKVKTVFLPTEKPMTLEACAPLIATLPLEVRGKIGDFIMGVFAVFQDLDFSFIEMNPFTLVHGEPYPLDMRGELDDTAAFKNFKKWGNIEFPLPFGRVLSPTESFIHSLDEKTSASLKFTVLNPKGRIWTMVAGGGASVIYADTVGDLGYASELGNYAEYSGAPNEEEVLQYARVVIDCATADPDGRKRALLIGGGIANFTDVATTFNGIIRALKEKEAKLKAARMHIYVRRGGPNYQIGLARMRALGEELGIPLEVYGPEATMTGICKNAIDCIMAAA

SEQ ID NO: 7874 - protein, 423 aa, Cajanus cajan
MARKKIREYHSKRLLKEHLKRLASIDIQILSAQVTESTDFTELTNEHPWLSSTKLVVKPDMLFGKRGKSGLVALNLDIAQVAEFVKARLGVEVEMGGCKAPITTFIVEPFVPHDQEYYLSVVSERLGSTISFSECGGIEIEENWDKVKTIFLPTEKPLTPEACAPLIATLPLEIRGKIGHFIMGVFAVFQDLDFSFLEMNPFTLVNEKPYPLDMRGELDDTAAFKNFNKWGNIEFPLPFGRVLSPTESFIHSLDDKTSASLKFTVLNPKGRIWTMVAGGGASVIYADTVGDLGYASELGNYAEYSGAPNEEEVLQYARVVIDCATADPDGRKRALLIGGGIANFTDVAATFSGIIRALKEKESKLKAARMHIYVRRGGPNYQTGLAKMRALGEELGVPIQVYGPEATMTGICKQAIDCIMSKA

SEQ ID NO: 7875 - protein, 423 aa, Populus trichocarpa
MARKKIREYDSKRLLKEHLKRLSGIDLLIRSAQVTEGTDFTELTNQEPWISSTKLVVKPDMLFGKRGKSGLVALNLDLAQVADFVKARLGVEVEMGGCKAPITTFIVEPFVPHDQEFYFSIVSERLGCTISFSECGGIEIEENWDKVKTIFLPTEKPMTLEACAPLIATLPLEIRGKIGDFIIGVFSVFQDLDFSFLEMNPFTLVNGEPYPLDMRGELDDTAAFKNFKKWGNIEFPLPFGRVLSSTESFIHSLDEKTSASLKFTVLNQKGRIWTMVAGGGASVIYADTVGDLGYASELGNYAEYSGAPNEEEVLQYARVVIDCATADPDGRKRALLIGGGIANFTDVAATFNGIIRALREKESKLKAARMHLYVRRGGPNYQTGLAKMRTLGEELGVPLEVYGPEATMTSICKQAIDCIMSTA

SEQ ID NO: 7876 - protein, 423 aa, Solanum phureja
MARKKIREYDSKRLLKEHLKRLAGIDLQICSAQVTESTDFTELTNKEPWLSSTKLVVKPDMLFGKRGKSGLVALNLDLAGVAEFVKTRLGVEVEMGGCKAPITTFIVEPFIPHDQEYYLSIVSERLGCTISFSECGGIEIEENWDKVKTIFLPTEKPMTLEACAPLIATLPLEVRGKIGNFLMGVFDVFQDLDFSFIEMNPFTLVNGEPYPLDMRGELDDTAAFKNFKKWGSIEFPLPFGRVLSPTESFIHSLDEKTSASLKFTVLNPKGRIWTMVAGGGASVIYADTVGDLGYASELGNYAEYSGAPNEEEVLQYARVVLDCATANPDGRKRALIVGGGIANFTDVAATFNGIIRALREKEAKLKAARMHIYVRRGGPNYQTGLAKMRALGEELGVPLEVYGPEATMTGICKGAIDCIMSEA

SEQ ID NO: 7877 - protein, 423 aa, Panicum virgatum
MARKKIREYDSKRLLKENLKRLAGIDLTILSAQITQSTDFAELVSQQPWLSTTKLVVKPDMLFGKRGKSGLVALNLDFDQVKEFVKERLGVEIEMGGCKAPITTFIVEPFVPHDQEYYLSIVSERLGSTISFSECGGIEIEENWDKVKTVFLPTEKPMTPDACAPLIATLPLEARGKIGDFIKGVFAVFQDLDFSFMEMNPFTMVNGEPYPLDMRGELDDTAAFKNFKKWGAIEFPLPFGRVLSPTESFIHELDEKTSASLKFTVLNPKGRIWTMVAGGGASVIYADTVGDLGYASELGNYAEYSGAPNEEEVLHYARVVLDCATADPDGRKRALLIGGGIANFTDVAATFNGIIRALREKESKLKASRMHIYVRRGGPNYQSGLAKMRKLGAELGIPIEVYGPEATMTGICKQAIECIMAAA

SEQ ID NO: 7878 - protein, 423 aa, Triphysaria pusilla
MARKKIREYDSKRLLKEHLKRLTGLDLQICSAQVTESTDFSDLTNKEAWLSSTKLVVKPDMLFGKRGKSGLVALNLDLAQVAGFVKERLGVEVEMGGCKAPITTFIVEPFVPHDQEYYLSIVSERLGCTISFSECGGIEIEENWDKVKTVFLPTEKPMNLDACAPLIATLPLEVRSKIGDFIMGVFSVFQDLDFSFIEMNPFTLVNGEPYPLDMRGELDDTAAFKNFKKWGGIEFPQPFGRVMSPTESFIHSLDEKTSASLKFTVLNPKGRIWTMVAGGGASVIYADTVGDLGYASELGNYAEYSGAPNEEEVLQYARIVIDCATSDPDGRKRALLIGGGIANFTDVAATFNGIIRALREKESKLKAARMNLYVRRGGPNYQTGLARMRTLGEELGLPIEVYGPEATMTGICKQAIDCIISAA

SEQ ID NO: 7879 - protein, 423 aa, Triphysaria pusilla
MARKKIREYDSKRLLKEHLKRLTGLDLQICSAQVTESTDFSDLTNKEAWLSSTKLVVKPDMLFGKRGKSGLVALNLDLAQVAGFVKERLGVEVEMGGCKAPITTFIVEPFVPHDQEYYLSIVSERLGCTISFSECGGIEIEDNWDKVKTIFLPTEKPMNLDACAPLIATLPLEVRSKIGDFIMGVFSVFQDLDFSFIEMNPFTLVNGEPYPLDMRGELDDTAAFKNFKKWGGIEFPQPFGRVMSPTESFIHSLDEKTSASLKFTVLNPKGRIWTMVAGGGASVIYADTVGDLGYASELGNYAEYSGAPNEEEVLQYARIVIDCATSDPDGRKRALLIGGGIANFTDVAATFNGIIRALREKESKLKAARMNLYVRRGGPNYQTGLARMRTLGEELGLPIEVYGPEATMTGICKQAIDCIISAA

SEQ ID NO: 7880 - protein, 423 aa, Echinochloa colona
MARKKIREYDSKRLLKENLKRLAGIDLAILSAQITQSTDFAELVSQQPWLLTTKLVVKPDMLFGKRGKSGLVALNLDFDQVKEFVKQRLGVEVEMGGCKAPITTFIVEPFVPHDQEYYLSIVSERLGSTISFSECGGIEIEENWDKVKTIFLPTEKPMTQDACAPLIATLPLEARGKIGDFIKGVFAVFQDLDFSFLEMNPFTMVNGEPYPLDMRGELDDTAAFKNFKKWGAIEFPLPFGRVLSATESFIHELDEKTSASLKFTVLNPKGRIWTMVAGGGASVIYADTVGDLGYASELGNYAEYSGAPNEEEVLHYARVVLDCATADPDGRKRALLIGGGIANFTDVAATFNGIIRALREKESKLKASRMHIYVRRGGPNYQSGLAKMRKLGAELGVPIEVYGPEATMTGICKQAIECVMAAA

SEQ ID NO: 7881 - protein, 423 aa, Allium cepa
MARKKIREYDSKRILKEHLKRIANIDLQIRSAQVTQSTDFTELVDKEQWLSSMKLVVKPDMLFGKRGKSGLVALNLDMAQVAQFVKQRLGVEVEMGGCKAPITTFIVEPFVPHDQEYYLSIVSERLGCTISFSECGGIEIEENWDKVKTIFLPTEKSMTTEACAPLIATLPLEIRGKIGDFIKGVFAVFQDLDFTFLEMNPFTLVNGEPYPLDMRGELDDTAAFKNFIKWGDIEFPLPFGRVLSPTERYIHGLDEKTSASLKFTVLNPKGRIWTMVAGGGASVIYADTVGDLGYASELGNYAEYSGAPNEEEVLQYARVVLDCATADPDGHKRALLIGGGIANFTDVAATFNGIIKALREKESKLKASRMNIFVRRGGPNYQTGLAKMRALGEELGVPLEVYGPEATMTGICKQAIDCIMSAA

SEQ ID NO: 7882 - protein, 423 aa, Musa acuminata
MARKKIREYDSKRLLKQHLKRLAAIDLQLCSAQVTQSTDFTELVNQEPWLSSMKLVVKPDMLFGKRGKSGLVSLNLDLAEVAEFVKKRFGVEVEMGGCKAPITTFIVEPFVPHDQEYYLSIVSERLGCSISFSECGGIEIEDNWDKVKTIFLPTEKPMTSEACAPLIATLPLEVRGKIGDFIRGVFAVFQDLDFSFIEMNPFTFVNGEPYPLDMRGELDDTAAFKNFNKWGNIEFPLPFGRVLSPAESYIHELDEKTSASLKFTILNPKGRIWTMVAGGGASVIYADTVGDLGYALELGNYAEYSGAPNEEEVLQYARVVLDCATADPDGRKRALLIGGGIANFTDVATTFNGIIRALREKEAKLKAARVHIYVRRGGPNYQTGLAKMRSLGDEIGIPLEVYGPEATMTGICKQAIDCIMSAA

SEQ ID NO: 7883 - protein, 423 aa, Panax ginseng
MARKKIREYDSKRLLKEHLKRLAAIDLQIYSAQVTESTHFTELTNKEPWLSSAKLVVKPDMLFGKRGKSGLVALNLDLAQVAQFVKGRLGVEVEMGGCKAPITTFIIEPFIPHDQEYYLSIVSERLGCTISFSECGGIEIEENWDKVKTVFLPTEKPMTLEACAPLIATLPLEVRPKIGDFIMGVFSVFKDLDFSFLEMNPFTLVNGEPYPLDMRGELDDTAAFKNFKKWGKIEFPLPFGRVMSPTESFIHSLDDKTSASLKFTVLNPKGRIWTMVAGGGASVIYADTVGDLGYASELGNYAEYSGAPNEEEVLQYARVVIDCATADPDGRKKALLIGGGIANFTDVAATFNGIIRALREKESKLKASRMHIYVRRGGPNYQTGLAKMRALGEELGVPLEVYGPEATMTGICKQAIECVMAAA

SEQ ID NO: 7884 - protein, 423 aa, Nicotiana tabacum
MARKKIREYDSKRLLKEHLKRLAGIDLQICSAQVTESTDFTELTNKEPWLSSTKLVVKPDMLFGKRGKSGLVALNLDLAAVAEFVKARLGVEVEMGGCKAPITTFIVEPFVPHDQEYYLSIVSERLGCTISFSECGGIEIEENWDKVKTIFLPTEKPMTLEACAPLIATLPLEVRGTIGNFLMGVFNVFQDLDFSFIEMNPFTLVNGDPYPLDMRGELDDTAAFKNFKKWGSIEFPLPFGRVLSPTESFIHSLDEKTSASLKFTVLNPKGRIWTMVAGGGASVIYADTVGDLGYASELGNYAEYSGAPNEEEVLQYARVVLDCATANPDGRKRALIVGGGIANFTDVAATFNGIIRALREKEAKLKAARMHIYVRRGGPNYQTGLAKMRALGEELGVPLEVYGPEATMTGICKRAIDCIMSEA

SEQ ID NO: 7885 - protein, 423 aa, Triticum aestivum
MARKKIREYDSKRLLKEHLKRLAGIDLHILSAQVTQSTDFAELVNQHPWLSTTKLVVKPDMLFGKRGKSGLVALNLDVAQVKEFVKERLGVEVEMGGCKAPITTFIVEPFVPHDQEYYLSVVSERLGSTISFSECGGIEIEENWDKVKTVFLPTEKPMTPDACAPLIATLPLEARGKIGDFIKGVFAVFQDLDFSFIEMNPFTMVNGEPYPLDMRGELDDTASFKNFKKWGNLEFPLPFGRVLSSTESFIHELDDKTSASLKFTVLNPKGRIWTMVAGGGASVIYADTVGDLGYASELGNYAEYSGAPNQEEVLQYARVVLDCVTADPDGRKRALLIGGGIANFTDVAATFSGIIQALREKESKLKASRMHLYVRRGGPNYQTGLAKMRKLGAEIGVPIEVYGPEETMTGICKQAIECIMAAS

SEQ ID NO: 7886 - protein, 204 aa, Panax ginseng
MARKKIREYDSKRLLKEHLKRLAAIDLQIYSAQVTESTHFTELTNKEPWLSSAKLVVKPDMLFGKRGKSGLVALNLDLAQVAQFVKGRLGVEVEMGGCKAPITTFIIEPFIPHDQEYYLSIVSERLGCTISFSECGGIEIEENWDKVKTVFLPTEKPMTLEACAPLIATLPLEVRPKIGDFIMGVFSVFKDLDFSFLEMNPLLW

SEQ ID NO: 7887 - protein, 84 aa, Avena sativa
MARKKIREYDSKRLPKEHLKRLAAIDLHILSAQVTESTDFTELVNEQPWLSSTKLVVKPDMLFGKRGKSGLVALNLDIAQARSL

SEQ ID NO: 7888 - protein, 196 aa, Solanum tuberosum
MARKKIREYDSKRLLKEHLKRLAGIDLQICSAQVTESTDFTELTNKEPWLSSTKLVVKPDMLFGKRGKSGLVALNLDLAGVAEFVKTRLGVEVEMGGCKAPITTFIVEPFIPHDQEYYLSIVSERLGCTISFSECGGIEIEENWDKVKTIFLPTEKPMTLEACAPLIATLPLEVRGKIGNFLMGVFDVFQISILVS

SEQ ID NO: 7889 - protein, 423 aa, Musa acuminata
MARKKIREYDSKRLLKQHLKRLAAIDLQLCSAQVTQSTDFTELVNQEPWLSSMKLVVKPDMLFGKRGKSGMVSLNLDLAEVAEFVKKRFGVEVEMGGCKAPITTFIVEPFVPHDQEYYLSIVSERLGCSISFSECGGIEIEDNWDKVKTIFLPTEKPMTSEACAPLIATLPLEVRGKIGDFIRGVFAVFQDLDFSFIEMNPFTFVNGEPYPLDMRGELDDTAAFKNFNKWGNIEFPLPFGRVLSPAESYIHELDEKTSASLKFTILNPKGRIWTMVAGGGASVIYADTVGDLGYALELGNYAEYSGAPNEEEVLQYARVVLDCATADPDGRKRALLIGGGIANFTDVATTFNGIIRALREKEAKLKAARVHIYVRRGGPNYQTGLAKMRSLGDEIGIPLEVYGPEATMTGICKQAIDCIMSAA

SEQ ID NO: 7890 - protein, 363 aa, Castanea mollissima
MLFGKRGKSGLVALNLDLAQVAEFVKARLGVEVEMGGCKAPITTFIVEPFVPHDQEYYLSIVSERLGCTISFSECGGIEIEENWDKVKTIFLPSEKPITLEACAPLIATLPLEVRGKIGDFIIGVFKVFQDLDFSFIEMNPFTLVNGEPYPLDMRGELDDTAAFKNFKKWGNIEFPLPFGRVLNPTESFIHSLDEKTSSSLKFTVLNPKGRIWTMVAGGGASVIYADTVGDLGYAQELGNYAEYSGAPNEDEVLQYARVVIDCATADPDGRKRALLIGGGIANFTDVAATFNGIIRALKEKESKLKAARMHIYVRRGGPNYQTGLAKMRALGEELGLPIEVYGPEATMTGICKQAIDCVMAAA

SEQ ID NO: 7891 - protein, 389 aa, Echinochloa colona
VMQSTDFTELANQEPWLSSMKLVVKPDMLFGKRGKSGLVALNLDLAQVRQFVKERLGVEVEMGGCKAPITTFIVEPFVPHDQEYYLSIVSERLGCTISFSECGGIEIEENWDKVKTIFLPTEKQMTPDACAPLIATLPLEVRTKIGDFIRGVFSVFQDLDFSFLEMNPFTLVNGEPYPLDMRGELDDTAAFKNFQKWGNIEFPLPFGRVLSPSESFIHELDEKTSSSLKFTVLNPKGRIWTMVAGGGASVIYADTVGDLGYASELGNYAEYSGAPNEEEVLQYARVVLDTATADPDGRKRALLIGGGIANFTDVAATFSGIIRALREKESKLKAARMNIYVRRGGPNYQTGLAKMRTLGAELGVPIEVYGPEATMTGICKEAIECIMAA

SEQ ID NO: 7892 - protein, 423 aa, Amsonia hubrichtii
MARKKIREYDSKRLLKEHLKRLAGIDLQICSAQVNEATDFAELTNKEPWLSSTKLVVKPDMLFGKRGKSGLVALNLDLAQVAEFVKARLGVEVDMGGCRAPITTFIVEPFVPHDQEYYLNIVSDRLGCSISFSECGGIEIEENWDKVKTIFLPTEKPMTLEACAPLIATLPLEVRGKIGDFIMGVFAVFQDLDFSFLEMNPFTLVNGEPFPLDMRGELDDTAAFKNFKKWSNIEFPLPFGRVLSPTESFIHTLDEKTSASLKFTVLNPKGRIWTMVAGGGASVIYADTVGDLGYASELGNYAEYSGAPNEEEVLQYARVVIDCATANPDGRKRALLIGGGIANFTDVAATFNGIIRALREKESKLKASRMNIYVRRGGPNYQTGLAKMRALGEELGVPIEVYGPEATMTGICKQAIDCIMSTA

SEQ ID NO: 7893 - protein, 423 aa, Fagus grandifolia
MARKKIREYDSKRLLKEHLKRLANIDLQINSAQVTEATDFTELTNQEPWLSSTRLVVKPDMLFGKRGKSGLVSLNLDLAQVAEFVKARLGVEVEMGGCKAPITTFIVEPFVPHDQEYYLSIVSERLGSTISFSECGGIEIEENWDKVKTIFLPTEKAMTLEVCAPLIATLPLEVRGKIADFIIGVFRVFQDLDFSFIEMNPFTLVNGEPYPLDMRGELDDTAAFKNFKTWGNIEFPLPFGRVLSPTENFVHSLDEKTSASLKFTVLNPKGRIWTMVAGGGASVIYADTVGDLGYAQELGNYAEYSGAPNEEEVLQYARVVIDCATADPDGRKRALLIGGGIANFTDVAATFNGIIRALKEKESKLKAARMHIYVRRGGPNYQTGLAKMRALGEELGIPIEVYGPEATMTGICKQAIDCVMAAA

SEQ ID NO: 7894 - protein, 423 aa, Theobroma cacao
MARKKIREYDSKRLLKEHLKRLANIHLQICSAQVTESTDFTELTNKEPWLSSTRLVVKPDMLFGKRGKSGLVALNLDLAQVAEFVKARLGVEVEMGGCKAPITTFIVEPFVPHEQEYYLSIVSERLGSIISFSECGGIEIEENWDKVKTIFLPTEKPMTQETCAPLIATLPLEVRGKIGDFIMGVFSVFQDLDFSFLEMNPFTLVNGEPYPLDMRGELDDTAAFKNFKKWGDIEFPLPFGRVMSPTEGFIHSLDEKTSASLKFTVLNPKGRIWTMVAGGGASVIYADTVGDLGYASELGNYAEYSGAPNEEEVLQYARVVVDCATANPDGRKRALLIGGGIANFTDVAATFNGIIRALREKEAKLKAARMHVYVRRGGPNYQTGLARMRTLGEELGVPLEVYGPEATMTGICKEAIDCIMSEA

SEQ ID NO: 7895 - protein, 423 aa, Cucumis sativus
MARKKIREYDSKRLLKEHLKRLANIDLQICSAQVNQSTDFAELTNNEPWLSSTRLVVKPDMLFGKRGKSGLVALNLDLAQVAEFVKQRLGVQVEMGGCKAPITTFIVEPFVPHDQEYYLSIVSERLGCEISFSECGGIEIEENWDKVKTIFLPTEKPFTLEACAPLIATLPLEIRGKIGDFIMGVFNVFQDLDFSFLEMNPFTLVNGEPYPLDMRGELDDTAAFKNFKKWGNIEFPLPFGRVLSSTESFVHSLDEKTSASLKFTVLNPKGRIWTMVAGGGASVIYADTVGDLGYASELGNYAEYSGAPNEEEVLQYARVVIDCATSDPDGRKRALLIGGGIANFTDVAATFNGIIRALREKESKLKAARMHIYVRRGGPNYQTGLSKMRALGEELGVPLEVFGPEATMTGICKQAIECIMSAA

SEQ ID NO: 7896 - protein, 423 aa, Eucalyptus grandis
MARKKIREYDSKRLLKQHLKRLANIDLPIRSAQVTESTDFGELVNKETWLSSTKLVVKPDMLFGKRGKSGLVALNLDMAQVAQFVKERLGVEVEMGGCRAPVTTFIVEPFVPHDQEYYLSIVSDRLGCTISFSECGGIEIEENWDKVKTISLPTEKPLTSETCAPLIATLPLEVRGKIGDFIKGVFSVFQDLDFSFLEMNPFTLVDGEPYPLDMRGELDDTAAFKNFNKWGDIEFPLPFGRVLSPTESFIHSLDEKTSASLKFTVLNPKGRIWTMVAGGGASVIYADTVGDLGYASELGNYAEYSGAPNEEEVLQYARVVIDCATANPDGRKRALLIGGGIANFTDVAATFNGIIRALREKESKLKAARMHIYVRRGGPNYQTGLAKMRALGEELGVPLEVYGPEATMTGICKEAIECIMAES

SEQ ID NO: 7897 - protein, 423 aa, Panax ginseng
MARKKIREYDSKRLLKEHLKRLAAIDLQIYSAQVTESTDFTELTNKEPWLSSAKLVVKPDMLFGKRGKSGLVALNLDLAQVAQFVKGRLGVEVEMGGCKAPITTFIIEPFIPHDQEYYLSIVSERLGCTISFSECGGIEIEENWDKVKTVFLPTEKPMTLEACAPLIATLPLEVRPKIGDFIMGVFSVFKDLDFSFLEMNPFTLVNGKPYPLDMRGELDDTAAFKNFKNWGKIEFPLPFGRVMSPTESFIHSLDDKTSASLKFTVLNPKGRIWTMVAGGGASVIYADTVGDLGYASELGNYAEYSGAPNEEEVLQYARVVIDCATADPDGHKRALLIGGGIANFTDVAATFNGIIRALREKESKLKASRMHIYVRRGGPNYQTGLAKMRALGEELGVPLEVYGPEATMTGICKQAIECVMAAA

SEQ ID NO: 7898 - protein, 423 aa, Cannabis sativa
MARKKIREYDSKRLLKEHLKRLAAIDLQISSAQVNEATDFTELTNQQPWLSSTRLVVKPDMLFGKRGKSGLVALNLDLAQVAEFVKARLGKEVEMGGCKAPITTFIVEPFVPHNQEYYLSIVSDRLGSTISFSECGGIEIEENWDKVKTIFLPTEKSLTLESCAPLIATLPLEVRGKIGDFLMGVFAVFQDLDFSFLEMNPFTLVNGEPYPLDMRGELDDTAAFKNFQKWGNIEFPLPFGRVMSPTESFIHSLDEKTSASLKFTVLNPKGRIWTMVAGGGASVIYADTVGDLGYASELGNYAEYSGAPNEDEVLQYARVVIDCATADPDGRKRALLIGGGIANFTDVAATFNGIIRALREKESKLKAARMHIYVRRGGPNYQTGLAKMRALGEELGVPLEVYGPEATMTGICKEAIDCIMSTA

SEQ ID NO: 7899 - protein, 423 aa, Castanea mollissima
MARKKIREYDSKRLVKEHLKRLANIDLQIHSAQVTEATDFTELTNQEPWLSSTRLVVKPDMLFGKRGKSGLVALNLDLAQVAEFVKARLGVEVEMGGCKAPITTFIVEPFVPHDQEYYLSIVSERLGCTISFSECGGIEIEENWDKVKTIFLPSEKPITLEACAPLIATLPLEVRGKIGDFLIGVFKVFQDLDFSFIEMNPFTLVNGEPYPLDMRGELDDTAAFKNFKKWGNIEFPLPFGRVLNPTESFIHSLDEKTSSSLKFTVLNPKGRIWTMVAGGGASVIYADTVGDLGYAQELGNYAEYSGAPNEDEVLQYARVVIDCATADPDGRKRALLIGGGIANFTDVAATFNGIIRALKEKESKLKAARMHIYVRRGGPNYQTGLAKMRALGEELGLPIEVYGPEATMTGICKQAIDCVMAAA

SEQ ID NO: 7900 - protein, 423 aa, Festuca arundinacea
MARKKIREYDSKRLLKEHLKRLAAIDLHILSAQITESTDFTELVNQQPWLSTMKLVVKPDMLFGKRGKSGLVALNLDIAQVKEFVKERLGVEVEMGGCKAPITTFIVEPFVPHDQEYYLSVVSERLGSTISFSECGGIEIEENWDKVKTVFLPTEKPMTPETCAPLIATLPLEARGKIGDFIKGVFAVFQDLDFSFIEMNPFTMVNGEPYPLDMRGELDDTASFKNFKKWGDLEFPLPFGRVLSSTESFIQDLDDKTSASLKFTVLNPKGRIWTMVAGGGASVIYADTVGDLGYASELGNYAEYSGAPKEEEVLQYARVVLDCATADPDGRKRALLIGGGIANFTDVAATFNGIIRALREKESKLKASRMHLYVRRGGPNYQTGLAKMRKLGAEIGVPIEVYGPEATMTGICKQAIECIMAAA

SEQ ID NO: 7901 - protein, 423 aa, Gossypium raimondii
MARKKIREYDSKRLLKQHLKRLANIDLQICSAQVTQSTDFTELTNEQPWLSSTRLVVKPDMLFGKRGKSGLVALNLDLAQVAEFVKARLGTEVEMGGCKAPITTFIVEPFVPHEQEYYLSIVSERLGFTISFSECGGIDIEENWDKVKTIFLPTEKPMTLDTCAPLIATLPLEVRGKIGDFIMGVFSVFQDLDFSFLEMNPFTLVNGEPYPLDMRGELDDTAAFKNFNKWGNIEFPLPFGRVLSSTESFIHSLDEKTSASLKFTVLNPKGRIWTMVAGGGASVIYADTVGDLGYASELGNYAEYSGAPNEEEVLQYARVVIDCATANPDGRKRALLIGGGIANFTDVAATFNGIIRALREKEAKLKAARMHIFARRGGPNYQTGLARMRALGEELGVPLEVYGPEATMTGICKQAIDCILSEA

SEQ ID NO: 7902 - protein, 423 aa, Cucumis melo
MARKKIREYDSKRLLKEHLKRLANIDLQICSAQINQSTDFAELTNNEPWLSSTRLVVKPDMLFGKRGKSGLVALNLDLAQVAEFVKQRLGVQVEMGGCKAPITTFIVEPFVPHDQEYYLSIVSERLGCTISFSECGGIEIEENWDKVKTIFLPTEKTFTLEACAPLIATLPLEIRGKIGDFIMGVFNVFQDLDFSFLEMNPFTLVNGEPYPLDMIGELDDTAAFKNFKKWGNIEFPLPFGRVLNPTESFVHSLDEKTSASLKFTVLNPKGRIWTMVAGGGASVIYADTVGDLGYASELGNYAEYSGAPNEEEVLQYARVVIDCATSDPDGRKRALLIGGGIANFTDVAATFNGIIRALREKESKLKAARMHIYVRRGGPNYQTGLTKMRALGEELGVPLEVFGPEATMTGICKQAIECIMSAA

SEQ ID NO: 7903 - protein, 423 aa, Nicotiana benthamiana
MARKKIREYDSKRLLKEHLKRLAGIDLQICSAQVTESTDFTELTNKEPWLSSTKLVVKPDMLFGKRGKSGLVALNLDLAAVAEFVKARLGVEVEMGGCKAPITTFIVEPFVPHDQEYYLSIVSERLGCTISFSECGGVEIEENWDKVKTIFLPTEKPMTLKACAPLIATLPLEVRGTIGNFLMGVFNVFQDLDFSFIEMNPFALVNGDPYPLDMRGELDDTAAFKNFKKWGSIEFPLPFGRVLSPTESFIHSLDEKTSASLKFTVLNPKGRIWTMVAGGGASVIYADTVGDLGYASELGNYAEYSGAPNEEEVLQYARVVLDCATANPDGRKRALIVGGGIANFTDVAATFNGIIRALREKEAKLKAARMHIYVRRGGPNYQTGLAKMRALGEELGVPLEVYGPEATMTGICKRAIDCIMSEA

SEQ ID NO: 7904 - protein, 423 aa, Citrus sinensis
MARKKIREYDSKRLLKEHLKRLAGLDLQICSAQVTESTDFSELTNKEPWLSSSRLVVKPDMLFGKRGKSGLVALNLDLAQVAEFVKGRLGTEVEMGGCKGPITTFIVEPFVPHNQEYYLSIVSDRLGCTISFSECGGIEIEENWDKVKTIFLPTEKHMTLDACAPLIATLPLEFRGKIGDFIMGVFAVFQDLDFSFIEMNPFTLVNGEPYPLDMRGELDDTAAFKNFKKWANIEFPLPFGRVLSSTESFIHSLDEKTSASLKFTVLNPKGRIWTMVAGGGASVIYADTVGDLGYASELGNYAEYSGAPNEEEVLQYARVVIDCATADPDGRKRALLIGGGIANFTDVATTFNGIIRALREKESKLKAARMHIFVRRGGPNYQTGLAKMRALGEELGIPLEVYGPEATMTGICKQAIDCIMSAS

SEQ ID NO: 7905 - protein, 423 aa, Phalaenopsis aphrodite
MARKKIREYDSKRLLKEHLKQLAGIELQISSAQVTEATDFTELTDREPWLSSNRLVVKPDMLFGKRGKSGLVALNLDLAQVAQFVKGRLGTEVEMGGCKAPITTFIVEPFVPHEQEYYFSIVSERLGCTLSFSECGGIEIEENWEKVKTVFLPTEKSMTYEVCAPLIATLPLEIRGKIGNFIKGVFDVFQDLDFSFLEMNPFTLVNGEPYPLDMRGELDDTAAFKNFKKWGDIEFPLPFGRVLSPTESFIHSLDEKTSASLKFTVLNPKGRIWTMVAGGGASVIYADTVGDLGYASELGNYAEYSGAPKEDEVLQYARVVLDCATSDPDGRKRALLIGGGIANFTDVAATFNGIIRALREKESKLKAARMHIYVRRGGPNYQTGLAKMRALGDELGVPLEVYGPEATMTGICKRAIDCVMSAA

SEQ ID NO: 7906 - protein, 423 aa, Secale cereale
MARKKIREYDSKRLLKEHLKRLAGINLHILSAQVTKSTDFAELVNQHPWLSTTKLVVKPDMLFGKRGKSGLVALNLDVAQVKEFVKERLGVEVEMGGCKAPITTFIVEPFVPHDQEYYLSVVSERLGSTISFSECGGIEIEENWDKVKTVFIPTEKPMTPDACAPLIATLPLEARGKIGDFIKGVFAVFQDLDFSFIEMNPFTMVNGEPYPLDMRGELDDTASFKNFKKWGNVEFPLPFGRVLSSTESFIHELDDKTSASLKFTVLNPKGRIWTMVAGGGASVIYADTVGDLGYASELGNYAEYSGAPNEEEVLQYARVVLDCATADPDGRKRALLIGGGIANFTDVAATFSGIIQALREKESKLKASRMHLYVRRGGPNYQTGLAKMRKLGAEIGVPIEVYGPEETMTGICRQAIECIMAAS

SEQ ID NO: 7907 - protein, 421 aa, Tragopogon dubius
MARKKIREYDSKRLLKEHLKRLAAIDLQICSAQVNASTDFTELTDREPWLSSTKLVVKPDMLFGKRGKSGLVALNLDVAQVADFVKSRIGVEVEMGGCKAPITTFIVEPFVPHDQEYYLSIVSERLGSTISFSECGGIDIEENWDKVKTAFLPTEKRLTLETCAPLIATLPLEVRAKIGNFIIGVFTVFQDLDFSFLEMNPFTLVNGEPFPLDMRGELDDTAAFKNFQKWGNIEFPLPFGRVLSSTESFIHTLDEKTSASLKFTVLNPKGRIWTMVAGGGASVIYADTVGDLGYASELGNYAEYSGAPNEEEVLQYARVVIDCATADPDGRKRALLIGGGIANFTDVAATFNGIIRALREKESKLKAARMHIYVRRGGPNYQTGLAKMRALGEELGIPLEVYGPEATMTGICKQAIDCIMS

SEQ ID NO: 7908 - protein, 146 aa, Vaccinium corymbosum
MARKKIREYDSKRILKEHLKRLAGIDLQICSAQVNESTEFTELTNQEPWLSSTKLVVKPDMLFGKRGKSGLVALNLDLAQVAEFVKTRLGVEVEMGGCKAPITTFIVNHLFPMPKNTTLTLYLTGLAVTLAFRNVEVLKLKRIGIR

SEQ ID NO: 7909 - protein, 100 aa, Pteridium aquilinum
QTDNISDHFISQRTNPPLSPPLPLFLFCQSVALSVWCLIFEDQKMARKKIREYDSKRLLKEHLKRLANIHLQICSAQVTESTDFTELTNKDPGFHPPDWL

SEQ ID NO: 7910 - protein, 423 aa, Chelidonium majus
MARKKIREYDSKRLLKEHLKRLAGIQLEICSVQVNASTDFAELTDKEPWLSSTKLVVKPDMLFGKRGKSGLVALNLDLAQVAQFVKERLGVEVEMGGCKAPITTFVVEPFVPHDDEYYLSIVSERLGSTISFSECGGIEIEENWDKVKSIFLPTEKPMTSDSCAPLIATLPLEVRGKIGDFIKGVFAVFQDLDFSFLEMNPFTLVKGEPYPLDMRGELDDTATFKNFKKWGNIEFPLPFGRVMSPTESFVHSLDEKTSASLKFTVLNPKGRIWTMVAGGGASVIYADTVGDLGYASELGNYAEYSGAPNEEEVLQYARVVIDCATADPDGRKRALLIGGGIANFTDVAATFNGIIRALREKESKLKAARMHIYVRRGGPNYQTGLAKLRALGEELGVPLEVFGPEATMTGICKQAIDCVMAAA

SEQ ID NO: 7911 - protein, 423 aa, Euphorbia peplus
MARKKIREYDSKRLLKHHLKRLSGIDLQICSAQVTESTDFSELTNKEAWLSSSRLVVKPDMLFGKRGKSGLVALNLDLAQVAEFVKGRLGAEVEMGGCKAPISTFIVEPFVPHDQEFYLSIISERLGSTISFSECGGIEIEENWDKVKTIFLPTEKPLTLEACAPLIATLPLEIRGKIGDFITGVFTVFQDLDFSFLEMNPFTLVNGEPYPLDMRGELDDTAAFKNFNKWGNIEFPLPFGRVLSSTESFIHSLDEKTSASLKFTVLNPKGRIWTMVAGGGASVIYADTVGDLGYASELGNYAEYSGAPNEEEVLQYARVVIDCATADPDGRKRALLIGGGIANFTDVAATFNGIIRALREKESKLKASRMHIFVRRGGPNYQTGLAKMRALGEELGVPLEVYGPEATMTGICKEAIDCIMSTA

SEQ ID NO: 7912 - protein, 423 aa, Vitis vinifera
MARKKIREYDSKRLLKEHLKRLVGIDLQICSAQVTEATDFAELTNKEPWLSSTRLVVKPDMLFGKRGKSGLVALNLDLAQVAEFVKARLGVEVEMGGCKAPITTFIVEPFVPHDQEYYLSIVSDRLGCTISFSECGGIEIEENWDKVKTINLPTEKPMTPETCAPLIATLPLEVRGKIGDFIKGVFAVFQDLDFSFLEMNPFTLVNGEPYPLDMRGELDDTAAFKNFKTWGNIEFPLPFGRVLSPTEGYIHLLDEKTSASLKFTVLNPKGRIWTMVAGGGASVIYADTVGDLGYASELGNYAEYSGAPNEEEVLQYARVVLDCATADPDGRKRALLIGGGIANFTDVAATFNGIIRALKEKESKLKASRMHIYVRRGGPNYQTGLARMRALGEELGIPLEVYGPEATMTGICKQAIDCIMSTA

SEQ ID NO: 7913 - protein, 423 aa, Tropaeolum majus
MARKKIREYDSKRLIKEHLKRLSGIDLQICSAQVTQSTDFTDLTNKEPWLSSERLVVKPDMLFGKRGKSGLVALNLDMAQVSEFVKARLGAEVEMGGCKAPITTFIVEPFVPHDQEYYLSIVSERLGCTISFSECGGIEIEENWDKVKTIFLPTEKHLTLEACAPLIATLPLEVRGKIGDFIMGVFSVFQDLDFSFIEMNPFTLVNGEPYPLDMRGELDDTAAFKNFKKWGDIEFPLPFGRVLSSTESFIHSLDEKTSASLKFTVLNQSGRIWTMVAGGGASVIYADTVGDLGYASELGNYAEYSGAPNEEEVLQYARVVIDCATSNPDGRKRALLIGGGIANFTDVAATFNGIIRALKEKESKLKASRMHIYVRRGGPNYQTGLARMRALGEELGVPFEVYGPEATMTGICKSAIDCIMSAA

SEQ ID NO: 7914 - protein, 423 aa, Quercus alba
MARKKIREYDSKRLVKEHLKRLANIDLQIHSAQVTEATDFAELTNQEPWLSSTRLVVKPDMLFGKRGKSGLVALNLDLAQVAEFVKARLGVEVEMGGCKSPITTFIVEPFVPHDQEYYLSIVSDRLGCTISFSECGGIEIEENWDKVKTIFLPTEKPITLEACAPLIATLPLEVRGKIGDYIIGVFKVFQDLDFSFIEMNPFTLVNGEPYPLDMRGELDDTAAFKNFKKWGNIEFPLPFGRVLNPTESFIHSLDEKTSSSLKFTVLNPKGRIWTMVAGGGASVIYADTVGDLGYAQELGNYAEYSGAPNEDEVLQYARVVIDCATADPDGRKRALLIGGGIANFTDVAATFNGIIRALKEKESKLKAARMHIYVRRGGPNYQTGLAKMRALGEELGVPIEVYGPEATMTGICKQAIDCVMAAA

SEQ ID NO: 7915 - protein, 423 aa, Papaver somniferum
MARKKIREYDSKRLLKEHLKRLAGIQLDISSVQVSEKTDFTELTNKEPWLSSTKLVVKPDMLFGKRGKSGLVALNLDLAQVAQFVKERLGVEVEMEGCKAPITTFVVEPFVPHDDEYYLSIVSERLGSTISFSECGGIEIEENWDKVKTIFLPTEKPMTSEACAPLIATLPLEVRSKIGDFIKGVFSVFQDLDFSFVEMNPFTLVKGEPYPLDMRGELDDTAAFKNFKKWGNVEFPLPFGRVMSPTESYIHTLDEKTSASLKFTVLNPKGRIWTMVAGGGASVIYADTVGDLGYASELGNYAEYSGAPNEEEVLQYARVVIDCATAEPDGRKRALLIGGGIANFTDVAATFNGIIRALREKESKLKASRMHIYVRRGGPNYQTGLAKMRSLGEELGVPLEVFGPEATMTGICKQAIDCIMSAS

SEQ ID NO: 7916 - protein, 423 aa, Tripterygium wilfordii
MARKKIREYDSKRLLKQHLKRLAGIDLQICSAQVTASTDFTDLTNKEPWLSSTRLVVKPDMLFGKRGKSGLVALNFDLAQVAEFVKARLGVEVEMGGCKAPITTFIVEPFVPHEQEYYLSIVSERLGCTISFSECGGIEIEENWDKVKTIYLPTEKPMTLEACAPLIATLPLEVRGKIGDFIMGVYAVFQDLDFSFVEMNPFTLVNGEPYPLDMRGELDDTAAFKNFKNWGSIEFPLPFGRVLSPTEGFIHSLDEKTSASLKFTVLNPKGRIWTMVAGGGASVIYADTVGDLGYASELGNYAEYSGAPNEEEVLQYARVVIDCATANPDGRKRALLIGGGIANFTDVAATFSGIIRALREKESKLKAARMHIYVRRGGPNYQTGLAKMRALGEELGVRLEVYGPEATMTGICKQAIDCIMSEA

SEQ ID NO: 7917 - protein, 191 aa, Panax ginseng
MARKKIREYDSKRLLKEHLKRLAAIDLQIYSAQVTESTDFTELTNKEPWLSSAKLVVKPDMLFGKRGKSGLVALNLDLAQVAQFVKGHLGVEVEMGGCKAPITTFIIEPFIPHDQEYYLSIVSERLGCTISFSECGGIEIEENWDKVKTVFLPTEKPMTLEACAPLIATLPLEVRPKIGDFIMGVFLYLKI

SEQ ID NO: 7918 - protein, 421 aa, Cyclamen graecum
MARKKIREYDSKRLLVQHLKRLANIHLHLSSAQVNESTDFLELTNQEPWLSSAKLVVKPDMLFGKRGKSGLVALNLDLAQVAEFAKGRLGVEVEMGGCKAPITTFIVEPFVPHDKEYYLSIVSERLGSTISFSECGGIEIEENWDKVKTIFLPTEKPMTLETCAPLIATLPLEVRGTIGDFIQGVFSVFQDLDFSFLEMNPFTLVNGEPYPLDMRGELDDTAAFKNFKKWGNIEFPLPFGRVLSSTESFIHSLDEKTSASLKFTVLNPNGRIWTMVAGGGASVIYADTVGDLGYASELGNYAEYSGAPNEEEVLQYAKVVIDCATANPDGRKRALLIGGGIANFTDVAATFNGIIRALREKESKLKASRMHIFVRRGGPNYQTGLAKMRALGEELGVPLEVYGPEATMTGICKEAIDCIMS

SEQ ID NO: 7919 - protein, 423 aa, Centaurea maculosa
MARKKIREYDSKRLLKQHLKRLAGIDLQICSAQVNASTDFIELTDKEPWLSSTKLVVKPDMLFGKRGKSGLVALNLDVAQVADFVKARLGVEVEMGGCKAPITTFIVEPFVPHDQEYYLSIVSERLGSTISFSECGGIEIEDNWDKVKTVFLPTEKPMTLETCAPLIATLPLEVRAKIGDFIMGVFAVFQDLDFSFLEMNPFTLVNGEPFPLDMRGELDDTAAFKNFQKWGNLEFPLPFGRVLSSTERFIHTLDEKTSASLKFTVLNPKGRIWTMVAGGGASVIYADTVGDLGYASELGNYAEYSGAPNEEEVLQYARVVIDCATADPDGRKRALLIGGGIANFTDVAATFNGIIRALREKESKLKAARMHIYVRRGGPNYQTGLAKMRALGEELGIPLEVYGPEATMTGICKEAIECIMSQA

SEQ ID NO: 7920 - protein, 421 aa, Cichorium intybus
MARKKIREYDSKRLLKEHLKRLSGINLQICSAQVNASTDFTELTDKEPWLSSTKLVVKPDMLFGKRGKSGLVALNLDVAQVADFVKSRLGVEVEMGGCKAPITTFIVEPFVPHDEEYYLSIVSERLGSTISFSECGGIDIEENWEKVKTAFLPTEKPLTLETCAPLIATLPLEVRAKIGNFIMGVFAVFQDLDFSFLEMNPFTLVNGEPFPLDMRGELDDTAAFKNFKKWGNVEFPLPFGRVLSPTEGFIHTLDEKTSASLKFTVLNPKGRIWTMVAGGGASVIYADTVGDLGYASELGNYAEYSGAPNEEEVLQYARVVIDCATADPDGRKRALLIGGGIANFTDVAATFNGIIRALREKESKLKAARMHIFVRRGGPNYQTGLAKMRALGQELGVPLEVYGPEATMTGICKEAIDCIMS

SEQ ID NO: 7921 - protein, 423 aa, Eschscholzia californica
MARKKIREYDSKRLLKEHLKRLAGIQLEIRSVQVNASTDFTELTNKEPWLSSTKLVVKPDMLFGKRGKSGLVALNMDLAQVAQFVKERLGVEVEMGGCKAPITTFVVEPFIPHDDEYYLSIVSERLGCTISFSECGGIEIEENWDKVKTIFLPTEKPMTSETCAPLIATLPLEVRAKIGDFVKGVFSIFQDLDFSFLEMNPFTLVNGEPYPLDMRGELDDTAAFKNFKKWGNIEFPLPFGRVMSPTESYIHSLDEKTSASLKFTVLNSKGRIWTMVAGGGASVIYADTVGDLGYASELGNYAEYSGAPNEEEVLQYARVVIDCATADPDGRKRALLVGGGIANFTDVAATFNGIIRALREKESKLKASRMHIYVRRGGPNYQTGLAKMRALGEELGVPLEVFGPEATMTGICKQAIDCIMSAA

SEQ ID NO: 7922 - protein, 423 aa, Lotus japonicus
MARKKIREYHSKKLLKEHLKRLASIDLDIKSAQVTESTDFAELTNQHPWLSSTKLVVKPDMLFGKRGKSGLVALNLDVAQVAEFVKERLGVEVEMGGCKAPITTFIVEPFVPHELEFYLSVVSERLGSTISFSECGGIEIEENWDKVKTIFLPTEKPMTLEACAPLIATLPLEVRGKIGDFIMGVFAVFQDLDFSFLEMNPFTLVDEKPYPLDMRGELDDTAAFKNFNKWGDIEFPLPFGRVLSPTESFIHSLDDKTSASLKFTVLNPKGRIWTMVAGGGASVIYADTVGDLGYASELGNYAEYSGAPNEEEVLQYARVVIDCATADPDGRKRALLIGGGIANFTDVAATFSGIIRALKEKESKLKAARMHIFVRRGGPNYQTGLAKMRALGEELGVPIEVYGPEATMTGICKQAIDCIMSEA

SEQ ID NO: 7923 - protein, 423 aa, Nicotiana benthamiana
MARKKIREYESKRLLKEHLKRLSGIDLQICSAQVTESTDFTELTNKEPWLSSTKLVVKPDMLFGKRGKSGLVALNLDLAGVAEFVKARLGVEVEMGGCKAPITTFIVEPFVPHDQEYYLSIVSERLGCTISFSECGGIEIEENWDKVKTIFLPTEKPMTLEACAPLIATLPLEVRGTIGNFLMGVFNVFQDLDFSFIEMNPFALVNGDPYPLDMRGELDDTAAFKNFKKWGSIEFPLPFGRVLSPTESFIHSLDEKTSASLKFTVLNPKGRIWTMVAGGGASVIYADTVGDLGYASELGNYAEYSGAPNEEEVLQYARVVLDCATANPDGRKRALIVGGGIANFTDVAATFNGIIRALREKEAKLKAAGMHIYVRRGGPNYQTGLAKMRALGEELGVPLEVYGPEATMTGICKRAIDCIMSEA

SEQ ID NO: 7924 - protein, 424 aa, Eutrema halophilum
MARKKIREYDSKRLLKQHLKRLANIDLQIRSAQVTQSTDFTELTNQESWLSSTKLVVKPDMLFGKRGKSGLVALKLDLAEVAEFVKVRLGTEVEMGGCKAPITTFIVEPFVPHDQEYYLSIVSDRLGCTISFSECGGIEIEENWDKVKTIFLPSEKPMTLEVCAPLIATLPLEVRAKIGNFIMGAFSVFQDLDFSFMEMNPFTLVDGEPYPLDMRGELDDTAAFKNFNKWGDIEFPLPFGRVLSPTESFIHGLDEKTSASLKFTVLNPKGRIWTMVAGGGASVIYADTVGDLGYASELGNYAEYSGAPNEEEVLQYARVVIDCATADPDGRKRALLIGGGIANFTDVAATFNGIIRALREKETRLKASRMHIYVRRGGPNYQTGLARMRALGDELGVPLEVYGPEATMTGICKRAIDCIMLADT

SEQ ID NO: 7925 - protein, 452 aa, Echinochloa colona
FRTHARRSSSPPTHPPTCSCPSLPEGSAGGDGAEEDPGVRLQAPPPEHLKRLAGIDLQILSAQVTQSTDFTELANQEPWLSSMKLVVKPDMLFGKRGKSGLVALNLDLAQVRQFVKERLGVEVEMGGCKAPITTFIVEPFVPHDQEYYLSIVSERLGCTISFSECGGIEIEENWDKVKTIFLPTEKQMTPDACAPLIATLPLEVRTKIGDFIRGVFSVFQDLDFSFLEMNPFTLVNGEPYPLDMRGELDDTAAFKNFNKWGNIEFPLPFGRVLNPSESFIHELDEKTSSSLKFTVLNPKGRIWTMVAGGGASVIYADTVGDLGYASELGNYAEYSGAPNEEEVLQYARVVLDCATADPDGRKRALLIGGGIANFTDVAATFSGIIRALREKESKLKAARMNIYVRRGGPNYQTGLAKMRTLGAELGVPIEVYGPEATMTGICKEAIDCIMAA

SEQ ID NO: 7926 - protein, 423 aa, Daucus carota
MARKKIREYDSKRLIKEHLKRLAGIDLQICSAQVTESTDFTDLTNKEPWLSSSKLVVKPDMLFGKRGKSGLVALNLDLAQVAEFVKGRLGVEVEMGGCKAPITTFIVEPFIPHDQEYYLNIVSERLGCSISFSECGGIDIEENWDKVKTIFLPTEKPMTQEVCAPLIATLPLEVRAKIGDFILAVFSVFTDLDFTFLEMNPFTLVNGEPYPLDMRGELDDTATFKNFKKWGKIEFPLPFGRVLSPTESFILSLDEKTSASLKFTVLNPKGRIWTMVAGGGASVIYADTVGDLGYATELGNYAEYSGAPNEEEVLQYARVVIDCATADPDGRKRALLIGGGIANFTDVAATFNGIIRALREKESKLKASRMHIYVRRGGPNYQTGLAKMRALGEELEIPLEVYGPEATMTGICKQAIECVMAAA

SEQ ID NO: 7927 - protein, 423 aa, Allium cepa
MARKKIREYDSKRLLKEHLKRLAGIELQIQSAQVTESTDFTELVNKEPWMSSTKLVVKPDMLFGKRGKSGLVALNLDMAQVSEFVKERLGVEVEMSGCKAPITTFIVEPFVPHDDEYYLNIVSERLGCSVSFSECGGIDIEENWDKVKTVFLPTEKPLTSEACAPLIATLPLEVKEKIGAFIQGVFSVFQDLDMSFLEMNPFTMVNGEPYPLDMRGELDDTAAFKNFKKWGNIEFPLPFGRVLSPTESFIHGLDEKTSASLKFTVLNPKGRIWTMVAGGGASVIYADTVGDLGYANELGNYAEYSGAPNEEEVLQYARVVLDCATADPDGRKRALLIGGGIANFTDVAATFNGIIRAIREKESKIKAARMHIYVRRGGPNYLTGLAKMRALGAEIGVPLEVYGPEATMTGICKEAINCIMAEA

SEQ ID NO: 7928 - protein, 423 aa, Arnica chamissonis
MARKKIREYDSKRLLKENLKRLAGIDLLICSAQVDASTDFTELTDKEPWLSSTKLVVKPDMLFGKRGKSGLVALNLDVAQVADFVKARLGVEVEMGGCKAPITTFIVEPFVPHDQEYYLSIVSERLGSTISFSECGGIDIEENWEKVKTVFLPTEKPIMLETCAPLIATLPLEVRAKIGNFIMGVFAVFQDLDFTFLEMNPFTLVNGEPFPLDMRGELDDTAAFKNFKKWGNIEFPLPFGRVLSSTESFIHTLDEKTSASLKFTVLNPKGRIWTMVAGGGASVIYADTVGDLGYASELGNYAEYSGAPNEEEVLQYARIVIDCATADPDGRKRALLIGGGIANFTDVAATFSGIIRALREKESKLKAARMHIYVRRGGPNYQTGLAKMRALGEELGVPLEVYGPEATMTGICKEAIECIMSKA

SEQ ID NO: 7929 - protein, 423 aa, Phaseolus vulgaris
MARKKIREYHSKRLLKEHLKRLASIDLDILSAQVTQSTDFAEFTDHHPWLSSTKVVVKPDMLFGKRGKSGLVALNLDIAEVAEFVKARLGVEVEMGGCKAPITTFIVEPFVPHDQEYYLSIVSERLGSTISFSECGGIDIEENWDKVKTIFLPTEKQLTPKACAPLIATLPLEIRETIGDFILGVFAVFQDLDFSFLEMNPFTIVNEKPYPLDMRGELDDTAAFKNFNKWGNIEFPLPFGRVLSPTESFIHSLDDKTSASLKFTVLNPKGRIWTMVAGGGASVIYADTVGDLGYASELGNYAEYSGAPNEEEVLQYARVVIDCATADPDGRKRALLIGGGIANFTDVAATFSGIIRALKEKESKLKAARVHIYVRRGGPNYQTGLAKMRSLGEELGVPIQVYGPEATMTGICKQAIDCIMSEA

SEQ ID NO: 7930 - protein, 423 aa, Capsicum annuum
MARKKIREYDSKRLLKEHLKRLCGIDLKICSAQVTESTDFTELTNKDPWLSSTKLVVKPDMLFGKRGKSGLVALNLDLAGVAEFVKTRLGVEVEMGGCKAPITTFIVEPFVPHDQEYYLSIVSERLGCTISFSECGGIEIEENWDKVKTIFLLTEKPMNLEACAPLIATLPLEVRGTIGNFLMGVFNVFQDLDFSFIEMNPFTLVNGEPYPLDMRGELDDTAAFKNFKKWGSIEFPLPFGRVLSSTESFIHSLDEKTSASLKFTVLNPKGRIWTMVAGGGASVIYADTVGDLGYASELGNYAEYSGAPNEEEVLQYARVVLDCATATPDGRKRALIVGGGIANFTDVAATFNGIIRALREKESKLKAARMHIYVRRGGPNYQTGLAKMRALGEELGVPLEVYGPEATMTGICERAIDCIMSEA

SEQ ID NO: 7931 - protein, 232 aa, Allium cepa
MARKKIREYDSKRLLKEHLKRLAGIELQIQSAQVTESTDFTELVNKEPWMSSTKLVVKPDMLFGKRGKSGLVALNLDMAQVSEFVKERLGVEVEMSGCKAPITTFIVEPFVPHDDEYYLNIVSERLGCSVSFSECGGIDIEENWDKVKTVFLPTEKPLTSEACAPLIATLPLEVKEKIGAFIQGVFSVFQDLDMSFLEMNPFTMVNGEPYPLDMRGELDDTAAFKNFKKWET

SEQ ID NO: 7932 - protein, 198 aa, Brassica napus
MARKKIREYDSKRLLKEHLKRLANINLQIRSAQVTEATDFTELTNQEPWLSSTKLVVKPDMLFGKRGKSGLVALKLDLAEVAEFVKARLGSEVEMGGCKAPITTFIVEPFVPHDQEYYLSIVSDRLGCTISFSECGGIEIEENWDKVKTVFLPAEKSMTLEVCAPLIATLPLEVRGKIGSFIMGVFAVFKIWISVSWR

SEQ ID NO: 7933 - protein, 423 aa, Centaurea maculosa
MARKKIREYDSKRLLKQHLKRLSGIDLQICSAQVNASTDFIELTDKEPWLSSTKLVVKPDMLFGKRGKSGLVALNLDVAQVADFVKARLGVEVEMGGCKAPITTFIVEPFVPHDQEYYLSIVSERLGSTISFSECGGIEIEDNWDKVKTVFLPTEKPMTLETCAPLIATLPLEVRAKIGDFIMGVFAVFQDLDFSFMEMNPFTLVNGEPFPLDMRGELDDTAAFKNFQKWGNLEFPLPFGRVLSSTERFIHTLDEKTSASLKFTVLNPKGRIWTMVAGGGASVIYADTVGDLGYASELGNYAEYSGAPNEEEVLQYARVVIDCATADPDGRKRALLIGGGIANFTDVAATFNGIIRALREKESKLKAARMHIYVRRGGPNYQTGLAKMRALGEELGIPLEVYGPEATMTGICKEAIECIMSQA

SEQ ID NO: 7934 - protein, 423 aa, Glycine max
MARKKIREYHSKRLLKEHLKRLASIDLQILSAQVTESTDFTELTDQHPWLSSTRLVVKPDMLFGKRGKSGLVALNLDIAQVAEFVKARLGVEVEMGGCKAPITTFIVEPFVPHDQEFYLSIVSERLGSTISFSECGGIEIEENWDKVKTIFLPTEKPLTPEACAPLIAILPLEIRGTIGDFIMGVFAVFKDLDFSFLEMNPFTLVNEKPYPLDMRGELDDTAAFKNFNKWGNIEFPLPFGRILSPTESFIHSLDDKTSASLKFTILNPKGRIWTMVAGGGASVIYADTVGDLGYASELGNYAEYSGAPNEEEVLQYARVVIDCATEDPDGRKRALLIGGGIANFTDVAATFNGIIRALKEKESKLKAAQMHIYVRRGGPNYQTGLAKMRALGEELGVPIQVYGPEATMTGICKQAIDCIMSEA

SEQ ID NO: 7935 - protein, 424 aa, Brassica oleracea
MARKKIREYDSKRLLKEHLKRLANINLQIRSAQVTEATDFTELTNQEPWLSSTKLVVKPDMLFGKRGKSGLVALKLDLAEVAEFVKARLGSEVEMGGCKAPITTFIVEPFVPHDQEYYLSVVSDRLGCTISFSECGGIEIEENWDKVKTVFLPAEKSMTLEVCAPLIATLPLEVRGKIGSFIMGVFAVFQDLDFSFLEMNPFTLVDGEPYPLDMRGELDDTAAFKNFNKWGDIEFPLPFGRVLSPTESFIHGLDEKTSASLKFTVLNPKGRIWTMVAGGGASVIYADTVGDLGYASELGNYAEYSGAPNEEEVLQYARVVIDCATADPDGRKRALLIGGGIANFTDVAATFNGIIRALREKETRLKASRMHIYVRRGGPNYQTGLARMRALGDELGVPLEVYGPEATMTGICKRAIDCIMLPDA

SEQ ID NO: 7936 - protein, 423 aa, Elaeis guineensis
MARKKIREYDSKRLLKEHLKRIVGIDLQICSAQVTESTDFTELVKNEPWLSSTKLVVKPDMLFGKRGKSGLVALDLDMAQVAQFVKERLGVEVEMGGCKAPITTFIIEPFVPHDQEYYLSFVSERLGCTISFSECGGIEVEENWDKVKTIYLPAENPMTSDACAPLIATLPLEVRGKIDDFIKGVFAVFQDLDFTFLEMNPFSLVNGEPYPLDMRGELDDTAAFKNFKKWGNIEFPLPFGRVLSPTESFIHKLDEKTSASLKFTVLNPKGRIWTMVAGGGASVIYADTVGDLGYASELGNYAEYSGAPNEDEVLQYARVILDSATADPDGRKRALLIGGGIANFTDVAATFGGIIRALREKESKLKAARMHIYVRRGGPNYQRGLAKMRALGEELGISFEVYGPEATMTGICKQAIDCVMSTA

SEQ ID NO: 7937 - protein, 157 aa, Euonymus alatus
MARKKIREYDSKRLLKQHLKRFSGIDLQICSAQVTESTDFTDLTNKEPWISSTRLVVKPDMLFGKRGKSGLVALNLDLAQVAEFVKARLGVEVEMGGCKAPITTFIVEPFVPHEQEYYLSIVSERLGCTVSFSECGVLKLKKTGIRLRLYIFQLKSL

SEQ ID NO: 7938 - protein, 423 aa, Malus domestica
MARKKIREYDSKRLLKQHLKRLAGIDLQINSALVTESTDFSELSNEHTWLSSTRLVVKPDMLFGKRGKSGLVALNLDMAQVAEFVKQRLGKEVEMGGCKAPITTFIVEPFMPHDQEFYLSIVSERLGSTVSFSECGGIEIEENWDKVKTIFLPTEKPMTNDACAPLIATLPLEVRGKIGDFIKGVFAVFQDLDFSFLEMNPFTLVDGEPYPLDMRGELDDTAAFKNFNKWGNVEFPLPFGRVLSPTETFIHSLDEKTSASLKFTVLNPKGRIWTMVAGGGASVIYADTVGDLGYASELGNYAEYSGAPNEGEVLQYARVVIDCATADPDGRKRALIIGGGIANFTDVAATFNGIIRALKEKESKLKAARMHIFVRRGGPNYQTGLAKMRALGEELGVPLEVYGPEATMTGICKQAIECIMGEA

SEQ ID NO: 7939 - protein, 424 aa, Arabidopsis lyrata
MARKKIREYDSKRLLKEHLKRLANIDLQIRSAQVTESTDFTELTNQESWLSSTKLVVKPDMLFGKRGKSGLVALKLDLAEVAAFVKARLGTEVEMEGCKAPITTFIVEPFVPHDQEYYLSIVSDRLGCTISFSECGGIEIEENWDKVKTIFLPAEKSMTLEVCAPLIATLPLEVRAKIGNFIMGAFAVFQDLDFSFMEMNPFTLVDGEPYPLDMRGELDDTAAFKNFNKWGDIEFPLPFGRVLSSTESFIHGLDEKTSASLKFTVLNPKGRIWTMVAGGGASVIYADTVGDLGYASELGNYAEYSGAPNEEEVLQYARVVIDCATADPDGRKRALLIGGGIANFTDVAATFNGIIRALREKETRLKASRMHIYVRRGGPNYQTGLARMRALGEELGVPLEVYGPEATMTGICKRAIDCIMLPDA

SEQ ID NO: 7940 - protein, 423 aa, Musa acuminata
MARKKIREYDSKRLLKEHLKRLAGTDLQIRSAQVTESTDFNELVNKEPWISSTKLVVKPDMLFGKRGKSGLVALNLDLAQAAQFVKERLGTEVEMGGCKAPITTFIIEPFIPHDQEYYLSIVSERLGCTISFSECGGIEIEENWDKVKTVYLPTEKSMASEACAPLIVTLPLEVRGKIGDFIKGVLTVFQDLDFSFIEMNPFTLVNGEPYPLDMRGELDDTAAFKNFKKWGSIEFPLPFGRVLSSTEKFVHELDEKTSASLKFTVLNPKGRIWTMVAGGGASVIYADTVGDLGYASELGNYAEYSGAPNEEEVLKYARVVLDCATADPDGRKRALLIGGGIANFTDVAATFNGIIKALKEKESKLKAARMHIYVRRGGPNYQTGLAKMRKLGEELGIPLEVYGPEATMTGICKQAIDCVMSAA

SEQ ID NO: 7941 - protein, 424 aa, Catharanthus roseus
MARKKIREYDSKRLLKEHLKTLAGIDLQICSAQVNEDTDFVELTNKEPWLSSTRLVVKPDMLFGKRGKSGLVALNLDIAQVADFVKARLGKEVEMGGCKAPITTFIVEPFLPHDQEYYLNIVSERLGCSISFSECGGIEIEENWDKVKTIFLPTEKPLTLEACAPLIATLPLEVRGKIGDFIMAVFAVFQDLDFSFLEMNPFTLINGEPFPLDMRGELDDTAAFKNFKKWGNIEFPLPFGRVLSSTESFIHSLDEKTSASLKFTVLNPKGRIWTMVAGGGASVIYADTVGDLGYASELGNYAEYSGAPNEEEVLQYARVVIDCATANPDGLKRALLIGGGIANFTDVAATFNGIIRALREKESKLKAARMHIYVRRGGPNYQSGLAKMRALGEELGVPLEVYGPEATMTGICKQAIDCIMSEDN

SEQ ID NO: 7942 - protein, 423 aa, Gossypium hirsutum
MARKKIREYDSKRLLKQHLKRVANIDLQICSAQVTQSTDFTELTNEQPWLSSTRLVVKPDMLFGKRGKSGLVALNLDLAEVAEFVKARLGTEVEMGGCKAPITTFIVEPFVPHEQEYYLSIVSERLGFTISFSECGGIDIEENWDKVKTIFLPTEKPMTLETCAPLIATLPLEVRGKIGDFIMGVFSVFQDLDFSFLEMNPFTLVNGEPYPLDMRGELDDTAAFKNFNKWGNIEFPLPFGRVLSSTESFIYSLDGKTSASLKFTVLNPKGRIWTMVAGGGASVIYADTVGDLGYASELGNYAEYSGAPNEEEVLQYARVVIDCATANPDGRKRALLIGGGIANFTDVAATFNGIIRALREKEAKLKAARMHIFARRGGPNYQIGLARMRALGEELGVPLEVYGPEATMTGICKQAIDCILSEA

SEQ ID NO: 7943 - protein, 423 aa, Prunus mume
MARKKIREYDSKRLLKQHLKRVAGIDLQINSAQVTESTDIAELVNTETWLSSTRLVVKPDMLFGKRGKSGLVALNLDMAQVAEFVKQRLGKEVEMGGCKAPITTFIVEPFMPHDQEFYLSIVSERLGSTLSFSECGGIEIEENWDKVKTIFLPTEKSLTNEACAPLIATLPLEVRDKIGDFIKGVFTVFQDLDFSFLEMNPFTLVNGEPYPLDMRGELDDTAAFKNFNKWGNVEFPLPFGRVLSPTETFIHSLDEKTSASLKFTVLNPKGRIWTMVAGGGASVIYADTVGDLGYASELGNYAEYSGAPNEEEVLQYARVVIDCATADPDGQKRALIIGGGIANFTDVAATFNGIIRALREKESKLKAARMHIFVRRGGPNYQTGLAKMRALGEELGVPLEVYGPEATMTGICKQAIECIMGEE

SEQ ID NO: 7944 - protein, 424 aa, Raphanus sativus
MARKKIREYDSKRLLKEHLKRLANIDLQIRSAQVTEATDFTELTNQESWLSSTKLVVKPDMLFGKRGKSGLVALKLDLAEVAEFVKARLGSEVEMGGCKAPITTFIVEPFVPHDQEYYLSVVSDRLGCTISFSECGGIEIEENWDKVKTVFLPAEKSMTLEVCAPLIATLPLEVRGKIGSFIMGVFAVFQDLDFSFLEMNPFTLVDGEPYPLDMRGELDDTAAFKNFNKWGDIEFPLPFGRVLSPTESFIHGLDEKTSASLKFTVLNPKGRIWTMVAGGGASVIYADTVGDLGYASELGNYAEYSGAPNEEEVLHYARVVIDCATADPDGRKRALLIGGGIANFTDVAATFNGIIRALREKETRLKASRMHIYVRRGGPNYQTGLARMRALGDELGVPLEVYGPEATMTGICKRAIDCIMLPDA

SEQ ID NO: 7945 - protein, 423 aa, Fragaria vesca
MARKKIREYDSKRLLKQHLKRVAGIDLQINSAQVTEATDFTELANKETWLSSTRLVVKPDMLFGKRGKSGLVALNLDMAQVADFVKQRLGKEVEMGGCKAPITTFIVEPFMPHDKEFYLSIVSERLGSTISFSECGGIEIEENWDKVKTIFLPTEKSLTNEACAPLIATLPLEVKEKIGDFIKGVFAVFQDLDFTFLEMNPFTLVNGEPFPLDMRGELDDTAAFKNFNKWGNVEFPLPFGRVLSPTESFIHTLDEKTSASLKFTVLNPKGRIWTMVAGGGASVIYADTVGDLGYASELGNYAEYSGAPNEEEVLQYARVVIDCATANPDGRKRALLIGGGIANFTDVAATFNGIIRALREKESKLKASRMHMYVRRGGPNYQTGLARMRALGDELGVPLEVYGPEATMTGICKDAIDCIMSES

SEQ ID NO: 7946 - protein, 423 aa, Musa acuminata
MARKKIREYDSKRLLKEHLKRLAGTDLQIRSAQVTESTDFNELVNKEPWISSTKLVVKPDMLFGKRGKSGLVALNLDLAQAAQFVKERLGTEVEMGGCKAPITTFIIEPFIPHDQEYYLSIVSERLGCTISFSECGGIEIEENWDKVKTVYLPTEKSMASEACAPLIVTLPLEVRGKIGDFIKGVLTVFQDLDFSFIEMNPFTLVNGEPYPLDMRGELDDTAAFKNFKKWGSIEFPLPFGRVLSSTEKFVHELDEKTSASLKFTVLNPKGRIWTMVAGGGASVIYADTVGDLGYASELGNYAEYSGAPNEEEVLKYARVVLDCATADPDGRKRALLVGGGIANFTDVAATFNGIIKALKEKESKLKAARMHIYVRRGGPNYQTGLAKMRKLGEELGIPLEVYGPEATMTGICKQAIDCVMSAA

SEQ ID NO: 7947 - protein, 423 aa, Cocos nucifera
MARKKIREYDSKRLLKEHLKRIAGIDLQICSAQVTESTDFTELVKKEPWISSTKLVVKPDMLFGKRGKSGLVALDLDMAQVAQFVKERLGVEVEMGGCKAPITTFIIEPFVPHDQEYYLSFVSERLGCTISFSECGGIEIEENWEKVKTIFLPAENPMTFDACAPLIASLPLEVRGKMDDFIKGVFAVFQDLDFTFLEMNPFSFVNGEPYPLDMRGELDDTAAFKNFKKWGNIEFPLPFGRVLRPTENFIHKLDEKTSASLKFTVLNPKGRIWTMVAGGGASVIYADTVGDLGYASELGNYAEYSGAPNEDEVLQYARVILDSATADPDGRKRALLIGGGIANFTDVAATFGGIIRALREKESKLKAARMHIYVRRGGPNYQTGLAKMRALGKELGIPLEVYGPDATMTGICKQAIDCVMSAA

SEQ ID NO: 7948 - protein, 257 aa, Flaveria ramosissima
MARKKIREYDSKRLLKQNLKRLAGIDLQICSAQVTASTDFTDLTDKEPWLSSTKLVVKPDMLFGKRGKSGLVGLNLDVAQVADFVKARLGAEVEISGCKAPITMFIVEPFVPHDQEYYFSIVSERLGSTISFSECGGIDIEENWEKVKTVFLPTEKPMTLETCAPLIATLPLEVRAKIGNFIMGVFAVFQDLDFTFLEMNPFTLVNGEPFPLDMRGELDDTAAFKNFKKWGNIEFPLPFGRVLSSTESFIHTLDEKN

SEQ ID NO: 7949 - protein, 423 aa, Prunus persica
MARKKIREYDSKRLLKQHLKRVAGIDLQINSAQVTESTDIAELANTETWLSSTRLVVKPDMLFGKRGKSGLVALNLDMAQVAEFVKQRLGKEVEMGGCRAPITTFIVEPFMPHDQEFYLSIVSERLGSTLSFSECGGIEIEENWGKVKTIFLPTEKSLTNEACAPLIATLPLEVRDKIGDFIKGVFAVFQDLDFSFLEMNPFTLVNGEPYPLDMRGELDDTAAFKNFNKWGNVEFPLPFGRVLSPTETFIHSLDEKTSASLKFTVLNPKGRIWTMVAGGGASVIYADTVGDLGYASELGNYAEYSGAPNEEEVLQYARVVIDCATADPDGQKRALIIGGGIANFTDVAATFNGIIRALREKESKLKAARMHIFVRRGGPNYQTGLAKMRALGEELGVPLEVYGPEATMTGICKQAIECIMGEE

SEQ ID NO: 7950 - protein, 423 aa, Amborella trichopoda
MARKKIREYDSKRLLKEHLKRISEIEIGIRSAQVTESTDFTEITDKEPWLSSTKLVVKPDMLFGKRGKSGLVALNLDLAQVAAFVKERLGKEVEMGGCKAPITTFIVEPFVPHTQEFYLSIVSERLGCTVSFSECGGIEIEENWDKVKTIFLPTEKSMTPEACAPLIATLPLEIRGTIGDFIKGVFAIFQDLDFTFLEMNPFTLVNGAPYPLDMRGELDDTAAFKNFKKWGNVEFPLPFGRVLSPTESFIHGLDEKTSASLKFTVLNPKGRIWTMVAGGGASVIYADTVGDLGYASELGNYAEYSGAPNEEEVLQYARVVIDCATSDPDGRKRALLIGGGIANFTDVAATFNGIIRALREKEAKLKASRMHVYVRRGGPNYQTGLARMRVLGEELGVPLEVYGPEATMTGICKQAIECIMSAA

SEQ ID NO: 7951 - protein, 424 aa, Arabidopsis thaliana
MARKKIREYDSKRLLKEHLKRLANIDLQIRSAQVTESTDFTELTNQESWLSSTKLVVKPDMLFGKRGKSGLVALKLDLAEVADFVKARLGTEVEMEGCKAPITTFIVEPFVPHDQEYYLSIVSDRLGCTISFSECGGIEIEENWDKVKTIFLPAEKSMTLEVCAPLIATLPLEVRAKIGNFIMGAFAVFQDLDFSFMEMNPFTLVDGEPFPLDMRGELDDTAAFKNFNKWGDIEFPLPFGRVLSSTENFIHGLDEKTSASLKFTVLNPKGRIWTMVAGGGASVIYADTVGDLGYASELGNYAEYSGAPNEEEVLQYARVVIDCATTDPDGRKRALLIGGGIANFTDVAATFNGIIRALREKETRLKASRMHIYVRRGGPNYQTGLARMRALGEELGVPLEVYGPEATMTGICKRAIDCIMLPDA

SEQ ID NO: 7952 - protein, 424 aa, Brassica juncea
MARKKIREYDSKRLLKEHLKRLANINLQIRSAQVTEATDFNELTNQEAWLSSTKLVVKPDMLFGKRGKSGLVALKLDLAEVSEFVKARLGSEVEMGGCKAPITTFIVEPFVPHDQEYYLSIVSDRLGCTVSFSECGGIEIEENWDKVKTVFLPAEKSMTLEVCAPLIATLPLEVRGKIGSFIMGVFAVFQDLDFSFMEMNPFTLVDGEPYPLDMRGELDDTAAFKNFNKWGDIEFPLPFGRVLSPTESFIHGLDEKTSASLKFTVLNPKGRIWTMVAGGGASVIYADTVGDLGYASELGNYAEYSGAPNEEEVLQYARVVIDCATADPDGRKRALLIGGGIANFTDVAATFNGIIRALREKETRLKASRMHIYVRRGGPNYQTGLARMRALGEELGVPLEVYGPEATMTGICKRAIDCIMLPDA

SEQ ID NO: 7953 - protein, 423 aa, Flaveria ramosissima
MARKKIREYDSKRLLKQNLKRLAGIDLHICSAQVTASTDFTDLTDKEPWLSSTKLVVKPDMLFGKRGKSGLVGLNLDVAQVADFVKARLGAEVEISGCKAPITTFIVEPFVPHDQEYYFSIVSERLGSTISFSECGGIDIEENWEKVKTVFLPTEKPMTLEACAPLIATLPLEVRAKIGNFIMGVFAVFQDLDFTFLEMNPFTLVNGEPFPLDMRGELDDTAAFKNFKKWGNIEFPLPFGRVLNSTESFIHTLDEKTSASLKFTVLNPKGRIWTMVAGGGASVIYADTVGDLGYASELGNYAEYSGAPNEEEVLQYARIVIDCATADPDGRKRALLIGGGIANFTDVAATFSGIIRALREKESKLKAARMHIYVRRGGPNYQTGLAKMRALGEELGIPLEVYGPEATMTGICKEAIECIMSNK

SEQ ID NO: 7954 - protein, 407 aa, Oryza sativa
MARKKIREYDSKRLLKEHLKRLAGIDLQILSAQVTQSTDFTELVNQQPWLSTMKLVVKPDMLFGKRGKSGLVALNLDIAQVKEFVKERLGVEVEMGGCKAPITTFIVEPFVPHDQEYYLSIVSERLGSTISFSECGGIEIEENWDKVKTIFLSTEKPMTPDACAPLIATLPLEARGKIGDFIKGVFAVFQDLDFSFLEMNPFTIVNGEPYPLDMRGELDDTAAFKTSRSKWGNIEFPLPFGRVLSSTEGFIHDLDEKTSASLKFTVLNPKGRIWTMVAGGELENYAEYSGAPNEEEVLQYARVVLDCATADPDGRKRALLIGGGIANFTDVGATFSGIIRALREKESKLKAARMHIYVRRGGPNYQTGLAKMRKLGAELGVPIEVYGPEATMTGICKQAIECVMAAA

SEQ ID NO: 7955 - protein, 424 aa, Eutrema parvulum
MARKKIREYDSKRLLKEHLKRLANIDLQIRSAQVTQATDLTELTNQESWLSSTKLVVKPDMLFGKRGKSGLVALKLDLAEVAEFVKVRLGTEVEIDGCKAPITTFIVEPFVPHDQEYYLSIVSDRLGCTISFSECGGIEIEENWDKVKTVFLPSEKSMTLEVCAPLIAILPLEVRGKIGGFIMGVFAVFQDLDFSFMEMNPFTLVDGEPYPLDMRGELDDTAAFKNFNKWGDIEFPLPFGRVLSPTESFIHGLDEKTSASLKFTVLNPKGRIWTMVAGGGASVIYADTVGDLGYASELGNYAEYSGAPNEEEVLQYARVIIDCATADPDGRKRALLIGGGIANFTDVAATFNGIIRALNEKETRLKASRMHIYVRRGGPNYQTGLTRMRALGEELGVPLEVYGPEATMTGICKRAIDCIMLPDA

SEQ ID NO: 7956 - protein, 407 aa, Amaranthus tuberculatus
MARKKIREYDSKRLLKQHLKRIAGIDLPICSAQITESTDFTQLVNEETWLSSSRLVVKPDMLFGKRGKSGLVGLNLDLAQVAEFVKERIGKEVEVGGCKAPVTTFIVEPFVPHEQEFYLSIVSDRLGCTISFSECGGIEIEENWDKVKSIVLPTEKSLSSEACAPLIATLPLEIRGKIGDFIKGVFAVFEDLDFSFLEMNPFTLVNGEPYPLDMRGELDDTAAFKNFNKWGNIEFPLPFGRVLSPTESYIHSLDEKTSASLKFTILNPKGRIWTMVAGGGASVIYADTVGDLGYASELGNYAEYSGAPNEEEVLQYARVVIDCATANPDGRKRALLIGGGIANFTDVAATFSGIIRALREKESKLKAARMHIYVRRGGPNYQTGLKKCVHSVRSLEFLLRYTAQRQP

SEQ ID NO: 7957 - protein, 412 aa, Rosa hybrid cultivar
MARKKIREYDSKRLLKQHLKRVAGIDLQINSAQVTEATDFTELANNETWLSSTRLVVKPDMLFGKRGKSGLVALNLDMAQVADFVKQRLGKEVEMGGCKAPITTFIVEPFMPHDQEFYLSIVSERLGSTISFSECGGIEIEENWDKVKTIFLPTEKSLTNEACAPLIATLPLEVKEKIGDFIKAVFAVFQDLDFSFLEMNPFTLVNGEPFPLDMRGELDDTAAFKNFNKWGNVEFPLPFGRVLSPTETFIHTLDEKTSASLKFTVLNPKGRIWTMVAGGGASVIYADTVGDLGYASELGNYAEYSGAPNEEEVLQYARVVIDCATANPDGRKRALLIGGGIANFTDVAATFNGIIRALKEKESKLKASRMHIYVRRGGPNYQTGLAKMRALGDELGVPLEVYGPEATMTGIC

SEQ ID NO: 7958 - protein, 421 aa, Vinca minor
MARKKIREFDSKRLLKEHLKRLVGINLQICSAQVNQDTDFVELTNKETWLSSTKLVVKPDMLFGKRGKSGLVALNLDLAQVADFVKARLGKEVEMGGCKAPITTFIVEPFVPHDQEYYINIVSERLGSSISFSECGGIEIEDNWDKVKTIFLPTEKPLTLEACAPLIATLPLEVRGKIGDFIMGVFAVFQDLDFTFLEMNPFTLLNGEPFPLDMRGELDDTAAFKNFKKWGSIEFPLPFGRVLSPTESFIHSLDEKTSASLKFTVLNPKGRIWTMVAGGGASVIYADTVGDLGYASELGNYAEYSGAPNEEEVLQYARVVIDCATANPDGRKRGLLIGGGIANFTDVAATFNGIIRALREKESKLKAARMHLYVRRGGPNYQSGLAKMRVLGEELGVPLEVYGPEATMTGICKQAIECIMS

SEQ ID NO: 7959 - protein, 424 aa, Brassica rapa
MARKKIREYDSKRLIKEHLKRLANINLQTRSAQVTEATDFNELTNQEAWLSSTKLVVKPDMLFGKRGKSGLVALKLDLAEVAEFVKARLGSEVEMGGCKAPITTFIVEPFVPHDQEYYLSIVSDRLGCTISFSECGGIEIEENWDKVKTVFLPAEKSMTLEVCAPLIATLPLEVRGIIGSFIMGVFAVFQDLDFSFMEMNPFTLVDGEPYPLDMRGELDDTAAFKNFNKWGDIEFPLPFGRVLSPTESFIHGLDEKTSASLKFTVLNPKGRIWTMVAGGGASVIYADTVGDLGYASELGNYAEYSGAPNEEEVLQYARVVIDCATADPDGRKRALLIGGGIANFTDVAATFNGIIRALREKETRLKASRMHIYVRRGGPNYQTGLARMRALGDELGVPLEVYGPEATMTGICKRAIDCIMLPDA

SEQ ID NO: 7960 - protein, 419 aa, Flaveria ramosissima
RKKIREYDSKRLLKQNLKTLAGIDLHICSAQVTASTDFTDLTDKEPWLSSTKLVVKPDMLFGKRGKSGLVGLNLDVAQVADFVKARLGAEVEISGCKAPITTFIVEPFVPHDQEYYFSIVSERLGSTISFSECGGIDIEENWEKVKTVFLPTEKPMTLETCAPLIATLPLEVRAKIGNFIMGVFAVFQDLDFTFLEMNPFTLVNGEPFPLDMRGELDDTAAFKNFKKWGNIEFPLPFGRVLSSTESFIHTLDEKTSASLKFTVLNPKGRIWTMVAGGGASVIYADTVGDLGYASELGNYAEYSGAPNEEEVLQYARIVIDCATADPDGRKRALLIGGGIANFTDVAATFSGIIRALREKESKLKAARMHIYVRRGGPNYQTGLAKMRALGEELGIPLEVYGPEATMTGICKEAIECIMS

SEQ ID NO: 7961 - protein, 423 aa, Silene vulgaris
MARKKIREYDSKRILKQHLKRIANIDLPICSAQVTESTDFTQLVNEETWLSSSRLVVKPDMLFGKRGKSGLVALNLDLAQVADFVKERVGKEVEIGGCKAPVTTFIVEPFVPHEQEFYLSVVSERLGCTISFSECGGIEIEENWDKVKTIFLPSEKSLTNEACAPLIATLPLEIRDKIGDFIKGVFAVFLDLDFSFLEMNPFTLVNGEPYPLDMRGELDDTAAFKNFNKWGNIEFPLPFGRVLSPTEGFIHALDEKTSASLKFTILNPKGRIWTMVAGGGASVIYADTVGDLGYASELGNYAEYSGAPNEEEVLQYARVVIDCATANPDGRKRALLIGGGIANFTDVAATFSGIIRALREKETKLKAARMHIFVRRGGPNYQTGLAKMRALGEELGIPLEVYGPEATMTGICKQAIDCIMAKD

SEQ ID NO: 7962 - protein, 391 aa, Secale cereale
QVTQSTDFTELSNQEPWLSSTKLVVKPDMLFGKRGKSGLVALNLDLAQVRQFVKERLGVEVEMGGCKAPITTFIVEPFVPHDQEYYLSIVSDRLGCTISFSECGGIEIEENWDKVKTIFLPTEKPMTLDACAPLIATLPLEVRTKIGDFIRGSFSVFQDLDFSFMEMNPFTLVNGEPYPLDMRGELDDTAAFKNFKKWGDIEFPLPFGRVLSPSESYIHELDEKTSASLKFTVLNPKGRIWTMVAGGGASVIYADTVGDLGYASELGNYAEYSGAPKEEEVLHYARVVLDCATADPDGRKRALLIGGGIANFTDVAATFSGIIRALREKESKLKAARVNIYVRRGGPNYQTGLAKMRALGSELGLPIEVYGPEATMTGICKQAIDCVMAEA

SEQ ID NO: 7963 - protein, 159 aa, Flaveria ramosissima
MARKKIREYDSKRLLKENLKRLAGIDLQICSAQVDASTDFTELTDKEPWLSSTKLVVKPDMLFGKRGKSGLVGLNLDVAQVADFVKARLGAEVEISGCKAPITTFIVEPFVPHDQEYYFSIVSERLGSTISFSECGGIDIEETREKVKTVFLPTENLSR

SEQ ID NO: 7964 - protein, 422 aa, Beta vulgaris
MARKKIREYDSKRLLKQHLKRIANIDLPICSAQVTGSTDFTQLVNDETWLSSSRLVVKPDMLFGKRGKSGLVALNLDLAQVSEFVKERIGKEVEIEGCKAPVTTFIVEPFVPHKQEFYLSIVSERLGCTLSFSECGGIEIEENWDKVKTVFLPTEKPLTSDTCAPLIATLPLEIRDKIGDFIKGVFAVFQDLDFSFLEMNPFTLVNGEPYPLDMRGELDDTAAFKNFKKWGDLEFPLPFGRVLSSTEGYIHSLDEKTSASLKFTILNPKGRIWTMVAGGGASVIYADTVGDLGYASELGNYAEYSGAPNEEEVLQYARVVIDCATANPDGRKRALLIGGGIANFTDVAATFSGIIRALREKESKLKAARMHLFVRRGGPNYQTGLKKMRALGEELGVPIEVYGPEATMTGICKQAIDCIMKD

SEQ ID NO: 7965 - protein, 423 aa, Chenopodium quinoa
MARKKIREYDSKRLLKQHLKRIAGIDLPICSAQVTGSTDFTQLVNDETWLSSSRLVVKPDMLFGKRGKSGLVALNLDLAQVAEFVKERIGKEVEVGGCKAPVTTFIVEPFIPHEQEFYLSIVSERLGCTVSFSECGGIEIEENWDKVKTIFLPTEKPLTSETCAPLIATLPLETRGKIGDFIKGVFEVFQDLDFSFLEMNPFTLVNGEPLPLDMRGELDDTAAFKNFKKWGDIEFPLPFGRVLSSTEDYIHSLDEKTSASLKFTILNPKGRIWTMVAGGGASVIYADTVGDLGYASELGNYAEYSGAPNEEEVLNYARVVIDCATANPDGRKRALLIGGGIANFTDVAATFNGIIRALREKESKLRAARMNLFVRRGGPNYQTGLKKMRALGEELGVPIEVYGPEATMTGICKQAIDCIMAQE

SEQ ID NO: 7966 - protein, 423 aa, Zostera marina
MARKKIREYDSKRLLKEHLKRLAGIDLQILSAQVTEATDFTQLVDAQPWLSSTKLVVKPDMLFGKRGKSGLVALNLDMAEVSHFVKQRLGVEVEMGGCKAPITTFIVEPFVPHEQEFYLSIVSERLGCTLSFSECGGVEIEENWDKVKTVFLPTDKPLTLEACAPLIATLRLEVRGIIGDFIKGVFSVFQDLDFSFLEMNPFTIVDGKPYPLDMRGELDDTAAFKNFKKWGDLEFPLPFGRVLSPTEGFIHGLDEKTSASLKFTVLNSKGRIWTMVAGGGASVIYADTVGDLGYASELGNYAEYSGAPNEDEVLQYARVVIDCATADPRGEKRVLLIGGGIANFTDVAATFNGIIRALREKESKLKASRMHIYVRRGGPNYQTGLAKMRLLGEELGVPLEVYGPEATMTGICKQAIDTIMSAA

SEQ ID NO: 7967 - protein, 1098 aa, Ricinus communis
MADRNANVRPPNGKPSGGTNPYLIDLDNFTKRLKMLYLHWSENNIELWGASDALAVATPPPSEDLRYLKSTALNIWLVGYEFPETIMVFMKKQVHFLCSQKKASLLDVVKKPAKESIGVEVVMHVKTKSDDGSSLMDNIFNAVHASSGDKTPVIGHIARESPEGKLLEIWDKKLKNGNCELSDVTNGFSDLFAVKDNTELTYVRKAAFLTSSVMKQFVVPKLEKVIDEEKKITHSSFMDETEKAILEPARIKVKLKAENIDICYPPIFQSGGEFDLKPSAASNDDNLYYDSTSVIICAIGSRYNSYCSNVARTFLIDANSMQSKAYEVLLRAQEAAISALKSGNQVSAVYLAALSVVEKDAPELAANLTKTAGTGIGLEFRESGLSLSSKNNRILRPGMVFNVSLGFQNLHTETNKPKTQKFSVLLADTVIVGEKLPDVVTSKSSKAFKDVAYSFNEDDDEEEELSKARVEVKGGEATLSKATLRSDNHEMSKEELRRQHQAELARQKNEETARRLAGGGSSASDNRGSVKMIGDLIAYKNVNDLPPPRDLMIQVDQKNEAILIPIHGSMVPFHVATVKSVSSQQDSNRTCYIRITFNVPGTPFSPHDANTLKFQGSIYLKEISFRSKDSRHISEVVQQIKTLRRQVTSRESERAERATLVTQEKLQLASTKFKPIKLYDLWIRPVFGGRGRKLTGSLEAHVNGLRYSTSRPDERIDVMYSNIKHAFFQPADKEMITLLHFHLHNHIMVGNKKTKDVQFFIEVMDIVQTLGGGKRSAYDPDEIEEEQRERDRKNKINMDFQNFVNRVNDVWGQPQFRGLDLEFDQPLRELGFHGVPHKASAFIVPTSSCLVELIETPVVVITLSEIEIVNLERIGLGQKNFDMTIVFKDFKRDVLRIDSIPSTSLDSIKEWLNTTDLKYYESRLNLNWRPILKTITDDPEKFIEDGGWEFLNMEVSDSDSENSADSDHGYVPSDVQSDSGSEDEDDGSESLVESEDDEDEDSEEDSEEDEGKTWEELEREASYADREKGDDSDSEEERKRRKMKAFGKARAPLSRAPPPRAPLSRAPLPRAPPSRAPPPRAPDRRNSGGSLPKRPKLR

SEQ ID NO: 7968 - protein, 423 aa, Lupinus angustifolius
MARKKIREFHSKKLIKEHLKRIASIHLDTLSAQVTESTDFTELTKQYPWISTTKLVVKPDMLFGKRGKSGLVALNLDIAQVAKFVNTRLGVQVEIGGCKAPITTFIVEPFVPHDDEYYLSIVSERLGCTINFSECGGIEIEENWDKVKTIFLPTEKTMTLEACAPLIATLPLEIRGIIGDFIMGVFAVFQDLDFSFLEMNPFTLVNEKPYPLDMRGELDDTAAFKNFNKWGKIEFPLPFGRVLSPAESFINSFDEKTSASLKFTVLNPKGRIWTMVAGGGASVIYADTVGDLGYASELGNYAEYSGAPNEDEVLQYARVVIDCATADPDGRKRALLIGGGIANFTDVAATFSGIIRALKEKESKLKAARMNIYVRRGGPNYQTGLAKMSALGEELGLPIQVYGPEATMTSICKQAIDCIISEA

SEQ ID NO: 7969 - protein, 410 aa, Flaveria ramosissima
MARKKIREYDSKRLLKQNLKRLAGIDLHICSAQVTASTDFTDLTDKEPWLSSTKLVVKPDMLFGKRGKSGLVGLNLDVAQVADFVKARLGAEVEISGCKAPITTFIVEPFVPHDQEYYFSIVSERLGSTISFSECGGIDIEENWEKVKTVFLPTEKPMTLETCAPLIATLPLEVRAKIGNFIMGVFAVFQDLDFTFLEMNPFTLVNGEPFPLDMRGELDDTAAFKNFKKWGNIEFPLPFGRVLSSTESFIHTLDEKTSASLKFTVLNPKGRIWTMVAGGGASVIYADTVGDLGYASELGNYAEYSGAPNEEEVLQYARIVIDCATADPDGRKRALLIGGGIANFTDVAATFSGIIRALREKESKLKAARMHIYVRRGGPNYQTGLAKMRALGEGLGIPLEVYGPEATMTG

SEQ ID NO: 7970 - protein, 363 aa, Amorphophallus konjac
MLFGKRGKSGLVALNLDLAQVAQFVKQRLGVVVEMGGCKAPITTFIVEPFVPHDQEFYLSMVSERIGCTISFSECGGIEIEENWDKVKSIFLPTEKPMTSEACAPLIATLPLEIRGKIGDFIKGAFAVFQDLDFTFLEMNPFTLVNGEPYPLDMRGELDDTAAFKNFKKWGNIEFPLPFGRVLSATESFIHGLDEKTSASLKFTVLNPKGRIWTMVAGGGASVIYADTVGDLGYASELGNYAEYSGAPNEEEVLQYSRVVIDCATADPDGRKRALLIGGGIANFTDVATTFNGIIRALREKESKLKAARMHIYVRRGGPNYQTGLARMRALGDELGIPFEVYGPEATMTGICKQAINCIMSAA

SEQ ID NO: 7971 - protein, 210 aa, Humulus lupulus
AGIDLQICSAQVNEATDFTELTNQQPWLSSTRLVVKPDMLFGKRGKSGLVALNLDLAQVAEFVKARLGKEVEMGGCKAPITTFIVEPFVPHSQEYYVSIVSDRLGSTISFSECGGIEIEENWDKVKTIFLPTEKSLTLDSCAPLIATLPLEVRGKIGDFLMGVFAVFQDLDFSFLEMNPFTLVNGEPYPLDMRGELDDTAAFKNFQSGEH

SEQ ID NO: 7972 - protein, 423 aa, Distylium racemosum
MARKKIREYDSKRVLKEHLKRLTGMQLDIKSAQVTESTDFNELADREPWLSSTRLVVKPDMLFGKRGKSGLVALNLDLAQVIAFVKERLGKEVEMGGAKAPITTFIVEPFVPHDAEFYISIMSERLGSTISFSECGGIEIEENWDKVKTIFVPTEKSLTSDLCAPLIATLALEVRGKIEAFIKGIFNVFLDLDFTFLEMNPFTLVNGEPYPLDMRGELDDTATFKNFKKWGNIEFPMPFGRVMSPAESAIHSMDEKTSASLKFTILNSKGRIWTMVAGGGASVIYADTVGDLGFANELGNYAEYSGAPNEDEVLQYARVLIDCATANPDGRKRALVIGGGIANFTDVAATFSGIIRALREKESKLKAARMNVYVRRGGPNYQNGLAKMRALGEEIGVPFEVYGPEASMTGICKQAIQYITATA

SEQ ID NO: 7973 - protein, 423 aa, Sequoia sempervirens
MARKKIREYDSKRLLKEHLKRLAGMQLDIKSAQVTESTDFNELADREAWLSSTKLVVKPDMLFGKRGKSGLVALNLDLAQVASFVKERLGKEIEMGGAKAPITTFIVEPFVPHNAEYYISIVSDRLGSTISFSECGGIEIEENWDKVKTVFVPTEKPLTAESCAPLIATLPLEIRGKIEAFIMGTFDVFQDLDFTFLEMNPFTLVNGEAYPLDMRGELDDTAAFKNFKKWGNIEFPMPFGRVMSPSESAIHAMDEKTSSSLKFTILNPKGRIWTMVAGGGASVIYADTVGDLGFANELGNYAEYSGAPNEDEVLQYARVLIDCATASPDGRKRALVIGGGIANFTDVAATFNGIIRALREKESKLKAARMQVYVRRGGPNYQNGLAKMRALGNEMGVPFEVYGPEASMTGICKQAIDYITASA

SEQ ID NO: 7974 - protein, 423 aa, Podocarpus macrophillus
MARKKIREYDSKRLLKEHLKRLAGMQLDIKSAQVTEATDFNELADREPWLSSTRLVVKPDMLFGKRGKSGLVALNLDLAQVYAFVKERLGKEVDMGGAKAPITTFIVEPFVPHDTEYYMSIVSERLGSTISFSECGGIEIEENWDKVKTIFVPTEKSLTSELCAPLIATLPLEIRGKIEAFIKGVFSVFLDLDFTFLEMNPFTLVNEEPYPLDMRGELDDTAGFKNFKKWGNIEFPQPFGRVMNPSESAIHGMDEKTSASLKFTILNPKGRIWTMVAGGGASVIYADTVGDLGFASELGNYAEYSGAPNEDEVLQYARILIDCATANPDGHKRALVIGGGIANFTDVAATFSGIIQALREKESKLKAARMQVYVRRGGPNYQSGLVKMRALGNEIGVPFEVYGPEASMTGICKQAIEYITASA

SEQ ID NO: 7975 - protein, 363 aa, Euphorbia peplus
MLFGKRGKSGLVALNLDLAQVAGFVKERLGKEVEMGGCKGPITTFIVEPFIPHNEEFYLNIVSERLGCSISFSECGGIDIEENWDKVKTIFVPTGASFTSEVCAPLLTTLPLEVKGEIGEFIKVVFSLFQDLDFTFLEMNPFTFVNGKPYPLDMRGELDDTAAFKNFKKWSNIEFPMPFGRVMSATERFIHGLDEKTSASLKFTVLNPKGRIWTMVAGGGASVIYADTVGDLGFASELGNYAEYSGAPNEEEVLQYARVVIDCATSDPDGRKRALVVGGGIANFTDVAATFNGIIRALREKESKLKAARMHIYVRRGGPNYQRGLAKMRTLGEEIGIPIEVYGPEATMTGICKEAIQCISAAA

SEQ ID NO: 7976 - protein, 165 aa, Panax ginseng
MSPTESFIHSLDDKTSASLKFTVLNPKGRIWTMVAGGGASVIYADTVGDLGYASELGNYAEYSGAPNEEEVLQYARVVIDCATADPDGRKRALLIGGGIANFTDVAATFNGIIRALRERNQSLKLQGCISMFDEVVPIIRLVWQRCVPLERNWEFPLRSMDPKLR

SEQ ID NO: 7977 - protein, 403 aa, Brassica napus
LANINLQIRSAQVTEATDFTELTNQEAWLSSTKLVVKPDMLFGKRGKSGLVALKLDLAEVAEFVKARLGSEVEMGGCKAPITTFIVEPFVPHDQEYYLSVVSDRLGCTISFSECGGIEIEENWDKVKTVFLPAEKPMTLEVCAPLIATLPLEVRGKIGSFIMGVFAVFQDLDFSFLEMNPFTLVDGEPYPLDMRGELDDTAAFKNFNKWGDIEFPLPFGRVLSPTESFIHGLDEKTSASLKFTVLNPKGRIWTMVAGGGASVIYADTVGDLGYASELGNYAEYSGAPNEEEVLQYARVVIDCATADPDGRKRALLIGGGIANFTDVAATFSGIIRALREKETRLKASRMHIYVRRGGPNYQTGLARMRALGDELGVPLEVYGPEATMTGICKRAIDCIMLPDA

SEQ ID NO: 7978 - protein, 423 aa, Cycas rumphii
MARKKIREYDSKRLLKEHLKRLADVQLDIQSAQVTESTDFNELADKEPWLSSTRLVVKPDMLFGKRGKSGLVALNLDLAQVAAFVKERLGKEVEMGGAKAPITTFIVEPFIPHDEEYYISIVSERLGSTISFSACGGIEIEENWDKVKTIFVPTEKTLSNELCASLIATLPLEVRGKIEAFIKNVYSVFLDLDFTFLEMNPFTLVNGKPYPLDMRGELDDTAAFKNFKKWGKIEFPIPFGRVMSPSESMIHALDEKTGASLKFTILNPKGHIWTMVAGGGASVIYADTVGDLGYASELGNYAEYSGAPNEDEVLHYARVLIDCATANPDGQKRALVIGGGIANFTDVASTFSGIIRALREKEAKLKASRMQVYVRRGGPNYQSGLAKMRALSEEIGVPFEVYGPDASMTGICKQAIDYITAAA

SEQ ID NO: 7979 - protein, 423 aa, Actinidia deliciosa
MARKKIREYDSKRLLKEHYKRLAGAELGIKSAQITESTDVNELVEKEPWLSSEKLVVKPDMLFGKRGKSGLVALNLDLAQVAVFVKERLGKEVEMGGCKGPITTFIVEPFVPHNEEFYLNIVSERLGCSISFSECGGIEIEENWDKVKTIFVPSGVSFTSETCAPLIATLPLEIKGEIEEFIKVIFALFIDLDFTFLEMNPFTLVNGKPYPLDMRGELDDTAAFKNFKKWGNIEFPLPFGRVMSSTESFIHGLDEKTSASLKFTVLNPKGRIWTMVAGGGASVIYADTVGDLGFASELGNYAEYSGAPNEEEVLQYARVVIDCATDDPDGHKRALVIGGGIANFTDVAATFNGIIRALKEKESKLKAARMHIYVRRGGPNYQRGLAKMRALGEEIGIPIEVYGPEATMTGICKEAIECITAAA

SEQ ID NO: 7980 - protein, 423 aa, Nicotiana benthamiana
MARKKIREYDSKRLLKEHFKRLAGYDLAIKSAQVTESTDLNELVEKEPWLSSTKLVVKPDMLFGKRGKSGLVALNLDLAEVASFVKERLGKEVEMGGCKGPITTFIVEPFVPHNEEFYLNIVSERLGFSVSFSECGGIDIEENWDKVKTIFLPTGTSFTSEICAPLVATLPLEIKGVIEEFLKVVYTLFQDLDFTFLEMNPFTLVEGKPYPLDMRGELDDTAAFKNFKKWGNIEFPLPFGRVMSATESFIHGLDEKTSASLKFTVLNPKGRIWTMVAGGGASVIYADTVGDLGYASELGNYAEYSGAPNEEEVLQYARVVIDCATADPDGRKRALVIGGGIANFTDVAATFSGIIRALKEKESKLKAARMHIYVRRGGPNFQKGLAKMRSLGEEIGIPIEVYGPEATMTGICKQAIECITAAA

SEQ ID NO: 7981 - protein, 390 aa, Allium cepa
MARKKIREYDSKRILKEHLKRIANIDLQILSAQVTPSTDFTELVDKEQWLSSMKLVVKPDMLFGKRGKSGLVALNLDMAQVAQFVKQRLGVEVEMGGCKAPITTFIVEPFVPHDQEYYLSIVSERLGCTISFSECGGIEIEENWDKVKTIFLPTEKSMTTEACAPLIATLPLEIRGKIGDFIKGVFAVFQDLDFTFLEMNPFTLVNGEPYPLDMRGELDDTAAFKNFIKWGDIEFPLPFGRVLSPTERYIHGLDEKTSASLKFTILNPKGRIWTMVAGGGASVIYADTVGDLGYASELGNYAEYSGAPNEEEVLQYARVVLDCATADPDGRKRALLIGGGIANFTDVAATFNGIIKALREKESKLKASRMNIFVRRGGPNYQTGLAKMRA

SEQ ID NO: 7982 - protein, 423 aa, Castanea mollissima
MARKKIREYDSKRLLKEHFKRLSGRELPIKSAQVTESTDFNELAQNEPWLSSMKLVVKPDMLFGKRGKSGLVALNLDLAQVATFVKERLGKEVEMGGCKGPITTFIVEPFIPHNEEFYLNIVSDRIGNSISFSECGGIEIEENWDKVKTIFIPTGVSLTSELCAPLVATLPMEIKVEIEEFIKTVFTLFQDLDFTFLEMNPFTLVDGKPYPLDMRGELDDTAAFKNFKKWGSIEFPMPFGRVMSPSESFIHGLDEKTSSSLKFTVLNPKGRIWTMVAGGGASVIYADTVGDLGYASELGNYAEYSGAPNEDEVLQYARVVLDCVTADPDGRKRALVIGGGIANFTDVAATFNGIIRALKEKESKLKAARVHIYVRRGGPNYQKGLAKMRGLGEEIGIPIEVYGPEATMTGICKQAIECITAAA

SEQ ID NO: 7983 - protein, 386 aa, Vaccinium corymbosum
MARKKIREYDSKRLLKEHYKRLAGKELAIKSAQITESTDVNELVEKEPWLSSEKLVVKPDMLFGKRGKSGLVALNLDLAEVAIFVKERLGKEVEMGGCKGPITTFIVEPFVPHNEEFYLNIVSERLGSSVSFSECGGIDIEENWDKVKTIFLPTGVAFTSEACAPLVATLPLEIKGEIEEFIKQVFALFSDLDFTFLEMNPFTLVNGKPYPLDMRGELDDTAAFKNFKKWGNIEFPMPFGRVMSPTESFIHGLDEKTSASLKFTVLNPKGRIWTMVAGGGASVIYADTVGDLGFASELGNYAEYSGAPNEEEVLQYARVVIDCATADPDGQKRALVIGGGIANFTDVAATFNGIIRALKEKESKLKAARMHIYVRRGGPNYQKGAR

SEQ ID NO: 7984 - protein, 423 aa, Euonymus alatus
MARKKIREYDSKRLLKEHFKRLAGYELPIKSAQVTESTNFNELAEKEPWFSSGKLVVKPDMLFGKRGKSGLVALNLDLAQVATFVRERLGKEVEMGGCKGPITTFIVEPFIPHNEEFYLNIVSDRLGCSISFSECGGIEIEENWDKVKTIFVPTGVSLTPDVIAPLVATLPLEIKGVIEEFIKVVFALFQDIDFTFLEMNPFTLVDGKPYPLDMRGELDDTAAFKNFKKWGSIEFPMPFGRVMSPTESFIHGLDEKTSASLKFTVLNPKGRIWTMVAGGGASVIYADTVGDLGYASELGNYAEYSGAPNEEEVLQYARVVIDCATSDPDGRKRALVIGGGIANFTDVAATFNGIIRALKEKESKLKAARMSIYVRRGGPNYQKGLAKMRALGDEIGIPIEVYGPEETMTGICKQAIECITAAA

SEQ ID NO: 7985 - protein, 423 aa, Quercus alba
MARKKIREYDSKRLLKEHFKRLSGRELPIKSAQVTESTDFNELAQNEPWLSSMKLVVKPDMLFGKRGKSGLVALNLDLAQVVTFVKERLGKEVEMGGCKGPITTFIVEPFIPHNEEFYLNIVSDRIGNSISFSECGGIEIEENWDKVKTVFIPTGVSLTSELCAPLVATLPLEIKVEIEEFIKTVFTLFQDLDFTFLEMNPFALVDGKPYPLDMRGELDDTAAFKNFKKWGSIEFPMPFGRVMSPSESFIHGLDEKTSASLKFTVLNPKGRIWTMVAGGGASVIYADTVGDLGYASELGNYAEYSGAPNEDEVLQYARVVLDCVTADPDGRKRALVIGGGIANFTDVAATFNGIIRALKEKESKLKAARVHIYVRRGGPNYQKGLAKMRGLGEEIGIPIEVYGPEATMTGICKQAIECITAAA

SEQ ID NO: 7986 - protein, 423 aa, Petunia hybrida
MARKKIREYDSKRLLKEHFKRLAGYELAIKSAQVTESTDFNELTEKEPWLSSTKLVVKPDMLFGKRGKSGLVALNLDLAQVAAFVKERLGKEVEMGGCKGPITTFIVEPFVPHNEEYYLNIVSERLGCSVSFSECGGIDIEENWDKVKTIFVPTGTSFTSEICAPLVATLPLEIKGVIEEFLKVVYALFQDLDFTFLEMNPFTLVEGKPYPLDMRGELDDTAAFKNFKKWGNIEFPLPFGRVMSATESFIHGLDEKTSASLKFTVLNPKGRIWTMVAGGGASVIYADTVGDLGYASELGNYAEYSGVPNEEEVLQYARVVIDCATANPDGRKRALVIGGGIANFTDVAATFSGIIRALKEKESKLKAARMHIYVRRGGPNYQKGLAKMRALGEEIGIPIEVYGPEETMTGICKQAIECITAAA

SEQ ID NO: 7987 - protein, 423 aa, Tripterygium wilfordii
MARKKIREYDSKRLLKEHFKRLAGYELPIKSAQVTESTDFNELTEKEPWLSSEKLVVKPDMLFGKRGKSGLVALNLDLAQVATFVKERLGKEVEMGGCKGPITTFIVEPFIPHNEEFYLNIVSDRLGCSISFSECGGIEIEENWDKVKTIFVPTGVSLTPEVIAPLVATLPLEIKGVIEEFIKVVFTLFQDIDFTFLEMNPFTLVDGKPYPLDMRGELDDTAAFKNFKKWGSIEFPMPFGRVMSPTESFIHGLDEKTSASLKFTVLNPKGRIWTMVAGGGASVIYADTVGDLGYASELGNYAEYSGAPNEEEVLQYARVVIDCATSDPDGHKRALVIGGGIANFTDVAATFNGIIRALKEKESKLKAARMSIYVRRGGPNYQKGLAKMRALGDEIGIPIEVYGPEETMTGICKQAIECITAAA

SEQ ID NO: 7988 - protein, 423 aa, Valeriana officinalis
MARKKIREYDSKRLLKEHFKRLSGAELAIKSAQVTESTDFNELVESEPWLSSAKLVVKPDMLFGKRGKSGLVALNLDLAQVAQFVKERLGKEVEMGGCKGPITTFIVEPFVPHNEEFYLNIVSERLGCSISFSECGGIDIEENWDKVKTIFIPTGLSLTSEICAPLIATLPLEIKSVIEEFIKVIFTLFSDLDFTFLEMNPFTLVDSKPYPLDMRGELDDTAAFKNFKKWGNLEFPLPFGRVMSPTESFIHRLDEKTSASLKFTVLNPKGRIWTMVAGGGASVIYADTVGDLGYASELGNYAEYSGAPNEEEVLQYARVVLDCATADPDGRKRALVVGGGIANFTDVAATFNGIIRALKEKESKLKAARMHIYVRRGGPNYQKGLAKMRELGEQIGIPIEVYGPEETMTGICKQAIECITAAA

SEQ ID NO: 7989 - protein, 423 aa, Amaranthus tuberculatus
MARKKIREYDSKRLLKEHFKRISGSELPIRSAQIKESTDLNELIENEPWLSSEKLVVKPDMLFGKRGKSGLVALNLDFAQVSAFVKERLGKEVEMGGCKGPITTFIVEPFVPHNEEFYLNIVSERLGNSVSFSECGGIEIEENWDKVKTIFVPTGVSFTSEVCAPLVATLPLEVRGVIEEFIKNIFTLFLDLDFTFLEMNPFTLVNGKPYPLDMRGELDDTAAFKNFKKWGNIEFPLPFGRVMSPTETFVHGLDEKTSASLKFTVLNPKGRIWTMVAGGGASVIYADTVGDLGYASELGNYAEYSGAPNEEEVLQYARVVIDCATANPDGRKRALVIGGGIANFTDVAATFNGIIRALKEKESKLKAARMHIYVRRGGPNYQKGLAKMRMLGEEIGIPIEVYGPEATMTGICKQAIDCIDVAA

SEQ ID NO: 7990 - protein, 423 aa, Ricinus communis
MARKKIREYDSKRLLKEHFKRLSGYELPIKSAQVTESTDFNELAEKEPWLSSGKLVVKPDMLFGKRGKSGLVALNLDLAEVAIFVKERLGKEVEMGGCKGPITTFIVEPFIPHNEEFYLNMVSERLGCSISFSECGGIEIEENWDKVKTIFVPTGASFTSEVCAPLVATLPLEIKGELEQFIKVVFALFQDLDFTFLEMNPFTLVDGKPYPLDMRGELDDTATFKNFKKWGDIEFPMPFGRVMSPTESFIHGLDEKTSASLKFTVLNPKGRIWTMVAGGGASVIYADTVGDLGYASELGNYAEYSGAPNEEEVLQYARVVIDYATSNPDGRKRALVIGGGIANFTDVAATFNGIIRALREKESKLKAARMQIFVRRGGPNYQRGLAKMRILGEEIGIPIEVYGPEATMTGICKQAIDCITAAA

SEQ ID NO: 7991 - protein, 423 aa, Abies balsamea
MARKKIREYDSKRLLKEHLKRLTGMQLDIKSAQVTESTDFNELADKEPWLSSSRLVVKPDMLFGKRGKSGLVALNLDLAQVISFVKERLGKEVEMGGAKAPITTFIVEPFVPHDDEFYLSVMSERLGSTISFSECGGIEIEENWDKVKSVFVPTEKSLTPDLCAPLIATLPLEIRGKIEAFIKGVFNLFMDLDFTFLEMNPFTLVNGEPYPLDMRGELDDTAAFKNFKKWGSIEFPLPFGRVMSASESAIHGMDEKTSSSLKFTILNPKGRIWTMVAGGGASVIYADTVGDLGYANELGNYAEYSGAPNEDEVLHYARVLIDCATANPDGRKRALVIGGGIANFTDVSATFSGIIRALREKESKLKASRMQVYVRRGGPNYQNGLAKMRALGEQIGVPFQVYGPEASMTGICKQAIQNITATA

SEQ ID NO: 7992 - protein, 423 aa, Castanea mollissima
MARKKIREYDSKRLLKEHFKRLSGRELPIKSAQVTESTDFNELAQNEPWLSSMKLVVKPDMLFGKRGKSGLVALNLDLAQVATFVKERLGKEVEMGGCKGPITTFIVEPFIPHNEEFYLNIVSDRIGNSISFSECGGIEIEENWDKVKTIFIPTGVSLTSELSAPLVATLPMEIKVEIEEFIKTVFTLFQDLDFTFLEMNPFTLVDGKPYPLDMRGELDDTAAFKNFKKWGSIEFPMPFGRVMSPSESFIHGLDEKTSSSLKFTVLNPKGRIWTMVAGGGASVIYADTVGDLGYASELGNYAEYSGAPNEDEVLQYARVVLDCVTADPDGRKRALVIGGGIANFTDVAATFNGIIRALKEKESKLKAARVHIYVRRGGPNYQKGLAKMRGLGEEIGIPIEVYGPEATMTGICKQAIECITAAA

SEQ ID NO: 7993 - protein, 423 aa, Vigna unguiculata
MARKKIREYDSKRLLKEHFKRLCGKELAIKSAQINASTDFTELQEKEPWLSSSKLVVKPDMLFGKRGKSGLVALNLDFAQVVSFVKERLGKEVEMGGCKGPITTFIVEPFVPHDEEFYLNIVSERLGNSISFSECGGIEIEDNWDKVKTVFIPTGVSITSEIVAPLVATLPLEIKGEIEEFLRVVFTLFQDLDFTFLEMNPFTLVNGKPYPLDMRGELDDTAAFKNFKKWGDIEFPLPFGRVMSATESFIHGLDEKTSASLKFTVLNPKGRIWTMVAGGGASVIYADTVGDLGFASELGNYAEYSGAPKEDEVLQYARVVIDCATANPDGQKRALVIGGGIANFTDVAATFSGIIRALREKESKLKAARMNIYVRRGGPNYQKGLALMRALGDEIGIPIEVYGPEATMTGICKEAIQFITASA

SEQ ID NO: 7994 - protein, 423 aa, Pinus pinaster
MARKKIREYDSKRLLKEHLKRLTGSQVDIKSAQVTESTDFNELADREPWLSSSRLVVKPDMLFGKRGKSGLVALNLDLAQVIAFVKERLGKEVEMGGAKAPITTFIVEPFVPHDDEFYMSIVSERLGSTISFSECGGIEIEENWDKVKSVFIPTEKSLTAELCAPLIATLPLEIRVKIETFIKGVFNLFLDLDFTFLEMNPFTLVNGEPYPLDMRGELDDTAAFKNFKKWGAIEFPLPFGRVMSPSESAVHGMDEKTSSSLKFTILNPKGRIWTMVAGGGASVIYADTVGDLGFANELGNYAEYSGAPNEDEVLQYARVLIDCATADPDGRKRALVIGGGIANFTDVSATFSGIIRALREKESKLKASRMQVYVRRGGPNYQNGLAKMRALGEEIGVPFQVYGPEASMTGICKQAIESITASA

SEQ ID NO: 7995 - protein, 423 aa, Nicotiana benthamiana
MARKKIREYDSKRLLKEHFKRLAGYDLAIKSAQVTESTDLNELVEKEPWVSSTKLVVKPDMLFGKRGKSGLVALNLDLAEVASFVKERLGKEVEMSGCKGPITTFIVEPFVPHNEEFYLNIVSERLGCSVSFSECGGIDIEENWDKVKTIFLPTGTSFTSEICAPLVATLPLEIKGVIEEFLKVVYTLFQDLDFTFLEMNPFTLVEGKPYPLDMRGELDDTAAFKNFKKWGNIEFPLPFGRVMSATESFIHGLDEKTSASLKFTVLNPKGRIWTMVAGGGASVIYADTVGDLGYASELGNYAEYSGAPNEEEVLQYARVVIDCATADPDGRKRALVIGGGIANFTDVAATFSGIIRALKEKESKLKAARMHIYVRRGGPNYQKGLTKMRSLGEEIGIPIEVYGPEATMTGICKQAIECITAAA

SEQ ID NO: 7996 - protein, 423 aa, Olea europaea
MARKKIREYDSKRLLKEHFKRLSGSELAVKSAQVTESTDFNELVDKEPWLSSTKLVVKPDMLFGKRGKSGLVALNLDLAEVAAFVKERLGKEVEMGGCKGPITTFIVEPFVPHNEEFYLNIVSERLGCSISFSECGGIEIEENWDKVKTIFVPTGVSFTPELCAPLVATLPLEIKGVIEEFIKVIYALFLDLDFTFLEMNPFTLVNGKPYPLDMRGELDDTAAFKNFKKWGNIEFPMPFGRVLSATERFIHGLDEKTSASLKFTVLNPKGRIWTMVAGGGASVIYADTVGDLGYASELGNYAEYSGAPNEEEVLQYARVVIDCATADPDGRKRALVIGGGIANFTDVASTFNGIIRALKEKESKLKAARMHLYVRRGGPNYQKGLAKMRSLAEEIGLPIEVYGPEATMTGICKQAIECITAAA

SEQ ID NO: 7997 - protein, 423 aa, Picea glauca
MARKKIREYDSKRLLKEHLKRLTGLQVDIKSAQVTESTDFNELADREPWVSSSKLVVKPDMLFGKRGKSGLVALNLDLAQVIAFVKERLGKEVEMGGAKAPITTFIVEPFVPHDDEFYMSIMSDRLGSTISFSECGGIEIEENWDKVKSVFVPTEKSLTAELCAPLIATLPLEIRGKIETFIKGVFNLFLDLDFTFLEMNPFTLVNGEPYPLDMRGELDDTAAFKNFKKWGNIEFPLPFGRVMSPSESAIHGMDEKTSSSLKFTILNPKGRIWTMVAGGGASVIYADTVGDLGFANELGNYAEYSGAPNEDEVLQYARVLIDCATANPDGRKRALVIGGGIANFTDVSATFSGIIRALREKESKLKASRMQVYVRRGGPNYQNGLAKMRALGEEIGVPFQVYGPEASMTGICKQAIQNITAAA

SEQ ID NO: 7998 - protein, 423 aa, Tripterygium wilfordii
MARKKIREYDSKRLLKEHFKRLAGYELPIKSAQVTESTDFNELTVKEPWLSTGKLVVKPDMLFGKRGKSGLVALNLDLAQVATFVKERLGKEVEMGGCKGPITTFIVEPFISHNEEFYLNIVSDRLGCSISFSECGGIEIEENWDKVKTIFVPTGVSLTPEVIAPLVATLPLEIKSEIEEFIKVVFTLFQDIDFTFLEMNPFTLVDGKPYPLDMRGELDDTAAFKNFKKWGNIEFPMPFGRVMSSTESFIHGLDEKTSASLKFTVLNPKGRIWTMVAGGGASVIYADTVGDLGYASELGNYAEYSGAPNEEEVLQYARVVIDCATSDPDGHKRALVIGGGIANFTDVAATFNGIIRALKEKESKLKAARMSIYVRRGGPNYQKGLAKMRALGDEIGIPIEVYGPEATMTGICKQAIECITAAA

SEQ ID NO: 7999 - protein, 321 aa, Amsonia hubrichtii
MARKKIREYDSKRLLKEHFKRLSGYELGIKSAQVTEATDFNELVEKEPWLSSTKLVVKPDMLFGKRGKSGLVALNLDLAEVSGFVKERLGKEVEMGGCKGPITTFIVEPFVPHNEEFYLNIVSERLGCSISFSECGGIDIEENWDKVKTIFLPTGVSFTSEVCAPLVATLPLEVKNVIEEFIKVIYALFIDLDFTFLEMNPFTLVDGKPYPLDMRGELDDTAAFKNFKKWGNIEFPLPFGRVMSATETFIHGLDEKTSASLKFTVLNPKGRIWTMVAGGGASVIYADTVGDLGYASELGNYAEYSGAPNEEEVLQYARVVI

SEQ ID NO: 8000 - protein, 423 aa, Amaranthus tuberculatus
MARKKIREYDSKRLLKKHFKRIAGSELPIRSAQITELTDLNELIANEPWLSSEKLVVKPDMLFGKRGKSGLVALNLDFAQVSAFVKERLGKEVEMGGCKGPITTFIVEPFVPHNEEFYLNIVSERLGNSVSFSECGGIDIEENWDKVKTVYIPTGVSFTSEVCAPLVATLPLEVKGVIERFIKNIFSLFLDLDFTFLEMNPFTLVNGKPYPLDMRGELDDTAAFKNFKKWGNIEFPLPFGRVMSPTESFIHGLDEKTSASLKFTVLNPKGRIWTMVAGGGASVIYADTVGDLGYASELGNYAEYSGAPNEEEVLQYARVVIDCATANPDGRKRALVIGGGIANFTDVAATFNGIIRALKEKESKLKAARMHIYVRRGGPNYQKGLAKMRMLGEEIGIPIEVYGPEATMTGICKQAIDCIDVAA

SEQ ID NO: 8001 - protein, 423 aa, Cyclamen graecum
MARKKIREYDSKRLLKEHYKKLVGAELGIKSAQITESTDVNELVEKDPWLSSEKLVVKPDMLFGKRGKSGLVALNLDLAQVAIFVKERLGKEVEMGGCKGPITTFIVEPFVPHDEEFYINIVSERLGCSISFSECGGIEIEENWDKVKTIFVPTGVSFTSEVCAPLVATLPLEIKGVIEEFIKSVFTIFIDLDFTFLEMNPFTLVNGKPYPLDMRGELDDTATFKNFKKWGSIEFPLPFGRVMSSTESFIHGLDEKTSASLKFTVLNPKGRIWTMVAGGGASVIYADTVGDLGFASELGNYAEYSGAPNEEEVLQYARVVIDCATSDPDGRKRALVIGGGIANFTDVAATFNGIIRALKEKESKLKAARMHIYVRRGGPNYQRGLARMRQLGEEIGIPLEVYGPEATMTGICKEAIDCITAAA

SEQ ID NO: 8002 - protein, 423 aa, Fagus grandifolia
MARKKIREYDSKRLLKEHFKRLSGRDLPIKSAQVTESTDFNELAEKESWLSSTKLVVKPDMLFGKRGKSGLVALNLDLAQVATFVKERLGKEVEMGGCRGPITTFIVEPFIPHNEEFYLNIVSDRLGNSISFSECGGIDIEENWDKVKTIFVPTGVSLTAELCAPLVATLPMEIKVEIEEFIKTVFALFQDLDFTFLEMNPFALVDGKPYPLDMRGELDDTAAFKNFKKWGNIEFPMPFGRVMSPSENFIHGLDEKTSASLKFTVLNPKGRIWTMVAGGGASVIYADTVGDLGYAAELGNYAEYSGAPNEEEVLQYARVVLDCVTADPDGRKRALVIGGGIANFTDVAATFNGIIRALKEKESKLKAARVNIYVRRGGPNYQKGLAKMRALGEEIGIPIEVYGPEATMTGICKQAIECITVAA

SEQ ID NO: 8003 - protein, 423 aa, Cucumis sativus
MARKKIREYDSKRLLKEHFKRISGRQLPIQSAQVTESTDFNELVEKEPWLSSSKLVVKPDMLFGKRGKSGLVALNLDLAQVAAFVKERLGKEVTMGGCKGPITTFIVEPFIPHKEEYYLNIVSERLGCSISFSECGGIEIEENWDKVKTIFIPTGVSLTSETCAELVATLPLEIKGEIEEFIKAVYTLFQDLDFTFLEMNPFALVDGKPYPLDMRGELDDTAAFKNFKKWGSIEFPMPFGRVMSPTESFIHGLDEKTSASLKFTVLNPKGRIWTMVAGGGASVIYADTVGDLGYASELGNYAEYSGAPNEEEVLQYARVVIDCATADPDGQKRALVIGGGIANFTDVAATFNGIIRALKEKESRLKAARMSIYVRRGGPNYQRGLAKMRAVGEELGVPIEVYGPEATMTGICKQAIECITAAA

SEQ ID NO: 8004 - protein, 423 aa, Cucurbita pepo
MARKKIGEFDSKRLLKEHFKRISGRELPIQSAQVTESTDFNELVEREPWLSSSKLVVKPDMLFGKRGKSGLVALNLDLAQVAAFVKERLGKEVSIGGCKGPITTFIVEPFIPHSEEYYLNIVSERLGCSISFSECGGIEIEENWDKVKTIFIPTGVSLTSEICAELVATLPLEIKGEIEEFIRAVYTLFQDLDFTFLEMNPFAIVDGKPYPLDMRGELDDTAAFKNFKKWGGIEFPMPFGRVMSPTESFIHGLDEKTSASLKFTVLNPKGRIWTMVAGGGASVIYADTVGDLGYASELGNYAEYSGAPNEEEVLQYARVVIDCATADPDGQKRALVIGGGIANFTDVAATFNGIIRALKEKESRLKAARMNIYVRRGGPNYQRGLAKMRTLGEELGVPIEVYGPEATMTGICKQAIECITAAA

SEQ ID NO: 8005 - protein, 423 aa, Mimulus guttatus
MARKKIREYDSKRLLKEHYKRISGSELEIKSAQVTESTDFKELVDSEPWMSSTKLVVKPDMLFGKRGKSGLVALNLDLAGVAAFVKDRLGKEVEMGGCKGPITTFIVEPFVPHDEEYYLNIVSERLGCTISFSECGGIDIEENWDKVKTISVATGVAFTSEVCAPLVATLPLEIKTVIEDFIKVVYALFLDLDFTFLEMNPFTLVNGKPYPLDMRGELDDTATFKNFKKWGNIEFPLPFGRVMSPTESFIHGLDEKTSASLKFTVLNPKGRIWTMVAGGGASVIYADTVGDLGYASELGNYAEYSGAPNEEEVLQYARVVIDCATADPDGKRRALVIGGGIANFTDVAATFSGIIRALREKEAKLKAARMNLYVRRGGPNYQKGLEKMRTLAEEIGIPIEVYGPEATMTGICKQAIECISAAA

SEQ ID NO: 8006 - protein, 423 aa, Populus trichocarpa
MARKKIREYDSKRLLKEHFKRLSGRDLPIKSAQVTESTDFNELAEKEPWLSSAKLVVKPDMLFGKRGKSGLVALNLDLDQVADFVQQRLGKEVEMGGCKGPITTFIIEPFIPHDQEFYLNIVSERLGCSISFSECGGIEIEENWDKVKTIFVPTGATFTSEVCAPLVATIPLEIKGEIEEFIQSAFALFQDLDFTFLEMNPFTLVDGKPYPLDMRGELDDTAAFKNFKKWGNIEFPMPFGRVMSSTESFVHGLDEKTSASLKFTVLNPEGRIWTMVAGGGASVIYADTVGDLGYASELGNYAEYSGAPNEDEVLQYARVVIDCATSDPDGHKRALVIGGGIANFTDVAATFNGIIRALKEKESKLKAARMNIYVRRGGPNYQRGLAKMRALGEEIGIPIEVYGPEATMTGICKQAIECITAAA

SEQ ID NO: 8007 - protein, 417 aa, Pinus taeda
MARKKIREYDSKRLLKEHLKRLTGLQVDIKSAQVTESTDFNELADREPWLSSSRLVVKPDMLFGKRGKSGLVALNLDLAQVIAFVKERLGKEVEMGGAKAPITTFIVEPFVPHDDEFYMSIVSERLGSTISFSECGGIEIEENWDKVKSVFIPTEQSLTAELCAPLIATLPLEIRGKIETFIKGVFNLFLDLDFTFLEMNPFTLVNGEPYPLDMRGELDDTAAFKNFKKWGGIEFPLPFGRVMSPSESAVHSMDEKTSSSLKFTILNPKGRIWTMVAGGGASVIYADTVGDLGFANELGNYAEYSGAPNEDEVLQYARVLIDCATADPDGRKRALVIGGGIANFTDVSATFSGIIRALREKESKLKAARMQVYVRRGGPNYQNGLAKMRALGEEIGVPFQVYGPEASMTGICKQAIQ

SEQ ID NO: 8008 - protein, 89 aa, Secale cereale
MARKKIREYDSKRLLKEHLKRLAGIDLLILSAQVTQSTDFTELSNQEPWLSSTKLVVKPDMLLAAWEERPCSPQPRSCSSRHCQGAVRS

SEQ ID NO: 8009 - protein, 423 aa, Vicia sativa
MARKKIREYDSKRLLKEHFKRLSGKDLPIKSAQVTESTDFTQLQDKEPWLSSSKLVVKPDMLFGKRGKSGLVALNLDLAQVASFVKERLGKEVEMGGCKGPITTFIVEPFIPHNEEFYLNIVSDRLGNSISFSECGGIDIEENWDKVKTVFVPTGLSVTSEIVAPLVATLPLEIKGEIEEFLKVVFTLFQDLDFTFLEMNPFTLVDGKPYPLDMRGELDDTAAFKNFKKWGDIEFPLPFGRVMNATESFIHGLDEKTSASLKFTVLNPKGRIWTMVAGGGASVIYADTVGDLGFASELGNYAEYSGAPNEEEVLQYARVVIDCATADPDGRKRALVIGGGIANFTDVAATFSGIIRALKEKESKLKAARMHIYVRRGGPNYQKGLAKMRALGEEIGIPLEVYGPEATMTGICKEAIHCITASA

SEQ ID NO: 8010 - protein, 423 aa, Cedrus atlantica
MARKKIREYDSKRLLKEHLKRLTGMQVDIKSAQVTESTDFNELADREPWLSSSRLVVKPDMLFGKRGKSGLVALNLDLAQVMAFVKERLGKEVEMGGAKAPITTFIVEPFVPHDDEFYMSIMSERLGSTISFSECGGIEIEENWDKVKSVFVPTEKPLTAELCAPLIATLPLEVRGKIEAFIKGVFNLFLDLDFTFLEMNPFTLVNGEPYPLDMRGELDDTAAFKNFKKWGSIEFPLPFGSILSPSESAIHGMDEKTSASLKFTILNPKGRIWTMVAGGGASVIYADTVGDLGFANELGNYAEYSGAPNEDEVLQYARVLIDCATANPDGRKRVLVIGGGIANFTDVSATFNGIIRALREKESKLKASRMEVYVRRGGPNYQNGLAKMRALGEEIGVPFQVYGPEASMTGICKQAIQSITASA

SEQ ID NO: 8011 - protein, 423 aa, Panax ginseng
MARKKIREYDSKRLLKEHFKRISGSDLAIKSAQITESTDVNELVETEPWLSSSKLVVKPDMLFGKRGKSGLVALNLDLAQVADFVKERLGKEVEMGGCKGPITTFIVEPFVPHNEEFYLNMVSERLGCSISFSDCGGIEIEENWDKVKTIFVPTGVFLTPEICAPLVATLPLEIKGVIEEFIKLIFTLFADLDFTFLEMNPFTLVEGHPYPLDMRGELDDTAAFKNFKKWGNIEFPLPFGRVMSPTESFIHGLDEKTSASLKFTVLNPKGRIWTMVAGGGASVIYADTVGDLGYAAELGNYAEYSGAPNEEEVLQYARVVIDCATADPDGRKRALVVGGGIANFTDVAATFNGIIRALKEKESKLKAANMHIYVRRGGPNYQRGLAKMRTLGEEIGIPIEVYGPEETMTGICKQAIECISAAA

SEQ ID NO: 8012 - protein, 423 aa, Arachis hypogaea
MARKKIREYDSKRLLKEHFKRLSGRDLQIKSAQVTSSTDFAELQEKEPWLSSSKLVVKPDMLFGKRGKSGLVALNLDLAQVASFVKERLGTEVEMSGCKGPITTFIVEPFVPHKEEFYLNIVSERLGNSISFSECGGIEIEENWDKVKTVFVPTGASFTSETIAPLVATLPLEIKGEIEEFLKVVFNIFQDLDFTFLEMNPFTLVDGKPYPLDMRGELDDTAAFKNFKKWGDIEFPLPFGRVMSATEAFIHGLDEKTSASLKFTVLNPKGRIWTMVAGGGASVIYADTVGDLGFASELGNYAEYSGAPKEDEVLQYARVVIDAATADPDGQKRALVIGGGIANFTDVAATFSGIIRALKEKEAKLKAARMQIYVRRGGPNYQKGLEKMRALGEELGIPIEVYGPEATMTGICKQAIEYITAAA

SEQ ID NO: 8013 - protein, 423 aa, Solanum tuberosum
MARKKIREYDSKRLLKEHFKRLGGYDLAIKSAQVTESTDINELAEKEPWLNSTKLVVKPDMLFGKRGKSGLVALNLDLAQVATFVKERLGKEVEMGGCKGPITTFIVEPFIPHNEEFYLNIVSERLGCSVSFSECGGIDIEENWDKVKTIFVPTGTSFTSEICAPLVATLPLEIKGVIEEFLKVIYTLFQDLDFTFLEMNPFTLVEGKPYPLDMRGELDDTAAFKNFKKWGNIEFPLPFGRVMSASESFIHGLDEKTSASLKFTVLNPMGRIWTMVAGGGASVIYADTVGDLGYASELGNYAEYSGAPNEEEVLQYARVVIDCATANPDGRKRALVIGGGIANFTDVAATFSGIIRALKEKESKLKAASMNIYVRRGGPNYQKGLAKMRSLGEEIGIPIEVYGPEETMTGICKQAIECITAAA

SEQ ID NO: 8014 - protein, 423 aa, Sesamum indicum
MARKKIREYDSKRLLKEHFKRLSGSELEIKSAQVTESTDFKELVDREPWLSSTKLVVKPDMLFGKRGKSGLVALNLDLAGVAAFVKERLGKEVEMGGCKGPITTFIVEPFVPHNEEFYLNIVSERLGCSISFSECGGIEIEENWDKVKTIFVPTGVAFTSELCAPLVATLPLEIKGVIEEFIKVIYDLFLDLDFTFLEMNPFTLVNGRPYPLDMRGELDDTAAFKNFKKWGNIEFPMPFGRVMSPTESFIHGLDEKTSASLKFTVLNPKGRIWTMVAGGGASVIYADTVGDLGYASELGNYAEYSGAPNEEEVLQYARVVIDCATAEPDGRKRALVIGGGIANFTDVAATFSGIIRALKEKEAKLKAARMHLYVRRGGPNYQKGLARMRSLAEEIGIPIEVYGPEATMTGICKQAIECISAAA

SEQ ID NO: 8015 - protein, 423 aa, Trigonella foenum-graecum
MARKKIREYDSKRLLKEHFKRLSGKDLPIKSAQVTESTDFTELQDKEPWLSSSKLVVKPDMLFGKRGKSGLVALNLDLAQVASFVKERLGKEVEMGGCKGPITTFIVEPFIPHNEEFYLNIVSDRLGNSISFSECGGIDIEENWDKVRTVFVPTGVSLTSEIVAPLVATLPLEIKGEIEEFLKVIFTLFQDLDFTFLEMNPFTLVDGKPYPLDMRGELDDTAAFKNFKKWGNIEFPLPFGRVMSATESFIHGLDEKTSASLKFTVLNPKGRIWTMVAGGGASVIYADTVGDLGFANELGNYAEYSGAPKEEEVLQYARVVIDCATADPDGQKRALVVGGGIANFTDVAATFSGIIRALKEKESKLKAARMHIYVRRGGPNYQKGLAKMRELGEEIGIPIEVYGPEATMTGICKEAIQCITASA

SEQ ID NO: 8016 - protein, 423 aa, Citrullus lanatus
MARKKIREYDSKRLLKEHFKRISGRELPIQSAQVTESTDFNELVEREPWLSSSKLVVKPDMLFGKRGKSGLVALNLDLAQVAAFVKERLGKEVTMGGCKGPITTFIVEPFIPHNEEYYLNIVSERLGCSISFSECGGIEIEENWDKVKTIFIPTGVSLTSETCGELVATLPLEIKGEIEEFIKAVYTLFQDLDFTFLEMNPFAIVDGKPYPLDMRGELDDTAAFKNFKKWGSIEFPMPFGRVMSPTESFIHGLDEKTSASLKFTVLNPKGRIWTMVAGGGASVIYADTVGDLGYASELGNYAEYSGAPNEEEVLQYARVVIDCATADPDGQKRALVIGGGIANFTDVAATFNGIIRALKEKESRLKAARMSIYVRRGGPNYQRGLAKMRALGEELGVPIEVYGPEATMTGICKQAIECITAAA

SEQ ID NO: 8017 - protein, 423 aa, Beta vulgaris
MARKKIREYDSKRLMKEHYKRIAGSQLPIKSAQITESTDLNELVANEPWLSSEKLVVKPDMLFGKRGKSGLVALNLDFAQVADFVKERLGKEVEMGGCKGPITTFIVEPFVPHNEEFYLNIVSDRLGNSISFSECGGIEIEENWDKVKTIFVPTGISFTSEICAPLVATLPLEVKGVIEEFIKVIFTLFLDLDFTFLEMNPFTLVNGNPYSLDMRGELDDTAAFKNFKKWGNIEFPLPFGRVMSPTESFVHGLDEKTSASLKFTVLNPKGRIWTMVAGGGASVIYADTVGDLGYASELGNYAEYSGAPNEEEVLQYARVVIDCATADPDGRKRALVVGGGIANFTDVAATFNGIIRAMKEKESKLKAARMHIYVRRGGPNYQKGLAKMRMLGEEIGIPIEVYGPEATMTGICKQAIECIEVAA

SEQ ID NO: 8018 - protein, 423 aa, Cannabis sativa
MARKKIREYDSKRLLKEHFKRISGRDLPIKSAQINESTDFNELANKETWLSSSKLVVKPDMLFGKRGKSGLVALNLDYAQVATFVKERLGKEVEMGGCKGPITTFIVEPFIPHNEEFYLNIVSERLGSSLSFSECGGIDIEENWDKVKTIFVPTGATFTSEVCAPLVATLPLEIKAEIEEFIKSVFALFQDLDFTFLEMNPFALVDGKPYPLDMRGELDDTAAFKNFKKWGNIEFPMPFGRVMSPTESFIHGLDEKTSASLKFTVLNPKGRIWTMVAGGGASVIYADTVGDLGYANELGNYAEYSGAPNEEEVLQYARVVIDCATADPDGRKRALVVGGGIANFTDVAATFNGIIRAFKEKESKLKAARMHIYVRRGGPNYQRGLAKMRALGDEIGIPIEVYGPEATMTGICKEAIQCITAAA

SEQ ID NO: 8019 - protein, 423 aa, Cephalotaxus harringtonia
MARKKIREYDSKRLLKEHLKRLAGIQLEIKSAQVTGSTNLNELADNEPWLSASRLVVKPDMLFGKRGKSGLVALNLDLAQGAAFVKERLGKEVEMGGARAPITTFILEPFIPHDEEYYLSIISDRLGFTISFSACGGIEIEENWDKVKTIFVPTEKSLTAELCAPLIATLPLEIRGKIENFIAGVYKVFLDLDFTFLEMNPFTFVDGKPYPLDMRGELDDTAAFKNFKKWSNIEFPMPFGRVMSPAEDLVHNMDEKTSASLKFTILNPKGRIWTMVAGGGASVIYADTVGDLGYASELGNYAEYSGAPNEEEVLYYARVLIDCATANPDGRKRALLIGGGIANFTDVAATFNGIIRALREKESKLKASRMNIYVRRGGPNYQSGLAKMRALSEEIGVPIEVFGPEASMTGICKQAIEYITAAD

SEQ ID NO: 8020 - protein, 423 aa, Vitis vinifera
MARKKIREYDSKRLLKEHFKRLSGTDLPIKSAQITESTDFNELAEKEPWLLSGKLVVKPDMLFGKRGKSGLVALNLDLAQVGTFVKERLGKEVEMGGCRGPITTFIVEPFIPHNEEFYLNMVSERLGSSISFSECGGIEIEENWDKVKTIFIPTGATFTSEICSPLVATLPLEIKGKIEEFIKVVFALFLDLDFTFLEMNPFTLVDGKPYPLDMRGELDDTAAFKNFKKWGNIEFPMPFGRVMSPTETFIHGLDEKTSASLKFTVLNPKGRIWTMVAGGGASVIYADTVGDLGYASELGNYAEYSGAPNEEEVLQYARVVIDCATANPDGLKRALVIGGGIANFTDVAATFNGIIRALKEKESKLKASRMHIYVRRGGPNYQRGLAKMRTLGEEIGIPLEVYGPEATMTGICKQAIECIGAAA

SEQ ID NO: 8021 - protein, 423 aa, Lupinus angustifolius
MARKKIREYDSKRLVKEHYKRLSGNDLPIKSAQVTESTDLVELQEKEPWLSSSKLVVKPDMLFGKRGKSGLVALNLDLAQVASFVKERLGNEVEMSGCKGPITTFIVEPFIPHNEEFYLNIVSERLGNSISFSECGGIEIEENWDKVKTVFVPTGVSLTSEIIAPLVATLPLEIKGEIEEFLNVIFNLFQDLDFTFLEMNPFTLVNGKPYPLDMRGELDDTAAFKNFKKWGNIEFPLPFGRVMSPTESFIHGLDEKTSASLKFTVLNPKGRIWTMVAGGGASVIYADTVGDLGFANELGNYAEYSGAPKEDEVLQYARVVIDCATANPDGQKRALVIGGGIANFTDVAATFSGIIRALKEKESKLKAARMHIYVRRGGPNYQKGLAKMRALGEDIGIPIEVYGPEATMTGICKEAIQCITASA

SEQ ID NO: 8022 - protein, 423 aa, Cucumis melo
MARKKIREYDSKRLLKEHFKRISGRELPIQSAQVTESTDFNELVEKEPWLSSSKLVVKPDMLFGKRGKSGLVALNLDLAQVAAFVKERLGKEVTMGGCKGPITTFIVEPFIPHKEEYYLNIVSERLGCSISFSECGGIEIEENWDKVKTIFIPTGVSLTSETCAELVATLPLEIKGEIEEFIKAVYTLFQDLDFTFLEMNPFAIVDEKPYPLDMRGELDDTAAFKNFKKWGSIEFPMPFGRVMSPTESFIHGLDEKTSASLKFTVLNPKGRIWTMVAGGGASVIYADTVGDLGYASELGNYAEYSGAPNEEEVLQYARVVIDCATADPDGQKRALVIGGGIANFTDVAATFNGIIRALKEKESRLKAARMSIYVRRGGPNYQRGLAKMRAVGEELGVPIEVYGPEATMTGICKQAIECITAAA

SEQ ID NO: 8023 - protein, 423 aa, Nicotiana benthamiana
MARKKIREYDSKRLLKEHFKRLGGYDLAIKSAQVTESTDFNELAEKEPWLNSSKLVVKPDMLFGKRGKSGLVALNLDLAQVATFVKERLGKEVEMGGCKGPITTFIVEPFIPHNEEFYLNIVSDRLGCSVSFSECGGIDIEENWDKVKTIFVPTGTSFTSEICAPLVATLPLEIKGVIEDFLKVVYTLFQDLDFTFLEMNPFALVEGKPYPLDMRGELDDTAAFKNFKKSGNIEFPLPFGRVMSATESFIHGLDEKTSASLKFTVLNPKGRIWTMVAGGGASVIYADTVGDLGYASELGNYAEYSGAPNEEEVLQYARVVIDCATANPDGRKRALVIGGGIANFTDVAATFSGIIRALKEKESKLKAARMQIFVRRGGPNYQKGLAKMRSLGEEIGIPIEVYGPEATMTGICKQAIECITAAA

SEQ ID NO: 8024 - protein, 423 aa, Lippia dulcis
MARKKIREYDSKRLLKEHFKRISGSELEIKSAQVTEDTDFKDLVDKEPWLSSSRLVVKPDMLFGKRGKSGLVALNLDLAGVAAFVKERLGKEIEMGGCKGPITTFIVEPFVPHNEEYYLNIVSERLGCSISFSECGGIEIEENWDKVKTIFLPTGSSFTSELCAPLVATLPLEIKLVIEEFLKSVYDIFLDLDFTFLEMNPFTLVNGKPYPLDMRGELDDTAAFKNFKKWGNIEFPMPFGRVMSPTESFIHGLDEKTSASLKFTVLNPKGRIWTMVAGGGASVIYADTVGDLGFASELGNYAEYSGAPNEEEVLQYARVVIDCATADPDGRKRALVIGGGIANFTDVAATFSGIIRALKEKESKLKAARMHLYVRRGGPNYQKGLARMRTLAEEIGLPIEVYGPEATMTGICKQAIECISAAA

SEQ ID NO: 8025 - protein, 423 aa, Cajanus cajan
MARKKIREYDSKRLLREHFKRLSGQDLPIKSAQVTECTDFNELAEKEPWLSSSKLVVKPDMLFGKRGKSGLVALNLDLAEVASFVKERLGKEVEMSGCKGPITTFIVEPFIPHKEEFYLNIVSERLGNSISFSECGGIEIEENWDKVKTVFIPTGISLTLENIAPLVATLPLEIKVEIEEFLKVIFALFQDLDFTFLEMNPFTLVNGKPYPLDMRGELDDTAAFKNFKKWGNIEFPMPFGRVMSTTESFIHGLDEKTSASLKFTVLNPKGRIWTMVAGGGASVIYADTVGDLGYAPELGNYAEYSGAPKEDEVLQYARVVIDCATSDPDGQKRALVIGGGIANFTDVAATFSGIIRALKEKEQKLKEAKMHIYVRRGGPNYQKGLAKMRALGEEIGIPIEVYGPEATMTGICKQAIQCITIAA

SEQ ID NO: 8026 - protein, 423 aa, Cajanus cajan
MARKKIREYDSKRLLKEHFKRLSGKELPIKSAQITVSTDFTELQEKEPWLSSSKLVVKPDMLFGKRGKSGLVALNLDFAQVVSFVKERLGKEVEMSGCKGPITTFIVEPFIPHNEEFYLNIVSERLGNSISFSECGGIEIEDNWDKVKTVFVPTGISITSEIVAPLVATLPLEIKGEIEEFLKVVFTLFQDLDFTFLEMNPFTLVNGKPYPLDMRGELDDTAAFKNFKKWGDIEFPLPFGRVMSATESFIHGLDEKTSASLKFTVLNPKGRIWTMVAGGGASVIYADTVGDLGFASELGNYAEYSGAPKEEEVLQYARVVIDCATANPDGQKRALVIGGGIANFTDVAATFSGIIRALKEKESKLKAARMHIYVRRGGPNYQKGLALMRALGDEIGIPIEVYGPEATMTGICKEAIQFITAAA

SEQ ID NO: 8027 - protein, 423 aa, Platanus occidentalis
MARKKIREYDSKRLLKEHFKRLSGTEIGIKSAQVTESTDFNELVEREPWLLSGKLVVKPDMLFGKRGKSGLVALNLDLAEVATFVKQRLGKEVEMGGCKGPITTFIVEPFVPHNEEFYLNIVSERLGCSVSFSDCGGIEIEENWDKVKTIFVPTGVSFTSETCAPLIATLPLEVKDKVEEFIKVIFALFVDLDFTFLEMNPFTLVDGKPYPLDMRGELDDTAAFKNFKKWGNIEFPMPFGRVMSSTESFIHGLDEKTSASLKFTVLNPKGRIWTMVAGGGASVIYADTVGDLGYASELGNYAEYSGAPNEEEVLQYARVVIDCATANPDGCKRALVIGGGIANFTDVAATFSGIIRALREKESKLKAAQMHIYVRRGGPNYQKGLAKMRTLGEEIGIPIEVYGPEATMTGICKQAIQCITVAA

SEQ ID NO: 8028 - protein, 423 aa, Sequoia sempervirens
MARKKIREYDSKRLLKEHLKRLAAIQLDIKSAQVTGSTNLNELADNEPWLSASRLVVKPDMLFGKRGKSGLVALNLDLAQAAAFVKERLGKEVEMGGARSPITTFILEPFIPHEEEYYLSIVSERLGCTISFSACGGIEIEENWDKVKTVFVPTEKSLTSELCAPLIATLPLEIRGKIETFITGVYKVFLDLDFTFLEMNPFTLVDGNPYPLDMRGELDDTAAFKNFQKWGQIEFPLPFGRVMSPAEDLVHNMDEKTSASLKFTILNPKGRIWTMVAGGGASVIYADTVGDLGYASELGNYAEYSGAPNEEEVLYYARVLIDCATANPDGRKRALLIGGGIANFTDVAATFNGIIRALREKESKLKAARVNIYVRRGGPNYQSGLAKMRALSEEIGVPIEVFGPEASMTGICKQAIEYITAAD

SEQ ID NO: 8029 - protein, 423 aa, Solanum phureja
MARKKIREYDSKRLLKEHFKRLGGYDLAIKSAQVTESTDINELAEKEPWLNSTKLVVKPDMLFGKRGKSGLVALNLDLAQVATFVKERLGKEVEMGGCKGPITTFIVEPFIPHNEEFYLNIVSERLGCSISFSECGGIDIEENWDKVKTIFVPTGTSFTSEICAPLVATLPLEIKGVIEEFLKVIYTLFQDLDFTFLEMNPFTLVEGKPYPLDMRGELDDTAAFKNFKKWGNVEFPLPFGRVMSATESFIHGLDEKTSASLKFTVLNPMGRIWTMVAGGGASVIYADTVGDLGYASELGNYAEYSGAPNEEEVLQYARVVIDCATANPDGRKRALVIGGGIANFTDVAATFSGIIRALKEKESKLKAASMNIYVRRGGPNYQKGLAKMRSLGEEIGIPIEVYGPEETMTGICKQAIECITAAA

SEQ ID NO: 8030 - protein, 423 aa, Triphysaria pusilla
MARKKIREYDSKRLLKEHFKRISGSDLEIKSAQVTESTNFEELVDNEAWISSTKLVVKPDMLFGKRGKSGLVALNLDLAGVAAFVKERLGKEVEMGGCKGPITTFIVEPFVPHNEEYYLNIVSERLGCSISFSECGGIDIEENWDKVKTIFVPTGSSFTSDLCAPLVATLPLEIKGVLEEFIKYVYTLFLDLDFTFLEMNPFTLVDGKPYPLDMRGELDDTATFKNFKKWGNIEFPMPFGRVMSPTESFIHGLDEKTSASLKFTVLNPKGRIWTMVAGGGASVIYADTVGDLGYASELGNYAEYSGAPNEEEVLQYARVVIDCATADPDGRKRALVIGGGIANFTDVAATFSGIIRALREKEAKLKSARMHLYVRRGGPNYQKGLEKMRTLADEIGIPIEVYGPEATMTGICKQAIDCISAAA

SEQ ID NO: 8031 - protein, 101 aa, Pseudotsuga menziesii
MARKKIREFDSKRLLKEHLKRLTGMLVDIKSAQVTESTDFNELADREPWLSSSRLVVKPDMLFGKRGKSGLVALNLDLAQVIAFVKERLGKEVEMGVQGHL

SEQ ID NO: 8032 - protein, 423 aa, Capsicum annuum
MARKKIREYDSKRLLKEHFKRLAGYDLAIKSAQATESTDINELADKEPWLHSTKLVVKPDMLFGKRGKSGLVALNLDLAQVATFVKERLGKEVEMAGCKGPITTFIVEPFIPHNEEFYLNIVSERLGCSVSFSECGGIDIEENWDKVKTIFVPTGTSFTSEICAPLVATLPLEIKGVIEEFLKVIYTLFQDLDFTFLEMNPFTLVEGKPYPLDMRGELDDTAAFKNFKKWGNIEFPLPFGRVMSATESFIHRLDEKTSASLKFTVLNPKGRIWTMVAGGGASVIYADTVGDLGYASELGNYAEYSGAPNEEEVLQYARVVIDCATANPDGRKRALVIGGGIANFTDVAATFSGIIRALKEKESKLKAARMHIYVRRGGPNFQKGLAKMRSLGEEIGIPIEVYGPEETMTGICKQAIECITAAA

SEQ ID NO: 8033 - protein, 423 aa, Cicer arietinum
MARKKIREYDSKRLLKEHFKRLSGKDLPIKSAQVTEATDFTALQDKEPWLSSSKLVVKPDMLFGKRGKSGLVALNLDLAQVASFVKERLGKEVEMGGCKGPISTFIVEPFIPHNEEFYLNIVSDRLGNSISFSECGGIDIEDNWDKVKTAFVPTGVSLTSEIVAPLVATLPLEIKGEIEDFLKVIFTLFQDLDFTFLEMNPFTLVDGKPYPLDMRGELDDTAAFKNFKKWGNIEFPLPFGRVMSATESFIHGLDEKTSASLKFTVLNPKGRIWTMVAGGGASVIYADTVGDLGFASELGNYAEYSGAPNEEEVLQYARVVIDCATADPDGQKRALVIGGGIANFTDVAATFSGIIRALKEKESKLKAARMHIYVRRGGPNYQKGLAKMRALGEEIGIPIEVYGPEATMTGICKEAIQCITASA

SEQ ID NO: 8034 - protein, 423 aa, Eucalyptus grandis
MARKKIREYDSKRLLKEHFKRLSGNDLPIKSAQVTESTDFNELVEREPWLSSEKLVVKPDMLFGKRGKSGLVALNLDLAQVAVFVKERLGKEVEMGGCKGPITTFIVEPFIPHKEEFYLNILSERLGSSISFSECGGIEIEENWDKVKTIFVPTGSPFTSEVCAPLVATLPLEIKAEIEEFITVVFTLFQDLDFTFLEMNPFALVNGKPYPLDMRGELDDTAAFKNFKKWGKIEFPLPFGRVMSPTETFIHGLDEKTSASLKFTVLNPKGRIWTMVAGGGASVIYADTVGDLGFASELGNYAEYSGAPNEEEVLQYARVVIDCATAEPDGQKRALVIGGGIANFTDVAATFNGIIRALKEKEAKLKAARIHIYVRRGGPNYQKGLTKMRALGEEIGIPIDVYGPEATMTGICKQAIECITAAA

SEQ ID NO: 8035 - protein, 423 aa, Lupinus angustifolius
MARKKIREYDSKRLLKEHFNRISGQDLPIKSAQVTDSTDFNEIAEKEPWLSSSKLVVKPDMLFGKRGKSGLVALNLDLAQVASFVNERLGKEVEMGGCKGPITTFIVEPFIPHNEEFYLNIVSERLGNSISFSECGGIEIEENWDKVKTVFLPTGVSLTPENIAPLVATLPLEVKGEIEEFLKSVFILFQDLDFTFLEMNPFTLVNGKPYPLDMRGELDDTAAFKNFKKWGNVEFPLPFGRVMSPTESFIHGLDEKTSASLKFTVLNPKGRIWTMVAGGGASVIYADTVGDLGYAPELGNYAEYSGAPKEDEVLQYARVVIDCATSNPDGQNRALVIGGGIANFTDVAATFSGIIRALKEKEQKLKEANMHIYVRRGGPNYQRGLAKMRALGEEIGIPIQVYGPEETMTGICKQAIQCINVAA

SEQ ID NO: 8036 - protein, 423 aa, Tropaeolum majus
MARKKIREYDSKRLLKEHFKRLSGNELPIKSAQITQSTDITELGEKEPWLLSGKLVVKPDMLFGKRGKSGLVALNLDLAEVHAFVKERLGKEVEMGGCKGPITTFIVEPFIPHNEEFYLNIVSDRLGCSISFSECGGIEIEENWDKVKTIFVPTGGSLTAETVAPLVATLPLETKGEIEEFIKVVFTVFQDLDFTFLEMNPFALVDGKPYPLDMRGELDDTATFKNFKKWGNIEFPLPFGRVMSATESYIHGLDEKTSASLKFTVLNPKGRIWTMVAGGGASVIYADTVGDLGYASELGNYAEYSGAPNEEEVLQYARVVIDCATSDPDGQKRALVIGGGIANFTDVAATFNGIIRALKEKESRLKAARMSIYVRRGGPNYQKGLAKMRALGEEIGIPLEVYGPEATMTGICKEAIQCITASA

SEQ ID NO: 8037 - protein, 423 aa, Podocarpus macrophillus
MARKKIREYDSKRLLKHHLKRLASIELNIKSAQVTRSTNYNELADNEPWLSSSRLVVKPDMLFGKRGKSGLVALNLDLAEAAAFIKERVGKEVEMDGSKAPITTFILEPFIPHDEEYYLSIVSERLGLTISFSACGGIEIEENWDKVKTIFVPTEKTLTPELCAPLIATLPLEIRGKIENFVRGVYKVFLDLDFTFLEMNPFTLVDGKPFPLDMRGELDDTAAFKNFQKWGDIEFPLPFGRILSPAEDLIHGMDEKTSASLKFTILNPKGRIWTMVAGGGASVIYADTVGDLGYASELGNYAEYSGAPNEEEVLYYARVLIDCATANPDGQKRALLIGGGIANFTDVAATFNGIIRALREKESKLKAARVNIYVRRGGPNYQSGLAKIRALSEEIGIPIEVYGPEASMTGICKQAIDYITFAD

SEQ ID NO: 8038 - protein, 423 aa, Papaver somniferum
MARKKIREYDSKRLLKEHFKRLAGSELALKSAQVTESTDFNELANKEPWLSSSKLVVKPDMLFGKRGKSGLVALNLDLAQVASFVKERLGKEVEMGGCKGPITTFIVEPFIPHDEEFYLNIVSERLGCSISFSECGGIDIEENWDKVKTVFIPTRTTFSADLCAPLVATLPLEIKEKIEDFIKVVYSIFLDLDFTFLEMNPFALVDGKPYPLDMRGELDDTATFKNFKKWGNLEFPMPFGRVMSPAESFIHGLDEKTSASLKFTVLNPKGRIWTMVAGGGASVIYADTVGDLGYASELGNYAEYSGAPNEQEVLQYARVVIDCATAEPDDKKRALVIGGGIANFTDVAATFSGIIRALREKEEKLKAAKMHIYVRRGGPNYQLGLAKMRSLGEEIGIPLEVFGPEATMTGICKQAIDCITASA

SEQ ID NO: 8039 - protein, 423 aa, Solanum lycopersicum
MARKKIREYDSKRLLKEHFKRLGGYDLAIKSAQVTESTDINELAEKEPWLNSTKLVVKPDMLFGKRGKSGLVALNLDLAQVATFVKERLGKEVEMGGCKGPITTFIVEPFIPHNEEFYLNIVSDRLGCSVSFSECGGIDIEENWDKVKTISVPTGTSFTSEICAPLVATLPLEIKGVIEEFLKVIYALFQDLDFTFLEMNPFTLVEGKPYPLDMRGELDDTAAFKNFKKWGNIEFPLPFGRVMSATESFIHGLDEKTSASLKFTVLNPKGRIWTMVAGGGASVIYADTVGDLGYASELGNYAEYSGAPNEEEVLQYARVVIDCATANPDGRKRALVIGGGIANFTDVAATFSGIIRALKEKESKLKAARMHIYVRRGGPNYQKGLAKMRSLGEEIGIPIEVYGPEETMTGICKQAIECISAAA

SEQ ID NO: 8040 - protein, 424 aa, Vinca minor
MARKKIREYDSKRLLKENFKRLSGYELAIKSAQVTEATDFNELVEKEPWLSSTKLVVKPDMLFGKRGKSGLVALNLDLAEVASFVMDRLGKEVEMGGCKGPITTFIVEPFVPHNEEFYLNIVSERLGCSISFSECGGIDIEENWDKVKTIFLPTGASFTSEVCAPLVATLPLEIKPVIDKFIKVVYALFVDLDFTFLEMNPFTLVDGKPYPLDMRGELDDTAAFKNFKKWGNIEFPLPFGRVMSTTESFIHGLDEKTSASLKFTVLNPKGRIWTMVAGGGASVIYADTVGDLGYATELGNYAEYSGAPNEEEVLQYARVVIDCATAEPDGRKRALVIGGGIANFTDVAATFNGIIRALKEKESKLKAARMSIYVRRGGPNYQRGLAKMRALGDEIGIPIEVYGPEATMTGICKEAIECITAAAA

SEQ ID NO: 8041 - protein, 424 aa, Daucus carota
MARKKIREYDSKRLLKEHYKRLTGGDELGIKSAQITESTNINELVEKEPWLSSSKLVVKPDMLFGKRGKSGLVALNLDLAQVDNFVKERLGKEVEMGGCKGPITTFIVEPFVPHNEEFYLNMVSDRLGCSISFSECGGIDIEENWDKVKTIFVPTGMSMTPEICAPLVATLPLEIKSVIEEFIKVIFILFADLDFTFLEMNPFTLVDGKPYPLDMRGELDDTAAFKNFKKWGNIEFPLPFGRVMSSTESFIHGLDEKTSASLKFTVLNPKGRIWTMVAGGGASVIYADTVGDLGFAEELGNYAEYSGAPNEEEVLQYARVVIDCATADPDGRKRALVVGGGIANFTDVAATFNGIIRALKEKESKLKAARMHIYVRRGGPNYQKGLAKMRALGEEIGIPIEVYGPEKTMTGICKQAIECISAAA

SEQ ID NO: 8042 - protein, 395 aa, Brassica napus
RSAQVTEATDFTELTNQEPWLSSTKLVVKPDMLFGKRGKSGLVALKLDLAEVAEFVKARLGSEVEMGGCKAPITTFIVEPFVPHDQEYYLSIVSDRLGCTVSFSECGGIEIEENWDKVKTVFLPAEKSMTLEVCAPLIATLPLEVRGKIGSFIMGVFAVFQDLDFSFMEMNPFTLVDGEPYPLDMRGELDDTAAFKNFNKWGDIEFPLPFGRVLSPTESFIHGLDEKTSASLKFTVLNPKGRIWTMVAGGGASVIYADTVGDLGYASELGNYAEYSGAPNEEEVLQYARVVIDCATADPDGRKRALLIGGGIANFTDVAATFNGIIRALREKETRLKASRMHIYVRRGGPNYQTGLARMRALGEELGVPLEVYGPEATMTGICKRAIDCIMLPDA

SEQ ID NO: 8043 - protein, 423 aa, Phaseolus vulgaris
MARKKIREYDSKRLLKEHFKRLSGKDLPIKSAQIDASTDFTELQEKEPWLSSSKLVVKPDMLFGKRGKSGLVALNLDFAQVVSFVKERLGKEVEMSGCKGPITTFIVEPFIPHDEEFYLNIVSERLGNSISFSECGGIEIEDNWDKVKTIFIPTGVSITSEIVAPLVATLPLEIKGEIEEFLKVVFMLFQDLDFTFLELNPFTLVDGKPYPLDMRGELDDTAAFKNFKKWGDIEFPLPFGRVMSATESFIHGLDEKTSASLKFTVLNPKGRIWTMVAGGGASVIYADTVGDLGFASELGNYAEYSGAPKEDEVLQYARVVIDCATANPDGQKRALVIGGGIANFTDVAATFSGIIRALREKESKLKAARMNIYVRRGGPNYQKGLTLMRALGEEIGIPIEIYGPEATMTGICKEAIQFITASA

SEQ ID NO: 8044 - protein, 423 aa, Panax ginseng
MARKKIREYDSKRLLKEHFKRISGSDLAIKSAQITESTDVNELVETEPWLSSSKLVVKPDMLFGKRGKSGLVALNLDLAQVTDFVKERLGKEVEMGGCKGPITTFIVEPFVPHNEEFYLNMVSERLGCSISFSDCGGIEIEENWDKVKTIFIPTGVFLTPEICAPLVATLPLEIKGVIEEFIKLIFTLFADLDFTFLEMNPFTLVEGHPYPLDMRGELDDTAAFKNFKKWGNIEFPLPFGRVMSPTESFIHGLDEKTSASLKFTVLNPKGRIWTMVAGGGASVIYADTVGDLGYAAELGNYAEYSGAPNEEEVLQYARVVIDCATAEPDGHKRALVVGGGIANFTDVAATFNGIIRALKEKESKLKAANMHIYVRRGGPNYQRGLAKMRNLGEEIGIPIEVYGPEETMTGICKQAIECISAAA

SEQ ID NO: 8045 - protein, 423 aa, Panax ginseng
MARKKIREYDSKRLLKEHFKRISGCELVIKSAQITESTDVNELVKRESWLSSSKLVVKPDMLFGKRGKSGLVALNLDLAQVAGFVKERLGKEVEMGGCKGPITTFIVEPFVPHNEEFYLNMVSERLGCSISFSECGGIEIEENWDKVKTIFVPTGVSLTTDICAPLVATLPLEIKGVIEEFIKVIFTLFSDLDFTFLEMNPFTLVDGKPYPLDMRGELDDTAAFKNFKKWGNIEFPLPFGRVMSPTESFIHGLDEKTSASLKFTVLNPKGRIWTMVAGGGASVIYADTVGDLGFAAELGNYAEYSGAPNEEEVLQYARVVIDCATSDPDGRKRALVVGGGIANFTDVAATFNGIIGALKEKETKLKAANMHIYVRRGGPNYQRGLAKMRTLGQEIGIPIEVYGPEETMTGICKQAIECISAAA

SEQ ID NO: 8046 - protein, 423 aa, Lotus japonicus
MARKKIREYDSKRLVKEHFKRLSGKELPIKSAQVTGSTDFSELQDKEPWLSSSKLVVKPDMLFGKRGKSGLVALNLDFAQVASFVKERLGKEVEMGGCKGPITTFIVEPFIPHNEEFYLNIVSERLGNSISFSECGGIDIEENWDKVKTVFIPTGVSLTSEIVAPLVATLPLEIKGEIEEFLKVIFTLFQDLDFTFLEMNPFTLVDGKPCPLDMRGELDDTAAFKNFKKWGNIEFPLPFGRVMSATESFVHELDEKTSASLKFTVLNPKGRIWTMVAGGGASVIYADTVGDLGFASELGNYAEYSGAPKEDEVLQYARVVIDCATANPDGQKRALVIGGGIANFTDVAATFSGIIRALKEKESKLKAARMHIYVRRGGPNYQKGLALMRALGEEIGIPIEVYGPEATMTGICKEAIQCITAAA

SEQ ID NO: 8047 - protein, 423 aa, Nicotiana benthamiana
MARKKIREYDSKRLLKEHFKRLGGYDLAIKSAKVTESTDFNELAEKEPWLNSSKLVVKPDMLFGKRGKSGLVALNLDLAQVATFVKERLGKEVEMGGCKGPITTFIVEPFIPHNEEFYLNIVSDRLGCSVSFSECGGIDIEENWDKVKTIFVPTGTSFTSEICAPLVATLPLEIKGVIEDFLKVVYTLFQDLDFTFLEMNPFALVEGKPYPLDMRGELDDTAAFKNFKKSGNIEFPLPFGRVMSATESFIHGLDEKTSASLKFTVLNPKGRIWTMVAGGGASVIYADTVGDLGYASELGNYAEYSGAPNEEEVLQYARVVIDCATANPDGRKRALVIGGGIANFTDVAATFSGIIRALKEKESKLKAARMQIFVRRGGPNYQKGLAKMRSLGEEIGIPIEVYGPEATMTGICKQAIECITPAA

SEQ ID NO: 8048 - protein, 423 aa, Pinus taeda
MARKKIREYDSKRLLKEHLKRLADIEIDIKSAQVTNSTNLNELADTKPWLSSLRLVVKPDMLFGKRGKSGLVALNLDLAQAALFVRDRLGKEVEMGNARAPITTFILEPFIPHDDEYYLSILSERLGFTISFSACGGIEIEENWDKVKTIFIPTEKPLTSELCAPLIATLPLEIRGNIENFIRGVYKVFLDLDFTFLEMNPFTLLDGKPYPLDMRGELDDTASFKNFQKWGNIEFPMPFGRVMSPAEELIHSMDEKTSASLKLTILNPKGRIWTMVAGGGASVIYADTVGDLGYASELGNYAEYSGAPNEEEVLYYARVLIDCATANPDGRKRALLIGGGIANFTDVAATFNGIIRALREKESKLKAARFNIYVRRGGPNYQTGLAKMRALSEEIGVPIEVHGPEASMTGICKDAIDYITAAD

SEQ ID NO: 8049 - protein, 423 aa, Papaver somniferum
MARKKIREYDSKRLLKEHFKRLAGSELALKSAQVTESTDFNELANKEPWLSSSKLVLKPDMLFGKRGKSGLVALNLDLAQVASFVKERLGKEVEMGGCKGPITTFIVEPFIPHDEEFYLNIVSERLGCSISFSECGGIDIEENWDKVKTVFIPTGTTFSADLCAPLVATLPLEIKEKIEDFIKVVYSIFLDLDFTFLEMNPFALVDGKPYPLDMRGELDDTATFKNFKKWGNLEFPMPFGRVMSPTESFIHGLDEKTSASLKFTVLNPKGRIWTMVAGGGASVIYADTVGDLGYASELGNYAEYSGAPNEQEVLQYARVAIDCATAEPDDKKRALVIGGGIANFTDVAATFSGIIRALREKEEKLKAAKMHIYVRRGGPNYQLGLAKMRSLGEEIGIPLEVFGPEATMTGICKQAIDCITASA

SEQ ID NO: 8050 - protein, 423 aa, Papaver somniferum
MARKKIREYDSKRLLKEHFKRLAGSELALKSAQVTESTDFNELANKEPWLSSSKLVVKPDMLFGKRGKSGLVALNLDLAQVASFVKERLGKEVEMGGCKGPITTFIVEPFIPHDEEFYLNIVSERLGCSISFSECGGIDIEENWDKVKTVFIPTGTTFSADLCAPLVATLPLEIKEKIEDFIKVVYSIFLDLDFTFLEMNPFALVDGKPYPLDMRGELDDTATFKNFKKWGNLEFPMPFGRVMSPTESFIHGLDEKTSASLKFTILNPKGRIWTMVAGGGASVIYADTVGDLGYASELGNYAEYSGAPNEQEVLQYARVVIDCATAEPDDKKRALVIGGGIANFTDVAATFSGIIRALREKEEKLKAAKMHIYVRRGGPNYQLGLAKMRSLGEEIGIPLEVFGPEATMTGICKQAIDCITASA

SEQ ID NO: 8051 - protein, 423 aa, Chenopodium quinoa
MARKKIREYDSKRLIKEHYKRISGSELPIRSAQITESTDLNELVQNEPWLSSEKLVVKPDMLFGKRGKSGLVALNLDFSQVTAFVKERLGKEVEMGGCKGPITTFIVEPFIPHNEEFYLNIVSERLGNSISFSECGGIEIEENWDKVKTIFVPTGVSLTSEVCAPLVATLPLEVKSVIEEFVKVIFALFLDLDFTFLEMNPFTLVNGSPYPLDMRGELDDTATFKNFKKWGNIEFPLPFGRVMSPTESFVHGLDEKTSASLKFTVLNPKGRIWTMVAGGGASVIYADTVGDLGYASELGNYAEYSGAPNEDEVLQYARVVIDCATADPDGRKRALVVGGGIANFTDVAATFNGIIRALKEKESKLKAARMHIYVRRGGPNYQKGLAKMRLLGEEIGIPIEVYGPEATMTGICKQAIECISAAA

SEQ ID NO: 8052 - protein, 423 aa, Solanum phureja
MARKKIREYDSKRLLKEHFKRLAGYDLAIKSAQITESTDLNELVEKEPWLSSTQLVVKPDMLFGKRGKSGLVALNFDLAQVASFVKERLGKEVEMSGCKGPITTFIVEPFVPHNEEFYLNIVSERLGCSVSFSECGGIDIEENWDKVKTIFVPTGTSFTSEICAPLVATLPLEIKGVIEEFLKVVYTLFQDLDFTFLEMNPFTLVEGKPYPLDMRGELDDTAAFKNFKKWGNVEFPLPFGRVMSATESFIHGLDEKTSASLKFTVLNPKGRIWTMVAGGGASVIYADTVGDLGYASELGNYAEYSGAPNEEEVLQYARIVIDCATADPDGRKRALVIGGGIANFTDVAATCSGIIRALKEKESKLKAARMHIYVRRGGPNYQKGLAKMRSLGEEIGIPIEVYGPEETMTGICKQAIECITAAA

SEQ ID NO: 8053 - protein, 423 aa, Glycine max
MARKKIREYDSKRLLKEHFKRLSGKELPIKSAQITASTDFTELQEKEPWLSSSKLVVKPDMLFGKRGKSGLVALNLDFAQVVSFVKERLGKEVEMSGCKGPITTFIVEPFIPHNEEFYLNIVSERLGNSISFSECGGIEIEDNWDKVKTAFVPTGMSLTSEIVAPLVATLPLEIKGEIEEFLKVVFTLFQDLDFTFLEMNPFTLVDGKPYPLDMRGELDDTAAFKNFKKWGDIEFPLPFGRVMSATESFIHGLDEKTSASLKFTVLNPKGRIWTMVAGGGASVIYADTVGDLGFASELGNYAEYSGAPKEEEVLQYARVVIDCATANPDGQKRALVIGGGIANFTDVAATFSGIIRALKEKESKLKAARMHIFVRRGGPNYQKGLALMRALGEEIGIPIEVYGPEATMTGICKEAIQFITAAA

SEQ ID NO: 8054 - protein, 423 aa, Glycine max
MARKKIREYDSKRLLKEHFKRLSGQDLPIKSAQVTESTDFNELTEKEPWLLSSKLVVKPDMLFGKRGKSGLVALNLDLAEVDSFVKERLGKEVEMGGCKGPITTFIVEPFIPHNEEFYLNIVSERLGNSISFSECGGIEIEENWDKVKTVFMPTGVSLTSESIAPLVATLPLEIKGEIEGFLKVIFALFQDLDFTFLEMNPFTLVNGKPYPLDMRGELDDTAAFKNFKKWGNIEFPLPFGRVMSTTEAFVHGLDEKTSASLKFTVLNPMGRIWTMVAGGGASVIYADTVGDLGYAPELGNYAEYSGAPKEDEVLQYARVVIDCATSNPDGQKRALVIGGGIANFTDVAATFSGIIRALKEKEQKLKEAKMHIYVRRGGPNYQKGLAKMRALGEEIGIPIEVYGPEATMTGICKQAIQCITAAA

SEQ ID NO: 8055 - protein, 423 aa, Tabernaemontana elegans
MARKKIREYDSKRLLKEHFKRLSGYELDIKSAQVTEATDFNELVEKEPWLSSTKLVVKPDMLFGKRGKSGLVALNLDLAEVAGFVKERLGKEVEMGGCKGPITTFIVEPFVPHNEEFYLNIVSERLGCSISFSECGGIDIEENWDKVKTIFLPTGVSFTSEVCAPLLATLPLEIKSVIEEFLKVIYALFVDLDFTFLEMNPFTFIDGRPYPLDMRGELDDTAAFKNFKKWGNLEFPLPFGRVMSATETFIHGLDEKTSASLKFTVLNPKGRIWTMVAGGGASVIYADTVGDLGYAAELGNYAEYSGAPNEEEVLQYARVVIDCATADPDGRKRALVIGGGIANFTDVAATFNGIIRALKEKESKLKAARMSIYVRRGGPNYQKGLAKMRILGEEIGIPIEVYGPEATMTGICKEAIECISAAA

SEQ ID NO: 8056 - protein, 423 aa, Solanum lycopersicum
MARKKIREYDSKRLLKEHFKRLAGYDLAIKSAQITESTDLNELVEKEPWVSSKKLAVKPDMLFGKRGKSGLVALNLDLAQVALFVKERLGKEVEMSGCKGPITTFIVEPFVPHNEEFYLNIVSDRLGCSVSFSECGGIDIEENWDKVKTIFVPTGTSFTSEICAPLAATLPLEIKGVIEEFLKVVYTLFQDLDFTFLEMNPFTLVEGKPYPLDMRGELDDTATFKNFKKWGNVEFPLPFGRVMSATESFIHGLDEKTSASLKFTVLNPKGRIWTMVAGGGASVIYADTVGDLGYASELGNYAEYSGAPNEEEVLQYARVVIDCATADPDGRKRALVIGGGIANFTDVAATFSGIIRALKEKESKLKAARMHIYVRRGGPNYQKGLAKMRSLGEEIGIPIEVYGPEETMTGICKQAIECITAAA

SEQ ID NO: 8057 - protein, 423 aa, Triphysaria pusilla
MARKKIREYDSKRLLKEHFKRISGSELEIKSAQVTESTNFEELVDNEAWISSTKLVVKPDMLFGKRGKSGLVALNLDLAGVAAFVKERLGKEVEMGGCKGPITTFIVEPFVPHNEEYYLNIVSERLGCSISFSECGGIDIEENWDKVKTIFVPTGSSFTSDLCAPLVATLPLEIKGVLEEFIKFVYALFLDLDFTFLEMNPFTLVDGKPYPLDMRGELDDTATFKNFKKWGNIEFPMPFGRVMSPTESFIHGLDEKTSASLKFTVLNPKGRIWTMVAGGGASVIYADTVGDLGFASELGNYAEYSGAPNEEEVLQYARVVIDCATADPDGRKRALVIGGGIANFTDVAATFSGIIRALREKEAKLKSARMHLYVRRGGPNYQKGLEKMRTLADEIGIPIEVYGPEATMTGICKQAIDCISAAA

SEQ ID NO: 8058 - protein, 423 aa, Triphysaria pusilla
MARKKIREYDSKRLLKEHFKRISGSDLEIKSAQVTESTNFEELVDNEAWISSTKLVVKPDMLFGKRGKSGLVALNLDLAGVAAFVKERLGKEVEMGGCKGPITTFIVEPFVPHNEEYYLNIVSERLGCSISFSECGGIDIEENWDKVKTIFVPTGSSFTSDLCAPLVATLPLEIKGVLEEFIKYVYTLFLDLDFTFLEMNPFTWVDGKPYPLDMRGELDDTATFRNFKKWGNIEFPMPFGRVMSPTESFIHGLDEKTSASLKFTVLNPKGRIWTMVAGGGASVIYADTVGDLGYASELGNYAEYSGAPNEEEVLQYARVVIDCATADPDGRKRALVIGGGIANFTDVAATFSGIIRALREKEAKLKSARMHLYVRRGGPNYQKGLEKMRTLADEIGIPIEVYGPEATMTGICKQAIDCISAAA

SEQ ID NO: 8059 - protein, 423 aa, Utricularia gibba
MARKKIREYDSKRLLKEHFKRLSGTELEIKSAQVTESTDLKKLVDKEPWLSSTRLVVKPDMLFGKRGKSGLVALNLDLAGVSAFVAERLGKEVEMGLCKGPITTFIVEPFVPHNEEFYLNIVSERLGCSISFSECGGIEIEENWDKVKTIFVPTNAILTSEVCAPLVATLPLEIKPVIEDFIKIVFAVFLDLDFTFLEMNPFTLVNGKPFPLDMRGELDDTAAFKNFKKWGNIEFPMPFGRVLSPAESFIHGLDEKTSASLKFTILNPKGRIWTMVAGGGASVIYADTVGDLGYASELGNYAEYSGAPNEDEVLHYARVVIDCATADPDGRKRALVIGGGIANFTDVAATFNGIIRALKEKESKLKAARMHLYVRRGGPNYQKGLAKMRSLAEEIGIPIEVYGPEATMTGICKQAIECISAAA

SEQ ID NO: 8060 - protein, 198 aa, Cucurbita pepo
MARKKIREYDSKRLLKEHFKRISGRDLPIKSAQVRDSTDFNELVEKEPWLSSSKLVVKPDMLFGKRGKSGLVALNLDFAEVTGFVKERLGKVVEMGGCKGPITTFIVEPFVTHKEEFYLNIVSERLGCNLSFSECGGIDIEENWDKVKTIFVPTGASLTSEVCAPLVATLPLEIKGEIEDFIKSVLLYFKIWTSLFWK

SEQ ID NO: 8061 - protein, 149 aa, Cucurbita pepo
MVAGGGASVIYADTVGDLGYATELGNYAEYSGAPNEEEVLQYARVVLDCATADPDGQKRALVIGGGIANFTDVAATFNGIIRALKEKESRLKAARMNIYVRRGGPNYQRGLAKMRALGEELGVPIEVYGPEATMTGICKQAIECITAAA

SEQ ID NO: 8062 - protein, 205 aa, Momordica charantia
MARKKIRENDSKRLLKEHFKRISGRDLPIKSAQVSESTDFNELAEKEPWLLSSKLVVKPDMLFGKRGKSGLVALNLDLAEVTNFVKERLGKVVEMSGCKGPITTFIVEPFIPHNEEFYLNIVSERLGCSLSFSECGGIDIEENWDKVKTIFVPTGASLTSEICAPLVATLPLEIKGEIEDFLKSVFSSISRFGLHFSGNESLHIG

SEQ ID NO: 8063 - protein, 388 aa, Papaver somniferum
MARKKIREYDSKRLLKEHFKRLAGSELALKSAQVTESTDFNELANKEPWLSSSKLVVKPDMLFGKRGKSGLVALNLDLAQVASFVKERLGKEVEMGGCKGPITTFIVEPFIPHDEEFYLNIVSERLGCSISFSECGGIDIEENWDKVKTVFIPTGTTFSADLCAPLVATLPLEIKEKIEDFIKVVYSIFLDLDFTFLEMNPFALVDGKPYPLDMRGELDDTATFKNFKKWGNLEFPMPFGRVMSPTESFIHGLDEKTSASLKFTVLNPKGRIWTMVAGGGASVIYADTVGDLGYASELGNYAEYSGAPNEQEVLQYARVVIDCATAEPDDKKRALVIGGGIANFTDVAATFSGIIRALREKEEKLKAAKIAYICEEKGTETISWVLLR

SEQ ID NO: 8064 - protein, 423 aa, Abies balsamea
MARKKIREYDSKRLLKEHLKRLAGIEIDIKSAQVTNSTDLNELADTKPWLSSFRLVVKPDMLFGKRGKSGLVALNLDLAQAALFVRERLGKEVEMGNAKAPITTFILEPFIPHDDEYYLSILSERLGFTISFSACGGVEIEENWDKVKTIFVPTEKPLTTELCAPLIATLPLEIRGKIENFIRGVYKVFLDLDFTFLEMNPFTFLDGNPYPLDMRGELDDTASFKNFQKWGNIEFPMPFGRVMSPAEQLIHSMDEKTSASLKLTILNPKGRIWTMVAGGGASVIYADTVGDLGYTSELGNYAEYSGAPNEEEVLYYARVLIDCATANPDGRKRALLIGGGIANFTDVAATFNGIIRALREKESKLKAARVNIYVRRGGPNYQIGLAKMHALSEEIGVPIEVHGPEDSMTGICKNAIDYITAAD

SEQ ID NO: 8065 - protein, 423 aa, Pinus pinaster
MARKKIREYDSKRLLKEHLKRLADIEIDIKSAQVTNSTNLNELADTKPWLSSLRLVVKPDMLFGKRGKSGLVALNLDLAQAALFVRDRLGKEVEMGNARAPITTFILEPFIPHDDEYYLSILSERLGFTISFSACGGIEIEENWDKVKTIFIPTEKPLTSELCAPLIATLPLEIRGNIENFIRGVYKVFLDLDFTFLEMNPFTLLDGKPYPLDMRGELDDTASFKNFQKWGSIEFPMPFGRVMSPAEELIHSMDEKTSASLKLTILNPKGRIWTMVAGGGASVIYADTVGDLGYASELGNYAEYSGAPNEEEVLYYARVLIDCATANPDGRKRALLIGGGIANFTDVAATFNGIIRALREKESKLKAARFNIYVRRGGPNYQTGLAKMRALSEEIGVPIEVHGPEASMTGICKDAIDYITAAD

SEQ ID NO: 8066 - protein, 423 aa, Medicago truncatula
MARKKIREYDSKRLLKEHFKRLSGKDLPIKSAQVTEATDFTELQDKEQWLSSSKLVVKPDMLFGKRGKSGLVALNLDLAQVASFVKERLGKEVEMGGCKGPITTFIVEPFIPHNEEYYLNIVSDRLGNSISFSECGGIDIEENWDKVKTVFIPTGVSLTSEIIAPLVATLPLEIKGEIEEFLKVIFTLFQDLDFTFLEMNPFTLVDGKPYPLDMRGELDDTAAFKNFKKWGNIEFPLPFGRVMSATESFIHGLDEKTSASLKFTVLNPKGRIWTMVAGGGASVIYADTVGDLGFANELGNYAEYSGAPNEEEVLQYARVVIDCATANPDGQKRALVIGGGIANFTDVAATFSGIIRALKEKESKLKAARMHLYVRRGGPNYQKGLEKMRALGEEIGIPIEVYGPEATMTGICKQAIQCITASA

SEQ ID NO: 8067 - protein, 423 aa, Tropaeolum majus
MARKKIREYDSKRLLKEHFKRLSGKELPIKSAQITESTDINELVEKEPWLSSEKLVVKPDMLFGKRGKSGLVALNLDLAEVASFVKERLGKEVEMSGCKGPITTFIVEPFIPHNEEFYLNIVSDRLGCSISFSECGGIEIEENWDKVKTIFVPTGVSLTSETCAPLIATIPLEIKGEIDQFIKVVFTIFQALDFTFLEMNPFALVDGKPYPLDMRGELDDTAAFKNFKTWGNIEFPLPFGRVMSATESYIHGLDEKTSASLKFTVLNPKGRIWTMVAGGGASVIYADTVGDLGYASELGNYAEYSGAPNEEEVLQYARVVLDCATADPDGQKRALVIGGGIANFTDVAATFNGIIRALKEKESKLKAARMSIYVRRGGPNYQRGLAKMRALGEEIGIPLEVYGPEATMTGICKEAIQCITTAA

SEQ ID NO: 8068 - protein, 423 aa, Pseudotsuga menziesii
MARKKIREYDSKRLLKEHLKRLAGIEMDIKSAQVTNSTDLNELADTKPWLSSLRLVVKPDMLFGKRGKSGLVALNLDLAQAALFVRDRLGKEVEMGNAKAPTTTFILEPFIPHDDEYYLSILSERLGFAISFSACGGVEIEENWDKVKTIFVPTEKPLTSELCAPLIATLPLEIRGNIENFIKGVYKVFLDLDFTFLEMNPFTLLDGKPYPLDMRGELDDTASFKNFQKWGNIEFPMPFGRVMSPAEELIHSMDEKTSASLKLTILNPKGRIWTMVAGGGASVIYADTVGDLGYASELGNYAEYSGAPNEEEVLYYARVLIDCATGNPDGRKRALLIGGGIANFTDVAATFNGIIRALREKESKLKAARVNIYVRRGGPNYQTGLAKMRALSEEIGVPIEVHGPEASMTGICKKAIDYITAAD

SEQ ID NO: 8069 - protein, 423 aa, Chenopodium quinoa
MARKKIREYDSKRLIKEHYKRISGSELPIRSAQITESTDLNELVQNEPWLSSEKLVVKPDMLFGKRGKSGLVALNLDFSQVTAFVKERLGKEVEMGGCKGPITTFIVEPFIPHNEEFYLNIVSERLGNSISFSECGGIEIEENWDKVKTIFVPTGVSLTSEVCAPLVATLPLEFKSVIEEFIKVTFALFLDLDFTFLEMNPFTLVNGSPYPLDMRGELDDTATFKNFKKWGNIEFPLPFGRVMSPTESFVHGLDEKTSASLKFTVLNPKGRIWTMVAGGGASVIYADTVGDLGYAFELGNYAEYSGAPNEDEVLQYARVVIDCATADPDGRKRALVVGGGIANFTDVAATFNGIIRALKEKESKLKAARMHIYVRRGGPNYQKGLAKMRLLGEEIGIPIEVYGPEATMTGICKQAIECISAAA

SEQ ID NO: 8070 - protein, 423 aa, Fragaria vesca
MARKKIREYDSKRLLKEHFKRLAGRELPLKSAQVTESTDFNELLEKETWLSTSKLVVKPDMLFGKRGKSGLVALNLDFAQVVTFVKERLGKEVEMGGCKGPITTFIVEPFIPHNEEFYINIVSERLGNSISFSECGGIDIEENWDKVKTIFVPTGASLTPEVCAPLVATLPMEIKSEIEEFIKSVFALFQDLDFTFLEMNPFALVDGKPYPLDMRGELDDTAAFKNFKKWGNIEFPMPFGRVMSSTEKFIHGLDEKTSASLKFTVLNPKGRIWTMVAGGGASVIYADTVGDLGFANELGNYAEYSGAPNEEEVLQYARVVIDCATSDPDGRKRALVIGGGIANFTDVAATFNGIIRALKEKESKLKAARMHLYVRRGGPNYQRGLAKMRALAEEIGLPIEVYGPEATMTGICKQAIQCISAAA

SEQ ID NO: 8071 - protein, 423 aa, Taxus baccata
MARKKIREYDSKRLLKEHLKRLVDLQVEIKSAQVTGSTNLNELADNEPWLSASRLVVKPDMLFGKRGKSGLVALNLDLAQAAAFVKDRLGKEVEMGGARAPITTFILEPFIPHDEEYYLSIVSDRLGLTISFSACGGIEIEENWDKVKTIFVPTEKSLTAEICAPLIATLPLEIRGKIENFIAGVYKVFLDLDFTFLEMNPFTFVNGKPYPLDMRGELDDTAAFKNFQKWNNIEFPMPFGRVMSPAEDSVHSMDEKTSASLKFTILNPKGRIWTMVAGGGASVIYADTVGDLGYAIELGNYAEYSGAPNEEEVLYYARVLIDCATANPDGRKRALLIGGGIANFTDVAATFNGIIRALREKESKLKAARVNIYVRRGGPNYQSGLAKMRALSEEIGVPIEVFGPEASMTGICKQAIDYITAAN

SEQ ID NO: 8072 - protein, 423 aa, Tragopogon dubius
MARKKIREYDSKRLVKEHFKRISGSELAIKSAQVTESTDLNELIEKEPWLSSSKLVVKPDMLFGKRGKSGLVALNLDLAQVSEFVKARLGKEVEMGGCKGPITTFIVEPFVPHNEEFYINIVSERLGCSISFSECGGIEIEENWDKVKTIFLPTGVSLNQEICAPLVATLPLEIKPVIEEFITAIYSLFIDLDFTFLEMNPFTLVDNKPYPLDMRGELDDTAAFKNFKKWGNIEFPLPFGRVMSATESFIHGLDEKTSASLKFTVLNPKGRIWTMVAGGGASVIYADTVGDLGYASELGNYAEYSGAPNEEEVLQYARVVIDCATADPDGKKRALVVGGGIANFTDVAATFNGIIRAMKEKESKLKAANMHIYVRRGGPNYQRGLARMRALGEEIGIPIEVYGPEATMTGICKQAIDCITAAA

SEQ ID NO: 8073 - protein, 423 aa, Triphysaria pusilla
MARKKIREYDSKRLLKEHFKRISGSELEIKSAQIVESTDFNEIVEKEPWLSSTKLVVKPDMLFGKRGKSGLVALNLDLAGVAAFVKERLGKEVEMGGCKGPITTFIVEPFVPHSEEYYLNIVSERLGCSISFSECGGIEIEENWDKVKTIFVPTGVSFTPEICAPLLATLPLEIKSVIEEFIKSVYALFLDLDFTFLEMNPFTLVNGKPYPLDMRGELDDTAAFKNFKKWGGIEFPMPFGRIMSPTESFIHGLDEKTSASLKFTVLNPKGRIWTMVAGGGASVIYADTVGDLGYASELGNYAEYSGAPNEEEVLQYARVVIDCAAAEPDGLSRALVIGGGIANFTDVAATFSGIIRALREKESKLKAARMHLYVRRGGPNYQKGLARMRSLAEEIGIPIEVYGPEATMTGICKQAIECISAAA

SEQ ID NO: 8074 - protein, 423 aa, Vinca minor
MARKKIREYDSKRLLKENFKRLSGYELGIKSSQVTEGTDFNELVEKEPWLSTTKLVVKPDMLFGKRGKSGLVALNLDLAEVSSFVKDRLGKEVEMGGCNGPITTFIVEPFVPHNEEFYLNIVSERLGCSISFSECGGIDIEENWDKVKTIFLPTGAFFTSEVCAPLVATLPLEIKNVIEEFIKVIYALFVDLDFTFLEMNPFTLVDGKPYPLDMRGELDDTAAFKNFKKWGNIEFPLPFGRVMSATESFIHGLDEKTSASLKFTVLNPKGRIWTMVAGGGASVIYADTVGDLGYATELGNYAEYSGAPNEEEVLQYARVVIDCATAEPDGRKRALVIGGGIANFTDVAATFNGIIRALKEKESKLKAARMSIYVRRGGPNYQRGLAKMRALGDEIGIPIEVYGPEATMTGICKEAIECITAAA

SEQ ID NO: 8075 - protein, 149 aa, Triphysaria pusilla
MVAGGGASVIYADTVGDLGYASELGNYAEYSGAPNEEEVLQYARVVIDCATADPDGRKRALVIGGGIANFTDVAATFSGIIRALREKEAKLKSARMHLYVRRGGPNYQKGLEKMRTLADEIGIPIEVYGPEATMTGICKQAIDCISAAA

SEQ ID NO: 8076 - protein, 265 aa, Triphysaria pusilla
MARKKIREYDSKRLLKEHFKRISGSELEIKSAQVTESTNFEELVDNEPWISSTKLVVKPDMLFGKRGKSGLVALNLDLAGVAAFVKERLGKEVEMGGCKGPITTFIVEPFVPHNEEYYLNIVSERLGCSISFSECGGIDIEENWDKVKTIFVPTGSSFTSELCAPLVATLPLEIKGVLEEFIKSVYTLFLDLDFTFLEMNPFTLVDGKPYPLDMRGELDDTATFKNFKKWGNIEFPMPFGRVMSPTESFIHGLDEKTSASLKFTF

SEQ ID NO: 8077 - protein, 423 aa, Cichorium intybus
MARKKIREYDSKRLVKEHYKRISGSELAIKSAQVTESTDLNELIEREPWLSSSKLVVKPDMLFGKRGKSGLVALNLDLAQVSEFVKARLGKEVEMGGCKGPITTFIVEPFVPHNDEFYINIVSERLGCSISFSECGGIDIEENWDKVKTIFLPTGVSLNQEICAPLVATLPLEIKSVIEEFIKSIYSLFTDLDFTFLEMNPFTLVDGKPYPLDMRGELDDTAAFKNFKKWGNIEFPLPFGRVMSATESFIHGLDEKTSASLKFTVLNPKGRIWTMVAGGGASVIYADTVGDLGYASELGNYAEYSGAPNEEEVLQYARVVIDCATADPDGQKRALVVGGGIANFTDVAATFNGIIRAMKEKESKLKAANMHIYVRRGGPNYQRGLARMRALGEEIGIPIEVYGPEATMTGICKQAIDCITAAA

SEQ ID NO: 8078 - protein, 424 aa, Aquilegia formosa
MARKKIREYDSKRLLKENFKRISGGSELPIKSAQVTESTDFNEVANKESWLSSGKLVVKPDMLFGKRGKSGLVALNLDLAEVATFVKERLGKEVEMGGCKGPITTFIVEPFIPHTEEFYLNIVSERIGCSLSFSECGGIDIEENWDKVKTVFIPTGSSLTSEICAPLFATLPLEINDTIKEFVKVVYAIFLDLDFTFLEMNPFTLVDGKPYPLDMRGELDDTAAFKNFKKWSGVEFPLPFGRVMSPTESFIHGLDEKTSASLKFTVLNPKGRIWTMVAGGGASVIYADTVGDLGYASELGNYAEYSGAPNEEEVLQYARVVLDCATADPDGRKRALVIGGGIANFTDVAATFSGIIRALREKESKLKAARMHIYVRRGGPNYQRGLAKMRDLGEEIGIPLEVYGPEATMTGICKQAIECITAAA

SEQ ID NO: 8079 - protein, 423 aa, Fagopyrum esculentum
MARKKIREYDSKRLLKEHFKRLAGYELAIRSAQINSSTDLNEVVEKEPWLSSEKLVVKPDMLFGKRGKSGLVALNLDFAQVASFVKERLGKEVEMGGCKGPITTFIVEPFVPHNEEFYLNIVSERLGCTVSFSECGGIDIEENWDKVKTIFVPTGATLTSEVCAPLVATLPLEVKGVIDEFLKVIFSLFQDLDFTFLEMNPFTLVNGKPYPLDMRGELDDTAAFKNFKKWGDIEFPLPFGRIMSPTESFIHGLDEKTSASLKFTVLNPKGRIWTMVAGGGASVIYADTVGDLGFANELGNYAEYSGAPNEDEVLQYARVVIDCATANPDGRKRALVIGGGIANFTDVAATFNGIIRALREKESKLKAARMHLYVRRGGPNYQKGLAKMRALADEIGIPIEVYGPEATMTSICKQAIDCITSSA

SEQ ID NO: 8080 - protein, 423 aa, Rosa hybrid cultivar
MARKKIREYDSKRLLKEHFKRIAGRELPLKSAQITESTDFNELLEKETWLSTSKLVVKPDMLFGKRGKSGLVALNLDFAQVVTFVKERLGKEVEMGGCKGPITTFIVEPFIPHNEEFYINIVSDRLGNSISFSECGGIDIEENWDKVKTIFVPTGASLTPDVSAPLVATLPLEIKSEIEEFIKSVFALFQDLDFTFLEMNPFALVDGKPYPLDMRGELDDTAAFKNFKKWGNIEFPMPFGRVMSPTEKFIHGLDEKTSASLKFTVLNPKGRIWTMVAGGGASVIYADTVGDLGFANELGNYAEYSGAPNEEEVLQYARVVIDCATSDPDGRKRALVIGGGIANFTDVAATFNGIIRALKEKESKLKAARMHLYVRRGGPNYQRGLAKMRALAEEIGLPIEVYGPEATMTGICKQAIQCISAAA

SEQ ID NO: 8081 - protein, 423 aa, Silene vulgaris
MARKKIREYDSKRLLKEHFKRISGSELPIRSAQITESTDLNKLVEREAWLSSEKLVVKPDMLFGKRGKSGLVALNLDFAQVTTFVKERLGKEVEMGGCKGPITTFIVEPFIPHNEEFYLNIVSERLGNSISFSECGGIEIEENWDKVKTVFVPTGVSFSSDVCAPLVGTLPLEVKSVIEEFIKVIFALFLDLDFSFLEMNPFTLVEGKPYPLDMRGELDDTAAFKNFKKWGNIEFPLPFGRVMSPTESFIHGLDEKTSASLKFTVLNPKGRIWTMVAGGGASVIYADTVGDLGYASELGNYAEYSGAPNEEEVLQYARVVIDCATANPDGRTRALVIGGGIANFTDVAATFNGIIRALKEKEAKLKAARMHIYVRRGGPNYQKGLAKMRLLGEEIGIPIEVYGPEATMTGICKQAIECISVSA

SEQ ID NO: 8082 - protein, 423 aa, Glycine max
MARKKIREYDSKRLLKEHFKRLSGKELPIKSAQITASTDFTELQEKEPWLSSSKLVVKPDMLFGKRGKSGLVALNLDFAQVVSFVKERLGKEVEMSGCKGPITTFIVEPFIPHNEEFYLNIVSERLGNSISFSECGGIEIEDNWDKVKTAFVPTGVSLTSEIVAPLVATLPLEIKGEIEEFLKVVFTLFQDLDFTFLEMNPFTLVDGKPYPLDMRGELDDTAAFKNFKKWGDIEFPLPFGRVMSATESFIHGLDEKTSASLKFTVLNPKGRIWTMVAGGGASVIYADTVGDLGFASELGNYAEYSGAPKEEEVLQYARVVIDCATANPDDQKRALVIGGGIANFTDVAATFSGIIRALKEKESKLKAARMHIFVRRGGPNYQKGLALMRALGEDIGIPIEVYGPEATMTGICKEAIQFITAAA

SEQ ID NO: 8083 - protein, 363 aa, Fagopyrum esculentum
MLFGKRGKSGLVALNLDFTQVSAFVKERLGKEVEMSGCKGPITTFIVEPFVPHNEEFYLNIVSDRLGCSISFSECGGIDIEENWDKVKTIFIPTGASFTSEVSAPLVATLPLEVKPVIDEFLRVIFSLFQDLDFTFLEMNPFTLVNGKPYPLDMRGELDDTAAFKNFKKWGNIEFPLPFGRVMSVTESSIHSLDEKTSASLKFTVLNPEGRIWTMVAGGGASVIYADTVGDLGFASELGNYAEYSGAPNEDEVLQYARVVIDCATANPDGRKRALVIGGGIANFTDVAATFNGIIRALKEKESKLKAARMNLYVRRGGPNYQKGLAKMRALAEEIGIPIEVYGPEKTMTGICKQAIDCISVAA

SEQ ID NO: 8084 - protein, 282 aa, Gnetum gnemon
MARKKIREYDSKRLLKEHLRRLAGIQLDIKSAQVTQSTDFNELVDKEPWLSSTKLVVKPDMLFGKRGKSGLVALNLDFVEVVAFIKERLGKEVEMGGAKAPITTFIIEPFVPHNDEYYLSIMSERLGSTINFSECGGMEIEENWDKVKTLFVPTDKQLTSELCAPLIATLPREIRSKIEKFILEVFSVFQDLDFTFLEMNPFTFLNGEPYPLDMRGELDDTAAFKNFKKWGGIEFPMPFGRVMSPAESAVHSMDEKTSASLKLTILNPKDGSGQWLLEEVQV

SEQ ID NO: 8085 - protein, 360 aa, Avena sativa
MARKKIREYDSKRLLKEHLKRLAGIDLQILSAQVTQSTDFTELSNQEPWLSSMKLVVKPDMLFGKRGKSGLVALNLDLAQVRQFVKERLGVEVEMGGCKAPITTFIVEPFVPHDQEYYLSIMSDRLGCTISFSECGGIEIEENWDKVKTIFLPTEKPMTLDACAPLIATLPLEVRTKIGDFIRGSFSVFQDLDFSFMEMNPFTLVNGEPYPLDMRGELDDTAAFKNFKKWGDIEFPLPFGRVLSPSESYIHELDEKTSASLKFTVLNPKGRIWTMVAGGGASVIYADTVGDLGYASELGNYAEYSGAPKEEEVLHYARVVLDCATADPDGRKRALLIGGGIANFTDVAATFSGIIRALRE

SEQ ID NO: 8086 - protein, 421 aa, Flaveria ramosissima
MARKKIREFDSKRLLKEHFKRISGSEMPIKSAQVTDSTDFNVLAKREPWLSSSKLVVKPDMLFGKRGKSGLVALNLDLAQVAEFVKERLGKEVVMGGCKGPITTFIVEPFIPHNEEFYINIVSERLGCSISFSECGGIDIEENWDKVKTIFLPTGVSLNQELCAPLVATLPLEFKSVIEEFITHIYSLFLDLDFTFLEMNPFTLVNGKPYPLDMRGELDDTAAFKNFKKWGNIEFPMPFGRVMSSTESFIHELDEKTSASLKFTVLNPKGRIWTMVAGGGASVIYADTVGDLGYASELGNYAEYSGAPNEEEVLQYARVVIDCATSDPDGQKRALVVGGGIANFTDVAATFNGIIRAMKEKESQLKAANMHIYVRRGGPNYQRGLARMRALGAEIGIPIEVYGPEATMTGICKQAIECIMV

SEQ ID NO: 8087 - protein, 423 aa, Chrysanthemum coronarium
MARKKIREYDSKRLVKEHFKRISGSDLPIKSAQVTESTDFNELVEREPWLSSSKLVVKPDMLFGKRGKSGLVALNLDLAQVAEFVKERLGKEVEMGGCKGPITTFIVEPFVPHSEEFYINIVSERLGCSISFSECGGIDIEENWDKVKTIFLATGVSLSREICAPLVATLPLEFKTVIEDFIKHTYSLFVDLDFTFLEMNPFTLVEGKPYPLDMRGELDDTAAFKNFKKWGNLEFPMPFGRVMSSTESFIHGLDEKTSASLKFTVLNPKGRIWTMVAGGGASVIYADTVGDLGYASELGNYAEYSGAPNEDEVLQYARVVIDCATADPDGQRRALVVGGGIANFTDVAATFNGIIRAMKEKESKLKAANMHIYVRRGGPNYQRGLARMRALGAELGIPIEVYGPEATMTGICKQAIECITVAA

SEQ ID NO: 8088 - protein, 423 aa, Cichorium intybus
MARKKIKEYDSKRLVKEHYKRISGSELAIKSAQVTESTDLNELIEREPWLSSSKLVVKPDMLFGKRGKSGLVALNLDLAQVSEFVKARLGKEVEMGGCKGPITTFIVEPFVPHNDEFYINIVSERLGCSISFSECGGIDIEENWDKVKTIFLPTGVSLNQEICAPLVATLPLEIKSVIEEFIKSIYSLFTDLDFTFLEMNPFTLVDGKPYPLDMRGELDDTAAFKNFKKWGNIEFPLPFGRVMSATESFIHGLDEKTSASLKFTVLNPKGRIWTMVAGGGASVIYADTVGDLGYASELGNYAEYSGAPNEEEVLQYARVVIDCATADPDGQKRALVVGGGIANFTDVAATFNGIIRAMKEKESKLKAANMHIYVRRGGPNYQRGLARMRALGEEIGIPIEVYGPEATMTGICKQAIDCITAAA

SEQ ID NO: 8089 - protein, 423 aa, Petroselinum crispum
MARKKIREYDSKRLLKEHYKRITGAELGIKSAQITESTNINELVEKEPWLSSSKLVVKPDMLFGKRGKSGLVALNLDLSQVDAFVKERLGKEVEMGGCKGPITTFIVEPFVPHNEEFYLNMVSDRLGCSISFSECGGIDIEENWDKVKTISVPTGVSMTPDICAPLVATLPLEIKSVIEEFIKVIFILFADLDFTFLEMNPFTLVDGKPYPLDMRGELDDTAAFKNFKKWGDIEFPLPFGRVMSSTESFIHGLDEKTSASLKFTVLNPKGRIWTMVAGGGASVIYADTVGDLGFAEELGNYAEYSGAPNEEEVLQYARVVIDCATADPDGRKRALVVGGGIANFTDVAATFNGIIRALKEKESKLKAARMHIYVRRGGPNYQKGLAKMRSLGEEIGIPIEVYGPEETMTGICKQAIECISAAA

SEQ ID NO: 8090 - protein, 423 aa, Capsicum annuum
MAREKIREYDSKRLLKEHFKRLAGYDLAIKSAQVTESTDINELAEKEPWLHSTKLVVKPDMLFGKRGKSGLVALNLDLAQVATFVKERLGKEVEMGGCEGPITTFIIEPFIPHNEEFYLNIVSERLGCSVSFSECGGIDIEENWDKVKTIFVPTGTSFTSVICAPLVATLPSEIKGVIEEFLKVIYALFQDLDFTFLEMNPFTLVEGKPYPLDMRGELDNTAAFKNFKKWGNIEFPLPFGRVMSATESFIHGLDEKTSASLKFTVLNPKGRIWTMVAGGGASVIYADTVGDLGYASELGNYAEYSGAPNEEEVLQYARVVIDCTTANPDGRKRALVIGGGIANFTDVAATFSGIIRALKEKESKLKAARVHIYVRRGGPNYQKGLAKMRSLGEEIGIPIEVYGPEETMTGICKQAIECITAAA

SEQ ID NO: 8091 - protein, 423 aa, Ambrosia trifida
MARKKIREYDSKRLVKEHFKRISGSELPIKSAQITESTDFNELVQREPWLSSSKLVVKPDMLFGKRGKSGLVALNLDLAQVAEFVKERLGKEVVMDGCKGPITTFIVEPFVPHNEEFYINIVSERLGCSISFSECGGIDIEENWDKVKTIFLPTGVVLNQEICAPLIATLPLEYKSVIEGFITNIYSLFIDLDFTFLEMNPFTLVDGKPYPLDMRGELDDTAAFKNFKKWGNIEFPMPFGRVMSPTESFIHGLDEKTSASLKFTVLNPKGRIWTMVAGGGASVIYADTVGDLGYASELGNYAEYSGAPNEEEVLQYARVVIDCATADPDGQRRALVVGGGIANFTDVAATFNGIIRAMKEKESKLKAANMHIYVRRGGPNYQRGLARMRALGAEIGIPIEVYGPEATMTGICKQAIECIMVGA

SEQ ID NO: 8092 - protein, 423 aa, Vigna unguiculata
MARKKIREYDSKRLLKEHFKRLSGQDLPIKSAQVTESTDFNELPEKEPWLLSSKLVVKPDMLFGKRGKSGLVALNLDLAEVASFVKERLGKEVEMSGCKGPITTFIVEPFIPHKEEFYLNIVSERLGNSISFSECGGIEIEENWDKVKTVFMPTGLSLTSESIAPLVATLPLEIRGEVEEFLKVIYTLFQDLDFTFLEMNPFTLVNGKPYPLDMRGELDDTAAFKNFKKWGNIEFPLPFGRVMSSTEAFIHGLDEKTSASLKFTVLNPKGRIWTMVAGGGASVIYADTVGDLGYAPELGNYAEYSGAPKEDEVLQYARVVIDCATSNPDDQKRALVIGGGIANFTDVAATFSGIIRALKEKEQKLKEAKMHIYVRRGGPNYQSGLAKMRALGEEIGIPIEVYGPEATMTGICKQAIQYITAAA

SEQ ID NO: 8093 - protein, 423 aa, Flaveria ramosissima
MARKKIREYDSKRLVKEHFKRISGTELAIKSAQVTETTDLNELIKEEPWLSSSKLVVKPDMLFGKRGKSGLVALNLDLAQVSEFVKARLGKEVEMGGCKGPITTFIVEPFVPHNEEFYINIVSERLGCSISFSECGGIDIEENWDKVKTIFLPTGMSLNQEICAPLVATLPLEIKPVIEEFIKAIYSLFLDLDFTFLEMNPFTLVDGKPYPLDMRGELDDTAAFKNFKKWGNLEFPLPFGRVMSATESFIHGLDEKTSASLKFTVLNPKGRIWTMVAGGGASVIYADTVGDLGYASELGNYAEYSGAPNEEEVLQYARVVIDCATADPDGQKRALVVGGGIANFTDVAATFNGIIRAMKEKESKLKAANMHIYVRRGGPNYQKGLAKMRALGEEIGIPIEVYGPEATMTGICKQAIDYITAAA

SEQ ID NO: 8094 - protein, 421 aa, Orobanche aegyptiaca
RKKIREYDSKRLLKEHFKRISGSELEIKSAQVTESTDFNELVEKEAWLSSTKLVVKPDMLFGKRGKSGLVALNLDLAGVAAFVKDRLGKEVEMGGCKGPITTFIVEPFVPHTEEYYLNIVSERLGCSISFSECGGIEIEENWDKVKTVFVPTGVSFTSDLCAPLLATLPLEIKGVIEEFIKVIYALFLDLDFTFLEMNPFTLVGGKPYPLDMRGELDDTATFKNFKKWGNIEFPMPFGRVMSPTESFIHGLDEKTSASLKFTVLNPKGRIWTMVAGGGASVIYADTVGDLGYASELGNYAEYSGAPSEEEVLQYARVVIDCATAEPDGRKRALVVGGGIANFTDVAATFSGIIRALKEKEAKLKAARMHLYVRRGGPNYQKGLARMRNLAAEIGIPIEVYGPEATMTGICKQAIECISAAA

SEQ ID NO: 8095 - protein, 423 aa, Phalaenopsis aphrodite
MARKKIREYDSKRLLKQHLRRLCGIELHIRSAQITESTEINELVEREPWLLSEKLVVKPDMLFGKRGKSGLVGLNLDLNQVASFVKDRLGKEVEIGGCKGPVTTFIVEPFVPHSQEFYLSIVSDRLGCNISFSECGGIEIEENWDKVRTVFIPCETSLTSDNCASLIATLPLELKGKIEEFIKAVFILFLDLDFTFLEMNPFTLANGNPYPLDMRGELDDTAAFKNFKKWGDIEFPMPFGRVMSATETFIHGLDEKTSASLKFTVLNPRGRIWTMVAGGGASVIYADTVGDLGYASELGNYAEYSGAPKEDEVLQYARVVIDCATSNPDGRKRALLIGGGIANFTDVAATFNGIIRALREKEAKLKAARMHVYVRRGGPNYQAGLAKMRKLGEEVGIPLEVYGPEATMTGICKQAIECISAAA

SEQ ID NO: 8096 - protein, 423 aa, Populus trichocarpa
MARKKIREYDSKRLLREHFKRFSGRDLPIKSAQVTESTDFNELAEKEPWLASAKLVVKPDMLFGKRGKSGLVALDLDLDQVAEFIQGRLGKEVEMGGCKGPITTFIIEPFIPHNQEFYLNIVSERLGCSISFSECGGIEIEENWDKVKTIFVPTRATFTSGDCALLVATLPSAIKGEIEEFIQVVFALFQDLDFTFLEMNPFTFVDGKPYPLDMRGELDDTAAFKNFKKWGSIEFPMPFGRVMSPSESFVHGLDEKTSASLKFTVLNPKGRIWTMVAGGGASVIYADTVGDLGYATELGNYAEYSGAPNEEEVLRYARVVIDCATADPDGHKRALVIGGGIANFTDVAATFNGIIRTLKEKESKLKAARMSIYVRRGGPNYQTGLAKMRALGEEIGIPIEVYGPEATMTGICKQAIECITAAA

SEQ ID NO: 8097 - protein, 364 aa, Brassica napus
MARKKIREYDSKRLLKEHLKRLANINLQIRSAQVTEATDFTELTNQEAWLSSTKLVVKPDMLFGKRGKSGLVALKLDLAEVAEFVKARLGSEVEMGGCKAPITTFIVEPFVPHDQEYYLSIVSDRLGCTISFSECGGIEIEENWDKVKTVFLPAEKSMTLEVCAPLIATLPLEVRGKIGSFIMGVFAVFQDLDFSFMEMNPFTLVDGEPYPLDMRGELDDTAAFKNFNKWGDIEFPLPFGRVLSPTESFIHGLDEKTSASLKFTVLNPKGRIWTMVAGGGASVIYADTVGDLGYASELGNYAEYSGAPNEEEVLQYARVVIDCATADPDGRKRALLIGGGIANFTDVAATFNGIIRALREKEQD

SEQ ID NO: 8098 - protein, 430 aa, Trifolium pratense
MARKKIREYDSKRLLKEHFKRLSGKDLPIKSAQVTEVTDFTELQDKEPWLSSSKLVVKPDMLFGKRGKSGLVALNLDLAQVASFVKERLGKEVEMGGCKGPITTFIVEPFIPHNEEFYLNIVSDRLGNSVSFSECGGIDIEENWDKVKTVFVPTGVSLTSEIVAPLVATLPLEIKGEIEEFLKVIFTLFQDLDFTFLEMNPFTLVDGKPYPLDMRGELDDTAAFKNFKKRCRTGCRWGNIEFPLPFGRVMSATESFIHGLDEKTSASLKFTVLNPKGRIWTMVAGGGASVIYADTVGDLGFANELGNYAEYSGAPNEEEVLQYARVVIDCATADPDGRKRALVIGGGIANFTDVAATFSGIIRALKEKESKLKAARMHIYVRRGGPNYQKGLEKMRALGDEIGIPIEVYGPEATMTGICKEAIQCITASA

SEQ ID NO: 8099 - protein, 423 aa, Chrysanthemum coronarium
MARKKIREYDSKRLVKEHFQRISGSDLPIKSAQVTESTDFTELVEREPWLSSSKLVVKPDMLFGKRGKSGLVALNLDLAQVAEFVKDRLGKEVEMGGCKGPITTFIVEPFVPHNEEFYINIVSERLGCSISFSECGGIDIEENWDKVKTIFLPTGVSLSQEICAPVVATLPLECKPVIEDFIKHTYSLFVDLDFTFLEMNPFTLVEGKPYPLDMRGELDDTAAFKNFKKWGNIEFPMPFGRVMSSTESFIHGLDEKTSASLKFTVLNPKGRIWTMVAGGGASVIYADTVGDLGYASELGNYAEYSGAPNEDEVLQYARVVIDCATADPDGQRRALVVGGGIANFTDVAATFNGIIRAMKEKESKLKAANMHIYVRRGGPNYQRGLARMRALGAELGIPIEVYGPEATMTGICKQAIECITVAA

SEQ ID NO: 8100 - protein, 423 aa, Cirsium arvense
MARKKIREYDSKRLVKEHYKRISGSELAIRSAQVTESTDLNELIEKEPWLSSSKLVVKPDMLFGKRGKSGLVALNLDLAQVSEFVKARLGKEVEMGGCKGPITTFIVEPFVPHNDEFYINIVSERLGCSISFSECGGIDIEENWDKVKTIFLPTGVSLNQEICAPLVATLPLEIKPVIEEFITNIYSLFIDLDFTFLEMNPFTLVDGKPYPLDMRGELDDTAAFKNFKKWGNIEFPLPFGRVMSATESFIHGLDEKTSASLKFTVLNPKGRIWTMVAGGGASVIYADTVGDLGFASELGNYAEYSGAPNEEEVLQYARVVIDCATADPDGQKRALVVGGGIANFTDVAATFNGIIRAMKEKESKLKAANMHIYVRRGGPNYQKGLARMRALGDEIGIPIEVYGPEATMTGICKQAIECITAAA

SEQ ID NO: 8101 - protein, 423 aa, Gossypium hirsutum
  Sequence also found in Organisms: Gossypium raimondii
MARKKIREYDSKRLLKEHFKRLSGRDLPIKSAQITESTDFNQLVEKEPWLSSQKLVVKPDMLFGKRGKSGLVGLNLDFAQVIAFVKERLGKEVEMSGCKGPVTTFIVEPFIPHNEEFYLNIVSERLGCSISFSECGGIEIEENWDKVKTIFVPTGLLLTSETCAPLVATLPLEIKGEIEEFIKVIFNLFQDLDFTFLEMNPFTLVDGKPYPLDMRGELDDTAAFKNFKKWGNIEFPMPFGRVMSATESYIHGLDEKTSASLKFTVLNPKGRIWTMVAGGGASVIYADTVGDLGFASELGNYAEYSGAPNEEEVLQYARVVIDCATADPDGRKRALVIGGGIANFTDVGATFNGIIRALKEKESKLKAARMMLYVRRGGPNYQRGLAKMRALGEEIGIPIEVYGPEATMTGICQQAIQYISAAA

SEQ ID NO: 8102 - protein, 423 aa, Lactuca sativa
MARKKIREYDSKRLVKEHFKRISGSELAIKSAQVTESTDLNELIEREPWLSSSKLVVKPDMLFGKRGKSGLVALNLDLAQVSEFVKARLGKEVEMGGCKGPITTFIVEPFIPHNDEFYINIVSERLGCSISFSECGGIDIEENWDKVKTIFLPTGISLNQEICAPLVATLPLEIKPVIEDFIKSIYTLFIDLDFTFLEMNPFTLVDGKPYPLDMRGELDDTAAFKNFKKWGNIEFPLPFGRVMSATESFIHGLDEKTSASLKFTVLNPKGRIWTMVAGGGASVIYADTVGDLGYASELGNYAEYSGAPNEEEVLQYARVVIDCATADPDGQKRALVVGGGIANFTDVAATFNGIIRAMKEKESKLKAANMHIYVRRGGPNYQRGLARMRALGEEIGIPIEVYGPEATMTGICKQAIDCITAAA

SEQ ID NO: 8103 - protein, 423 aa, Glycine max
MARKKIREYDSKRLLKEHFKRISGQELPIKSAQVTESTNFSELAEKEPWLLSSKLVVKPDMLFGKRGKSGLVALNLDLAEVDSFVKERLGKEVEMGGCKGPITTFIVEPFIPHNEEFYLNIVSERLGNSISFSECGGIEIEENWDKVKTVFMPTGVSLTSESIAPLVATLPLEIKGEIEEFLKVIFTLFQDLDFTFLEMNPFTLVNGKPYPLDMRGELDDTAAFKNFKKWGNIEFPLPFGRVMSTTEAFIHGLDEKTSASLKFTVLNPMGRIWTMVAGGGASVIYADTVGDLGYAPELGNYAEYSGAPKEDEVLQYARVVIDCATSNPDGQKRALVVGGGIANFTDVAATFSGIIRALKEKEQKLKEAKMHIYVRRGGPNYQKGLAKMRALGEEIGIPIEVYGPEATMTGICKQAIQYITAAA

SEQ ID NO: 8104 - protein, 423 aa, Helianthus annuus
MARKKIREYDSKRLVKEHFKRISGSDLAIKSAQITESTDLNELVNVEPWLSSSKLVVKPDMLFGKRGKSGLVALNLDLAQVSEFVKARLGKEVEMGGCKGPITTFIVEPFVPHNEEFYINIVSERLGCSISFSECGGIDIEENWEKVKTIFLPTGVSLNQEICAPLVATLPLEIKPVIEEFIKAIYSLFIDLDFTFLEMNPFTLVDGKPYPLDMRGELDDTAAFKNFKKWGNLEFPLPFGRVMSATESFIHGLDEKTSASLKFTVLNPKGRIWTMVAGGGASVIYADTVGDLGYASELGNYAEYSGAPNEEEVLQYARVVIDCATADPDGQKRALVVGGGIANFTDVAATFNGIIRAMKEKEAKLKAANMHIYVRRGGPNYQKGLAKMRALGEEIGIPIEVYGPEATMTGICKQAIEYITAAA

SEQ ID NO: 8105 - protein, 423 aa, Chrysanthemum coronarium
MARKKIREYDSKRLVKEHYKRISGNDLVIKSAQVTESTDLNELIEREPWLSSSKLVVKPDMLFGKRGKSGLVALNLDLAQVAEFVKARLGKEVEMGGCKGPITTFIVEPFVPHSEEFYINIVSERLGCSISFSECGGIDIEENWDKVKTIFLATGVSLSREICAPLVATLPLEFKTVIEDFIKHTYSLFVDLDFTFLEMNPFTLVEGKPYPLDMRGELDDTAAFKNFKKWGNLEFPMPFGRVMSSTESFIHGLDEKTSASLKFTVLNPKGRIWTMVAGGGASVIYADTVGDLGYASELGNYAEYSGAPNEDEVLQYARVVIDCATADPDGQRRALVVGGGIANFTDVAATFNGIIRAMKEKESKLKAANMHIYVRRGGPNYQRGLARMRALGAELGIPIEVYGPEATMTGICKQAIECITVAA

SEQ ID NO: 8106 - protein, 423 aa, Trifolium pratense
MARKKIREYDSKRLLKEHFKRISGQELPIKSAQIIESTDINELVEKEPWLSSSKLVVKPDMLFGKRGKSGLVALNLDLAEVAGFVKERLGKEVEMGGCKGPITTFIVEPFIPHNEEYYLNIVSERLGNSISFSECGGIDIEENWDKVKTVFIPTGESLTSDNISALIATLPLEVKGEIEEFLKVIFNIFQDLDFTFLEMNPFTLVNGKPYPLDMRGELDDTAAFKNFKKWGNIEFPLPFGRVMSSTESFIHGLDEKTSASLKFTVLNPMGRIWTMVAGGGASVIYADTVGDLGYAPELGNYAEYSGAPKEDEVLQYARVVIDCATANQDGQKRALVIGGGIANFTDVAATFSGIIRALKEKEQKLKEANMYIYVRRGGPNYQRGLAKMRALGEEIGIPIEVYGPEATMTGICKQAIQCITASA

SEQ ID NO: 8107 - protein, 423 aa, Ananas comosus
MARKKIREYDSKRLLKQHLQRLFGIHLPIRSAQITEATDLMALAEAEPWLSSEKLVVKPDMLFGKRGKSGLVGLNLDLAQVAAFTKERLGKQVEIGGCKGPITTFIVEPFVPHSQEFYLSVVSERLGCSISFSECGGIEIEENWDKVKTVFIPSDTSLSPETCAPLLATLTLEIKGEIEDFITKVFVTFLDLDFTFLEMNPFTLVDGKPYPLDMRGELDDTAAFKNFKKWGDIEFPMPFGRVMSPTESFVHKLDEKTSASLKFTVLNPQGRIWTMVAGGGASVIYADTVGDLGYASELGNYAEYSGAPKEEEVLQYARVVIDCATANPDGRKRALVIGGGIANFTDVAATFSGIIRALREKESNLKASRMHVIVRRGGPNYQTGLRKMRHLGEEIGIPIEVYGPEATMTGICKQAIECITAAA

SEQ ID NO: 8108 - protein, 423 aa, Malus domestica
MARKKIREYDSKRLLKEHFKRLAGRELPLKSAQITETTDVNELLEKESWLSSSKLVVKPDMLFGKRGKSGLVALNLDFAQVVDFVKERLGKEVEMGGCKGPITTFIVEPFIPHNEEFYLNIVSDRLGNSISFSECGGIDIEENWDKVKTIFVPTGVAFTSEVSAPLVATLPLEIKAELEDFIKAVFALFQDLDFTFLEMNPFALVDGKPYPLDMRGELDDTAAFKNFKKWGSIEFPMPFGRVMSPTEKFIHGLDEKTSASLKFTVLNPKGRIWTMVAGGGASVIYADTVGDLGFADELGNYAEYSGAPNEEEVLQYARVVIDCATSDPDGRKRALVIGGGIANFTDVAATFNGIIRALKEKESKLKAAQMHLYVRRGGPNYQRGLAKMRALAEEIGLPIEVYGPEATMTGICKQAIQCISAAA

SEQ ID NO: 8109 - protein, 423 aa, Arabidopsis thaliana
MARKKIREYDSKRLVKEHFKRLSGKELPIRSVQINETTDLNELVEKEPWLSSEKLVVKPDMLFGKRGKSGLVALKLDFADVATFVKERLGKEVEMSGCKGPITTFIVEPFVPHNEEYYLNVVSDRLGCSISFSECGGIEIEENWDKVKTIFLPTGASLTPEICAPLVATLPLEIKAEIEEFIKVIFTLFQDLDFTFLEMNPFTLVDGSPYPLDMRGELDDTAAFKNFKKWGDIEFPLPFGRVMSPTESFIHGLDEKTSASLKFTVLNPKGRIWTMVAGGGASVIYADTVGDLGYASELGNYAEYSGAPKEDEVLQYARVVIDCATANPDGKSRALVIGGGIANFTDVAATFNGIIRALKEKEAKLKAARMHIFVRRGGPNYQKGLAKMRALGDDIGVPIEVYGPEATMTGICKEAIQYITAAA

SEQ ID NO: 8110 - protein, 423 aa, Phaseolus vulgaris
MARKKIREYDSKRLLKEHFKRISGQDLPIKSAQVTESTDFSELPEKEPWLLSSKLVVKPDMLFGKRGKSGLVALNLDLAEVASFVKELLGKEAEISGCKGPITTFIVEPFIPHNEEFYLNIVSERLGNSISFSECGGIEIEENWDKVKTVFMPTGLSLTSESIAPLVATLPLEIRGEIEEFLRVIYTLFQDLDFTFLEMNPFTLVNGKPYPLDMRGELDDTAAFKNFKKWGNIEFPLPFGRVMSSTEAFIHGLDEKTSASLKFTVLNPKGRIWTMVAGGGASVIYADTVGDLGYAPELGNYAEYSGAPKEDEVLQYARVVIDCATSNPDDQKRALVIGGGIANFTDVAATFSGIIRALKEKEQKLKDAKMHIYVRRGGPNYQSGLAKMRALGEEIGIPIEVYGPEATMTGICKQAIHYITAAA

SEQ ID NO: 8111 - protein, 423 aa, Centaurea maculosa
MARKKIREFDSKRLVKEHFKRISGSELPIKSAQVTESTDFNELAEKEPWLSSSKLVVKPDMLFGKRGKSGLVALNLDLAQVAEFVKERLGKEIVMGGCKGPITTFIVEPFVPHHEEFYINIVSERLGCSISFSECGGIDIEENWDQVKTIFLPTGVSLTQETCAPLVATLPLEFKSVIEEFITHVYSLFIDLDFTFLEMNPFTLVDKKPYPLDMRGELDDTAAFKNFKKWGNIEFPMPFGRVMSPTERFIHGLDEKTSASLKFTVLNPKGRIWTMVAGGGASVIYADTVGDLGYASELGNYAEYSGAPNEEEVLQYARVVIDCATADPDGQRRALVVGGGIANFTDVAATFNGIIRAMKEKVSKLKAANMHIYVRRGGPNYQRGLARMRALGAELGIPIEVYGPEATMTGICKQAIECITVAA

SEQ ID NO: 8112 - protein, 423 aa, Cirsium arvense
MARKKIREFDSKRLVKEHFKRISGSELPIKSAQVTESTDFNELVEKEPWLSSSKLVVKPDMLFGKRGKSGLVALNLDLAQVAEFVKERLGKEIVMGGCKGPITTFIVEPFVPHHEEFYINIVSERLGCSISFSECGGIEIEENWDQVKTIFLPTGVSLNQEICAPLVATLPLEFKSVIEGFIQHVYSLFIDLDFTFLEMNPFTLVDGKPYPLDMRGELDDTATFKNFKKWGSIEFPMPFGRVMSPTERFIHGLDEKTSASLKFTVLNPKGRIWTMVAGGGASVIYADTVGDLGYASELGNYAEYSGAPNEEEVLQYARVVIDCATADPDGQRRALVVGGGIANFTDVAATFNGIIRAMKEKESKLKAANMHIYVRRGGPNYQRGLARMRALGAELGIPIEVYGPEATMTGICKQAIECITVAA

SEQ ID NO: 8113 - protein, 423 aa, Taraxacum officinale
MARKKIREYDSKRLVKEHYKRISGSELAIKSAQVTESTDLNELIEKEPWLSSSKLVVKPDMLFGKRGKSGLVALNLDLAQVSEFVKARLGKEVEMGGCKGPITTFIVEPFVPHNDEFYINIVSERLGCSISFSECGGIDIEENWDKVKTIFLPTGVSLNQEICAPLVATLPLEIKSVIEEFIRSIYTLFIDLDFTFLEMNPFTLVDGKPYPLDMRGELDDTAAFKNFKKWGNIEFPLPFGRVMSATESFIHGLDEKTSASLKFTVLNPKGRIWTMVAGGGASVIYADTVGDLGYASELGNYAEYSGAPNEEEVLQYARVVIDCATADPDGQKRALVVGGGIANFTDVAATFNGIIRAMKEKEAKLKAANMHIYVRRGGPNYQRGLARMRALGDEIGIPIQVYGPEATMTGICKQAIDCITASA

SEQ ID NO: 8114 - protein, 423 aa, Flaveria ramosissima
MARKKIREFDSKRLVKEHFKRISGSEMPIKSAQVTESTDFNELAKTEPWLSSSKLVVKPDMLFGKRGKSGLVALNLDLAQVAEFVKERLGKEVVMGGCKGPITTFIVEPFIPHNEEFYINIVSERLGCSISFSECGGIDIEENWDKVKTIFLPTGVSLNQELCAPLVATLPLEFKSVIEEFITHIYSLFLDLDFTFLEMNPFTLVNGKPYPLDMRGELDDTAAFKNFKKWGNIEFPMPFGRVMSSTESFIHELDEKTSASLKFTVLNPKGRIWTMVAGGGASVIYADTVGDLGYASELGNYAEYSGAPNEEEVLQYARIVIDCATADPDGQRRALVVGGGIANFTDVAATFNGIIRAMKEKESQLKAANMHIYVRRGGPNYQRGLARMRALGAEIGIPIEVYGPEATMTGICKQAIECIMVAS

SEQ ID NO: 8115 - protein, 423 aa, Helianthus annuus
MARKKIREYDSKRLVKEHFKRISGSDLAIKSAQITESTDLNELVKVEPWLSSAKLVVKPDMLFGKRGKSGLVALNLDLAQVSEFVKARLGKEVEMGGCKGPITTFIVEPFVPHNEEFYINIVSERLGCSISFSECGGIDIEENWEKVKTIFLPTGVSLNQEICAPLVATLPLEIKPVIEEFIKAIYSLFIDLDFTFLEMNPFTLVDGKPYPLDMRGELDDTAAFKNFKKWGNLEFPLPFGRVMSATESFIHGLDEKTSASLKFTVLNPKGRIWTMVAGGGASVIYADTVGDLGYASELGNYAEYSGAPNEEEVLQYARVVIDCATADPDGQKRALVVGGGIANFTDVAATFNGIIRAMKEKEAKLKAANMHIYVRRGGPNYQKGLAKMRALGEEIGIPIEVYGPEATMTGICKQAIEYITAAA

SEQ ID NO: 8116 - protein, 423 aa, Chrysanthemum coronarium
MARKKIREYDSKRLVKEHYKRISGNDLVIKSAQVTESTDLNELIEREPWLSSSKLVVKPDMLFGKRGKSGLVALNLDLAQVAEFVKARLGKEVEMGGCKGPITTFIVEPFVPHNEEFYINIVSERLGCSISFSECGGIDIEENWDKVKTIFLPTGVSLNQEIVAPLVATLPLEIKPVIEEFIKSIYSLFVDLDFTFLEMNPFTLVDGKPYPLDMRGELDDTAAFKNFKKWGNIEFPLPFGRVMSATESFIHGLDEKTSASLKFTVLNPKGRIWTMVAGGGASVIYADTVGDLGFASELGNYAEYSGAPNEDEVLQYARVVIDCATADPDGQKRALVVGGGIANFTDVAATFNGIIRAMKEKESKLKTANMHIYVRRGGPNYQKGLAKMRALGDEIGIPIEVYGPEATMTGICKQAIECITASA

SEQ ID NO: 8117 - protein, 423 aa, Trifolium pratense
MARKKIREYDSKRLLKEHFKRISGQELPIKSAQIIESTDINELVEKEPWLSSSKLVVKPDMLFGKRGKSGLVALNLDLAEVAGFVKERLGKEVEMGGCKGPITTFIVEPFIPHNEEYYLNIVSERLGNSISFSECGGIDIEENWDKVKTVFIPTGESLTSENISALIATLPLEVKGEIEEFLKVIFNIFQDLDFTFLEMNPFTLVDGKPYPLDMRGELDDTAAFKNFKKWGNIEFPLPFGRVMSPTESFVHGLDEKTSASLKFTVLNPMGRIWTMVAGGGASVIYADTVGDLGYAPELGNYAEYSGAPKEDEVLQYARVVIDCATANPDGQKRALVIGGGIANFTDVAATFSGIIRALKEKEQKLKEANMHIYVRRGGPNYQRGLAKMRALGEEIGIPIEVYGPEATMTGICKQAIQCITASA

SEQ ID NO: 8118 - protein, 423 aa, Malus domestica
MARKKIREYDSKRLLKEHFKRLAGRDLPLKSAQITETTDVNELLEKESWLSSSKLVVKPDMLFGKRGKSGLVALNLDFAQVVEFVKERLGKEVEMGGCKGPITTFIVEPFIPHNEEFYLNIVSDRLGNSISFSECGGIDIEENWDKVKTIFVPTGVAFSSEVSAPLVATLPLEIKAELEDFIKAVFALFQDLDFTFLEMNPFALVDGKPYPLDMRGELDDTAAFKNFKKWGSIEFPMPFGRVMSPTEKFIHGLDEKTSASLKFTVLNPKGRIWTMVAGGGASVIYADTVGDLGFADELGNYAEYSGAPNEEEVLQYARVVIDCATSEPDGRKRALVIGGGIANFTDVAATFNGIIRALKEKESKLKAAQMHLYVRRGGPNYQRGLAKMRALAEEVGLPIEVYGPEATMTGICKQAIQCITAAA

SEQ ID NO: 8119 - protein, 423 aa, Arnica chamissonis
MARKKIREYDSKRLVKEHFKRISGSELPVKSAQVTESTDFNELVKSEPWLSSSKLVVKPDMLFGKRGKSGLVALNLDLAQVAEFVKERLGKEVVMEGCKGPITTFIVEPFIPHNEEFYFNIVSERLGCSISFSECGGIDIEENWDKVKTIFLPTGVLLNQEICAPLVATLPLQYKSVIEEFITHIYSLFLDLDFTFLEMNPFTLVNGKPYPLDMRGELDDTAAFKNFKKWGNIEFPLPFGRVMSPTESFIHGLDEKTSASLKFTVLNPKGRIWTMVAGGGASVIYADTVGDLGYASELGNYAEYSGAPNEEEVLQYARVVIDCATADPDGQRRALVVGGGIANFTDVAATFNGIIRAMKEKESKLKAANMHIYVRRGGPNYQRGLERMRGLGAEIGIPIEVYGPEATMTGICKQAIECIMVGA

SEQ ID NO: 8120 - protein, 423 aa, Centaurea maculosa
MARKKIREYDSKRLVKEHYKRISGSELAIRSAQVTESTNLNELIEKEPWLSSSKLVVKPDMLFGKRGKSGLVALNLDLAQVSEFVKARLGKEVEMGGCKGPITTFIVEPFVPHNDEFYINIVSERLGCSISFSECGGIDIEENWDKVKTIFLPTGVSLNQEICAPLVATLPLEIKSVIEEFITNIYALFIDLDFTFLEMNPFTLVDGKPYPLDMRGELDDTAAFKNFKKWGNIEFPLPFGRVMSATESFIHGLDEKTSASLKFTVLNPKGRIWTMVAGGGASVIYADTVGDLGFASELGNYAEYSGAPNEEEVLQYARVVIDCATADPDGQKRALVVGGGIANFTDVAATFNGIIRAMKEKESKLKAANMHIYVRRGGPNYQKGLARMRALGDEIGIPIEVYGPEATMTGICKQAIECITAAA

SEQ ID NO: 8121 - protein, 423 aa, Centaurea maculosa
MARKKIREYDSKRLVKEHYKRISGSELAIRSAQVTESTDLNELIEKEPWLSSSKLVVKPDMLFGKRGKSGLVALNLDLAQVSEFVKARLGKEVEMGGCKGPITTFIVEPFVPHNDEFYINIVSERLGCSLSFSECGGIDIEENWDKVKTIFLPTGVSLNQEICAPLVATLPLEIKPVIEEFITNIYALFIDLDFTFLEMNPFTLVDGKPYPLDMRGELDDTAAFKNFKKWGNIEFPLPFGRVMSATESFIHGLDEKTSASLKFTVLNPKGRIWTMVAGGGASVIYADTVGDLGFASELGNYAEYSGAPNEEEVLQYARVVIDCATADPDGQKRALVVGGGIANFTDVAATFNGIIRAMKEKESKLKAANMHIYVRRGGPNYQKGLARMRALGDEIGIPIEVYGPEATMTGICKQAIECITAAA

SEQ ID NO: 8122 - protein, 423 aa, Cichorium intybus
MARKKIREYDSKRLVKEHYKRISGSELPIKSAQVTESTDFNELVEREPWLSSSKLVVKPDMLFGKRGKSGLVALNLDLAQVAEFVKERLGKEVVMGGCQGPITTFIVEPFVPHNEEFYINIVSERLGCSISFSECGGIDIEENWDKVKTIFLPTGVSLNQEICAPLVATLPLEFKPVIEQFITHIYSLFVDLDFTFLEMNPFTLVDGKPYPLDMRGELDDTAAFKNFKKWGNIEFPMPFGRVMSATESFIHGLDEKTSASLKFTVLNPKGRIWTMVAGGGASVIYADTVGDLGYASELGNYAEYSGAPNEEEVLQYARVVIDCATADPDGQRRALVVGGGIANFTDVAATFNGIIRAMKEKVSKLKAANMHIYVRRGGPNYQRGLARMRALGAELGIPIEVYGPEATMTGICKQAIECITVSA

SEQ ID NO: 8123 - protein, 423 aa, Cirsium arvense
MARKKIREFDSKRLVKEHFKRISGSELPIKSAQVTESTDFNELAEKEPWLSSSKLVVKPDMLFGKRGKSGLVALNLDLAQVAEFVKERLGKEIVMGGCKGPITTFIVEPFVPHHEEFYINIVSERLGCSISFSECGGIDIEENWDQVKTIFLPTGVSLNQETCAPLVATLPLEFKSVIEEFITHVYSLFIDLDFTFLEMNPFTLVDKKPYPLDMRGELDDTAAFKNFKKWGNIEFPMPFGRVMSPTERFIHGLDEKTSASLKFTVLNPKGRIWTMVAGGGASVIYADTVGDLGYASELGNYAEYSGAPNEEEVLQYARVVIDCATADPDGQRRALVVGGGIANFTDVAATFNGIIRAMKEKVSKLKAANMHIYVRRGGPNYQRGLARMRALGAELGIPIEVYGPEATMTGICKQAIECITVAA

SEQ ID NO: 8124 - protein, 423 aa, Citrus clementina
MARKKIREYDSKRLLKEHFQRLSGRELPIKSAQVTESTNFDELAQKEPWLTSCKLVVKPDMLFGKRGKSGLVALNLDLAQAATFVKECLGKEMEMSGCKGPITTFIIEPFIPHNEEFYLNIVSERLGCSVSFSECGGIEIEENWDKVKTIFVPTGACLASETSAPLVATLPLEIRGEIQEFIKSVFTLFQDLDFTFLEMNPFTLVDRKPYPLDMRGELDDTAAFKNFKKWGNIEFPLPFGRAMSATESFIHDLDEKTSASLKFTVLNPKGRIWTMVAGGGASVIYADTVGDLGYASELGNYAEYSGAPNEGEVLQYARVVIDCATADPDGRKRALVIGGGIANFTDVAATFNGIIQALKEKESKLKAARMHLYVRRGGPNYQRGLAKMRALAEEIGLPIEVYGPEATMTGICKQAIECISAAA

SEQ ID NO: 8125 - protein, 423 aa, Prunus mume
MARKKIREYDSKRLLKEHFKRLGGRELPLKSAQITESTDLNELVEKESWLSSSKLVVKPDMLFGKRGKSGLVALNLDFAQVATFVKERLGKEVEMGGCKGPITTFIVEPFIPHNEEFYLNIVSDRLGNSISFSECGGIDIEENWDKVKTIFVPTGTPFTSEVSAPLVATLPLEIKGELEDFIKVVFTLFQDLDFTFLEMNPFALVDGKPYPLDMRGELDDTAAFKNFKKWGSIEFPMPFGRVMSSTEKFIHGLDEKTSASLKFTVLNPKGRIWTMVAGGGASVIYADTVGDLGFADELGNYAEYSGAPNEEEVLQYARVVIDCATSDPDGRKRALVIGGGIANFTDVAATFNGIIRALKEKESKLKAARMHLYVRRGGPNYQRGLAKMRALGEEIGIPIEVYGPEATMTGICKQAIQCISVAA

SEQ ID NO: 8126 - protein, 423 aa, Trigonella foenum-graecum
MARKKIREYDSKRLLKEHFKRISGQDLPIKSAQVIESTDINELVEKEPWLSSSKLVVKPDMLFGKRGKSGLVALNLDLAEVAGFVKERLGKEVKMGGCKGPITTFIVEPFIPHNEEFYLNIVSDRLGNSISFSECGGIDIEENWDKVKTVFIPTGESLTSETISPLIATLPLEIKGELEDFLKVVFNIFQDLDFTFLEMNPFTLVDGKPYPLDMRGELDDTAAFKNFKKWGNIEFPLPFGRVLSSTESFIHGLDEKTSASLKFTVLNPMGRIWTMVAGGGASVIYADTVGDLGYAPELGNYAEYSGAPKEGEVLQYARVVIDCATANPDGQKRALVIGGGIANFTDVAATFSGIIRALKEKEQKLKEANMHIYVRRGGPNYQRGLAKMRALGEEIGIPIEVYGPEATMTGICKQAIQCITASA

SEQ ID NO: 8127 - protein, 139 aa, Zea mays
MKGKANASKKDEARLRAGGGGAGKRKKAAASGKPKRPPSAFFVFMSEFRQEYQAQHPGNKSVAAVSKAAGEKWRSMSEQEKQPYVDQAGQKKQDYEKTKANIEKESTSSKKAKTDDDDGSKSEVDDEDGGSDEDNDDDE

SEQ ID NO: 8128 - protein, 133 aa, Sorghum bicolor
MKGKADTSKKDEGRLRAGGGAGKRKKAAASGKPKRPPSAFFVFMSEFRQEYQAQHPGNKSVAAVSKAAGEKWRAMSEQEKQPYVDQAGQKKQDYEKTKANFEKKESTSSKKAKTDDDDGSKSEVDDEDDEDDE

SEQ ID NO: 8129 - protein, 142 aa, Panicum virgatum
MKGKADASKKGEGRLKAGGGAGKRKKAAASGKPKRPPSAFFVFMSEFRQQYNAQHPDNKSVAAVSKAAGEKWRSMSDEEKQPYVDQAGQKKQDYEKTKANFDKKESTSSKKAKTQDDDGSDKSKSEVDDEDGGSDEENDEDE

SEQ ID NO: 8130 - protein, 142 aa, Echinochloa colona
MKGKADTSKKGEGRLKAGGGAGKRKKAAASGKPKRPPSAFFVFMSEFRQQYNAEHPNNKSVANVSKAAGEKWRSMSEEEKQPYVDQAGQKKQDYEKTKANFDKKESTSSKKAKTEDDDGSDKSKSEVDDEDAGSDEENEEDE

SEQ ID NO: 8131 - protein, 142 aa, Setaria italica
MKGKADTSKKGDGRLKAGGGAGKRKKAAASGKPKRPPSAFFVFMSEFRQEYQAQHPDNKSVAAVSKAAGEKWRAMSEEEKQPYVDQAGQKKQDYEKNKANFDKKESTSSKKAKTQDDEGSDKSKSEVDDEDGGSDEENEEDE

SEQ ID NO: 8132 - protein, 142 aa, Panicum virgatum
MKGKADTSKKGDGRLKAGGGAGKRKKAAASGKPKRPPSAFFVFMSEFRQQYNAQHPDNKSVAAVSKAAGGKWRSMSDEEKQPYVDQAGQKKQDYEKTKANFDKKESTSSKKAKTQDDEGSDKSKSEVDDEDGSSDEENDEDE

SEQ ID NO: 8133 - protein, 145 aa, Oryza sativa
MKGKADASKKGEGRLKAAGGAGKRKKAAASGKPKRPPSAFFVFMSEFRQEYQAAHPGNKSVAAVSKAAGEKWRAMSEQEKAPYVDKAGQKKQDYEKTKANFDKKESTSSKKAKTHDDGEGSDKSKSEVDDDQDGGSDEENEDDEE

SEQ ID NO: 8134 - protein, 142 aa, Echinochloa colona
MKGKADTSKKGDGRLKAGGGAGKRKKAAASGKPKRPPSAFFVFMSEFRQQYNAEHPNNKSVANVSKAAGEKWRSMSEEEKQPYVDQAGKKKQDYEKTKANFDKKESTSSKKATTEDDEGSDKSKSEVDDEDAGSDEENEEDE

SEQ ID NO: 8135 - protein, 140 aa, Cenchrus ciliaris
MKGKADTSNKVDGRLKAGGGGAGKRKKAAASGKPKRPPSAFFVFMSEFRQEYNAQHPDNKSVAAVSKAAGEKWRAMSEEEKQPYVDQAGQKKQDYEKNKANFDKKESTSSKKAKTHDDEGSDKSKSEVEDEDGGSDEEDE

SEQ ID NO: 8136 - protein, 139 aa, Pennisetum glaucum
MKGKADSSKKGDGRLKAGGGAAKRKKAAASGKPKRPPSAFFVFMSEFRQEYNAQHPDNKSVAAVSKAAGEKWRAMSEEEKQPYVDQAGQKKQDYEKNKADFDKKESTSSKKAKTHDDDGSDKSKSEVEDDDGGSDEEDE

SEQ ID NO: 8137 - protein, 144 aa, Brachypodium distachyon
MKGKADTSSKGEGRLKAAGGASKRKKAAAASGKPKRPPSAFFVFMSEFRQEYQAEHPNNKSVANVSKAAGEKWRSMSDADKAPYVEKAGQKKQDYEKTKATFDKKESTSSKKTKTQDDEGSDKSKSEVDDEDAGSDEENDEDDE

SEQ ID NO: 8138 - protein, 344 aa, Sorghum bicolor
MSDALINGLAGAGGGIIAQLLTYPLQTVNARQQTERDPSKPAFKDGAARQLYLVVKNEGWERLYGGLMPSLVGTAASQGVYYYFYQIFRNRAEAKALERSRRGLGDGSVGMLQSLTVAALSGCVNVLLTNPIWVVVTRMQTHRKANKQQSPQGLTCALDKPLEASATENTPYKTIDVFQELHKEAGVLGFWKGVIPALIMVSNPAIQFMLYETLLKKLKKRRASNLKGADGLTALEIFLLGAVAKLGATVVTYPLLVVKARLQAKQMINDDKRHRYKGTFDAFTKLVQYEGLTGMYKGMGTKIVQSVFASALLFMIKEELVKGARLLVTGNTSLVKKLPSKPSR

SEQ ID NO: 8139 - protein, 344 aa, Saccharum officinarum
MSDALINGLAGAGGGIIAQLLTYPLQTVNARQQTERDPSKPAFKDGAARQLYLVVKNEGWERLYGGLMPSLVGTAASQGVYYYFYQIFRNRAEAKALERSRRGLGDGSVGMLQSLTVAALSGCVNVLLTNPIWVVVTRMQTHRKANKQQNPQGLTFALDKPLEAATTENTPYKTVDVFQELYKEAGVLGFWKGVIPALIMVSNPAIQFMLYETLLKKLKKRRSSNLKGADGLTALEIFLLGAVAKLGATVVTYPLLVVKARLQVKQMINDDKRHRYKGTFDAFTKMVQYEGLTGMYKGMGTKIVQSVFASALLFMIKEELVKGARLLVTGNTSLVKKLPSKPSR

SEQ ID NO: 8140 - protein, 344 aa, Panicum virgatum
MSDALINGLAGAGGGIIAQLLTYPLQTVNARQQTERDPTKPAFKDGAARQLYLVVKSEGWERLYGGLMPSLVGTAASQGVYYYFYQIFRNRAEAKALERSRRGLVDGSVGMLQSLTVAALSGCVNVLLTNPIWVVVTRMQTHRKANKQQSPQGLTCALDKAMEAAITETTPYKTIDVFQELYKEAGVLGFWKGVIPALIMVSNPAMQFMLYETLLKKLKKRRASNLKGADGLTALEIFLLGAVAKLGATVVTYPLLVVKARLQVKQRIDDDKRHRYKGTFDAFTKMVHYEGLKGMYKGMGTKIVQSVFASALLFMIKEELVKGARLLVTGNISLVKKLPSKPSR

SEQ ID NO: 8141 - protein, 345 aa, Panicum virgatum
MSDALINGLAGAGGGIIAQLLTYPLQTVNARQQTERDPTKPAFKDGAARQLYLVVKNEGWERLYGGLMPSLVGTAASQGVYYYFYQIFRNRAEAKALERSRRGLGDGSVGMLQSLTVAALSGCVNVLLTNPIWVVVTRMQTHRKANKQQSPEGLTCAPDKVMEAAITENTPYKTIDVFQELYKEAGVLGFWKGVIPALIMVSNPAMQFMLYETLLKKLKKRRASNLKGADGLTALEIFLLGAVAKLGATVVTYPLLVVKARLQVKQRIDNDKRHHYKGTFDAFTKMVHHEGLKGMYKGMGTKIVQSVFASALLFMIKEELVKGARLLVTGNTSLVKKLPSKPSRK

SEQ ID NO: 8142 - protein, 343 aa, Setaria italica
MSDALINGLAGAGGGIIAQLLTFPLQTVNARQQTERDPSKPAFKDGAARQLYLVVKNEGWERLYGGLMPSLVGTAASQGVYYYFYQIFRNRAEAKALERSRRGLGDGSVGMLQSLTVAALSGCVNVLLTNPIWVAVTRMQTHRKANIQQSPQDLICANDKALEASTTENTPYKTIDVFQELYKEAGVLGFWKGVIPSLIMVSNPAIQFMLYETLLKRIKKRRASNLKGADGLTALEIFLLGAVAKLGATVLTYPLLVVKARLQVKQRIDGDKRHHYKGTFDAITKLVQYEGLRGMYKGMGTKIVQSVFASALLFMIKEELVKGARLLVTGNTSLVKKLPSKPS

SEQ ID NO: 8143 - protein, 344 aa, Echinochloa colona
MSDALINGLAGAGGGIIAQLLTYPLQTVNARQQTERDPSKPAFKDGAARQLYLVVKNEGWERLYGGLKPSLFGTAASQGVYYYFYQIFRNRAEAKALERARRGLGDGSVGMLQSLTVAAMSGCVNVLITNPIWVAVTRMQTHRKANKQQSPKGLTCALDKALEDATTENTPYKTIDVFQELYNEAGVLGFWKGVIPALIMVSNPAIQFMLYETLLKKLKKKRASKLKGADGLTALEIFLLGAVAKLGATVVTYPLLVVKARLQVKQKIDDDKRHRYKGTFDAITKLVQYEGLTGMYKGMGTKIVQSVFASALIFMIKEELVKGARLLVTGNTRLVKKLPSKPST

SEQ ID NO: 8144 - protein, 344 aa, Echinochloa colona
MSDALINGLAGAGGGIIAQLLTYPLQTVNARQQTERDPSKPAFKDGAARQLYLVVKNEGWERLYGGLMPSLVGTAASQGVYYYFYQIFRNRAEAKALERSRRGLGDGSVGMLQSLTVAALSGCVNVLITNPIWVAVTRMQTHRKANKQQSPKGLTCALDKALEDSTTENTPYKTIDVFQELYNEAGVLGFWKGVIPALIMVSNPAIQFMLYETLLKKLKKKRASKLKGADGLTALEIFLLGAVAKLGATVVTYPLLVVKARLQVKQKIDDDKRHRYEGTFDAITKLVQYEGMKGMYKGMSTKIVQSVFASALIFMIKEELVKGARLLVTGNTRLVKKLPSKPST

SEQ ID NO: 8145 - protein, 343 aa, Pennisetum glaucum
MSDALINGLAGAGGGIIAQLLTFPLQTVNARQQTERDPSKPAFKDGAARQLYLVVKNEGWERLYGGLMPSLVGTAASQGVYYYFYQIFRNRAEAKALERSRRGLGDGSVGMFQSLTVAALAGCVNVLITNPIWVAVTRMQTHRKANKQQSPQGLTCANDKALKASTTENTPYKTMDVFQELYQESGVFGFWKGVIPSLIMVSNPAIQFMLYETLLKRIKKRRASKLKGADGLTALEIFLLGAVAKLGATVLTYPLLVVKARLQVKQRIDGDKRHHYKGTFDAITKLVQYEGLTGMYKGMGTKIVQSVFASAMLFMIKEELVKGARLLVTGNTSLVKKLPSKPS

SEQ ID NO: 8146 - protein, 344 aa, Oryza sativa
MSDALINGVAGAGGGIIAQLLTYPLQTVNARQQTERDPSKPAFKDGAVRQMCLVVKHEGWERLYGGLMPSLVGTAASQGVYYYFYQIFRSRAEAAALQRSRRGIGDGSVGMLQSLTVAALSGCVNVLLTNPIWVIVTRMQTHRKANKQQSPLDLTCVLDKALQAPAVENIPHKTIHVIQDLYKEAGFLGFWKGVVPALIMVSNPAIQFMLYETLLKKLKKRRASNLKGADGLTALEIFLLGAVAKLGATVVTYPLLVVKARLQVKQIIDDDKRHRYKGTFDAITKMIRYEGLSGLYKGMSTKIVQSVFASALLFMIKEELVKGARLLVTGNTSLVKKLPSKPLR

SEQ ID NO: 8147 - protein, 346 aa, Secale cereale
MSDALINGLAGAGGGIVAQLLTYPLQTVNARQQTERDPSKPAFKDGAVRQLCLVVQNEGWERLYGGLAPSLVGTAASQGVYYFFYQIFRSRAEAASLRRSIRGIGDGSVGMFQSLTVAALSGCVNVLLTNPIWVVVTRMQTHRKANKQQGPQDQGLTSALDKALQPAPVENVPHKTINVIQDLYKEAGVFGFWKGVIPALIMVSNPAIQFMLYETLLKKLKKRRASNFKGAQGPTAIEVFLLGAVAKLGATLVTYPLLVVKARLQAKHMIDDDKRHRYKGTFDAITKMMHYEGLSGLYKGMGTKIVQSVFASALLFMIKEELVKGARFLVTGDTSLVKKLPSKPSR

SEQ ID NO: 8148 - protein, 346 aa, Triticum aestivum
MSDALINGLAGAGGGIVAQLLTYPLQTVNARQQTERDPSKPAFKDGAVRQLCLVVQNEGWERLYGGLAPSLVGTAASQGVYYFFYQIFRSRAEAASLRRSIRGIGDGSVGMFQSLTVAALSGCVNVLLTNPIWVVVTRMQTHRKANKQQGPQDQGLTSALDKALQPAPVENVPHKTINVIQDLYKEAGAFGFWKGVIPALIMVSNPAIQFMLYETLLKKLKKRRASNFKGAQGLTAIEVFLLGAVAKLGATLVTYPLLVVKARLQAKQMIDDDKRHRYKGTFDAITKMMHYEGLSGLYKGMGTKIVQSVFASALLFMIKEELVKGARFLVTGDTSLVKKLPSKPSR

SEQ ID NO: 8149 - protein, 293 aa, Avena sativa
MCLVVKNEGWERLYGGLAPSLVGTAASQGVYYYFSKYSGAGGGGARRRFISGVGDGSVGMLQSLTVAAISGCVNVLLTNPIWVTVTRMQTHRKANKQQSPEGLNSALDKAIQTAPAENIPHKTINVIQDLYKEAGVLGFWKGVIPALIMVSNPAIQFMLYESLLKKLKKRRASNLKGAQGLTALEIFLLGAVAKLGATLVTYPLLVVKARLQAKQMIGDDKKHRYKGTFDAITKMMRYEGLSGLYKGMGTKIVQSVFASALLFMIKEELVKGARLLVTGDTSLVQKLPSKPSR

SEQ ID NO: 8150 - protein, 337 aa, Brachypodium distachyon
MSDALINGLAGAGGGIVAQLLTYPLQTVNARQQTERDPSKPAFKDGAVRQMCLVVRNEGWERLYSGLPPSLVGTAASQGVYYYFYQIFRSRAEAAALRRSIGGFGDGSVGMLQSLTVAALSGCVNVLLTNPIWVVVTRMQTHRKTNKQQSPALDKAIQTAPVENIPHKTINIIQDLYKEAGVLGFWKGVVPALIMVSNPAIQFMLYESLLKKLKKRRASNLKGADGLTAIEIFLLGAVAKLGATLVTYPLLVVKARLQAKQMITDDKRHRYKGTFDALTKMMHYEGLSGLYKGMGTKIVQSVFASALLFMIKEELVKGARLLVTGNTSLVKKLPSKQ

SEQ ID NO: 8151 - protein, 620 aa, Sorghum bicolor
MAAPSQTTAAATTHHRALLPSPRGTRAAAAPSAVRLPLRAQPHAHAQRARLSAPVAAAAPAASTASPESPAAGAVAGKPTVLVAEKLGAAGLALLREFANVDCSYGLSPEDLRAKISLCDALIVRSGTKVGRDVFEASGGRLRVVGRAGVGIDNVDLAAATEHGCLVVNAPTANTVAAAEHGIALLTAMARNIAQADASLKAGQWQRNKYVGVSLVGKTLAILGFGKVGSEVARRAKGLGMHVIAHDPYASADRARAIGVELVSMEEAMTTADFISLHMPLTPATNKMLNDEAFAKMKKGVRIINVARGGVIDEEALVRALDSGIVAQAALDVFTKEPPAPDNKLVLHENVTVTPHLGASTVEAQEGVAIEIAEAVIGALKGELAASAVNAPMVPAEVLSELAPFVVLAEKLGRLAVQLVAGGGGIKSVKVTYASARAPDDLDTRLLRAMITKGLIEPISSVFVNLVNADFTAKQRGVRITEERILLDGSPETPIDYIQVQIANVESKFPSAISESGEITVEGRVKDGVPHLTKVGAFQVDVSLEGSLILCRQVDQPGMIGSVGSVLGEENVNVSFMSVGRIAPRKHAVMAIGVDEEPSKATLTKIGEIPAIEEFVFLKL

SEQ ID NO: 8152 - protein, 625 aa, Setaria italica
MAAPTPTPTAAAAAAAATHHRILLPSPRGALAPAFLRLPLRAHQPQSHAQRAARLPAAPVAAAAPAASTASPDAPSSGAVPGKPTVLVAEKLGAAGLALLREFANVDCSYGLSPEELRAKISLCDALIVRSGTKVGRDVFEASGGRLRVVGRAGVGIDNVDLAAATEHGCLVVNAPTANTVAAAEHGIALLTAMARNIAQADASLKAGTWQRNKYVGVSLVGKTLAILGFGKVGSEVARRAKGLGMHVIAHDPYASADRARAIGVELVSMEEAMTTADFISLHMPLTPATNKMLNDEAFAKMKKGVRIINVARGGVIDEEALVRALDSGVVAQAALDVFTKEPPAPDNKLVLHENVTVTPHLGASTVEAQEGVAIEIAEAVIGALKGELAASAVNAPMVPAEVLSELAPFVVLAEKLGRLAVQLVAGGGGIKSVKVTYASARAPDDLDTRLLRAMITKGLIEPISSVFVNLVNADFTAKQRGVRITEERILLDGSPETPIDYIQVQIANVESKFPSAISETGEITVEGRVKDGVPHLTKVGAFQVDVSLEGSLILCRQVDQPGMIGSVGSVLGEENVNVSFMSVGRLAPRKHAVMAIGVDEEPSKGTLTRIGEIPAIEEFVFLKL

SEQ ID NO: 8153 - protein, 588 aa, Panicum virgatum
FLRLPHRAQAHAHAQRARLPAPLAAAAPAASTASPEAPASGAVPGKPTVLVAEKLGAAGLALLREFANVDCSYGLSPEELRAKISLCDALIVRSGTKVGRDVFEASGGRLRVVGRAGVGIDNVDLAAATEHGCLVVNAPTANTVAAAEHGIALLTAMARNIAQADASLKADKWLRNKYVGVSLVGKTLAILGFGKVGSEVARRAKGLGMHVVAHDPYASADRARAIGVELVSMEEAMTTADFISLHMPLTPATNKMLNDEAFAKMKKGVRIINVARGGVIDEEALVRALDSGIVAQAALDVFTKEPPAPDNKLVLHENVTVTPHLGASTVEAQEGVAIEIAEAVIGALKGELAASAVNAPMVPAEVLSELAPFVVLAEKLGRLAVQLVAGGGGIKSVKVTYASARAPDDLDTRLLRAMITKGLIEPISSVFVNLVNADFTAKQRGVRITEERILLDGSPETPIDYIQVQIANVESKFPSAISETGEITVEGRVKDGVPHLTKVGAFQVDVSLEGSLILCRQVDQPGMIGAVGSVLGEENVNVSFMSVGRIAPRKHAVMAIGVDEEPSKSTLKKIGEIPAIEEFVFLKL

SEQ ID NO: 8154 - protein, 628 aa, Panicum virgatum
SRQAQAPHWRRRPRPTAAATPPPPLLLPSPSPSPSPRGALAPAFLRLPHREQAHARAQRARLPAPLAAAAPTASPEAPASGAVPGKPTVLVAEKLGAAGLALLREFANVDCSYGLSPEELRAKISLCDALIVRSGTKVGRDVFEASGGRLRVVGRAGVGIDNVDLAAATEHGCLVVNAPTANTVAAAEHGIALLTAMARNIAQADASLKAGKWLRNKYVGVSLVGKTLAILGFGKVGSEVARRAKGLGMHVVAHDPYASADRARAIGVELVSMEEAMTTADFISLHMPLTPATNKMLNDEAFAKMKKGVRIINVARGGVIDEEALVRALDSGIVAQAALDVFTKEPPAPDNKLVLHENVTVTPHLGASTVEAQEGVAIEIAEAVIGALKGELAASAVNAPMVPAEVLSELAPFVVLAEKLGRLAVQLVAGGGGIKSVKVTYASARAPDDLDTRLLRAMITKGLIEPISSVFVNLVNADFTAKQRGVRITEERILLDGSPETPIEYIQVHIANVESKFPSAISETGEITVEGRVKDGVPHLTKVGAFQVDVSLEGSLILCRQVDQPGMIGAVGSVLGEENVNVSFMSVGRIAPRKHAVMAIGVDEEPSKSTLAKIGEIPAIEEFVFLKL

SEQ ID NO: 8155 - protein, 616 aa, Brachypodium distachyon
MAAPSPTTAAAAGTTTHRSVLLPASHHRAASSLRLPVRARAAPGARSIRASAATAPPAATASPPSSASGAVEGKPTVLVAEKLGAAGLALLREFANVDCSYGLSPEELRAKISLCDALIVRSGTKVGRDVFEASGGRLRVVGRAGVGIDNVDLAAATEHGCLVVNAPTANTVAAAEHGIALLAGMARNIAQADASLKAGKWARNKYVGVSLVGKTLAILGFGKVGSEVARRAKGLGMHVIAHDPYASADRARAIGVELVSMEEAMTTADFISLHMPLTPATNKMLNDEAFAKMKKGVRIVNVARGGVIDEEALVRALDAGIVAQAALDVFTKEPPAADDKLVLHENVTVTPHLGASTVEAQEGVAIEIAEAVTGALRGELAASAVNAPMVPAEVLSELAPFVVLAEKLGRLAVQLVAGGGGIKSVKVTYASARAPDDLDTRLLRAMITKGVIEPISDVFVNLVNADFTAKQRGIRISEERILMDGSPETPLDHIQVQIANVESKFPSAISETGEITVEGKVKDGVPHLTKVGAFEVDVSMEGSLILCRQVDQPGMIGSVGSVLGEENVNVSFMSVGRIAPRKRAVMAIGVDEEPSKATLTKIGEIPAIEEFVFLKL

SEQ ID NO: 8156 - protein, 618 aa, Brachypodium distachyon
MAAPSPTTAAAATTHHRLLLPTSHRALAPSSSSLRLPVRASTTPGARIRVSAATAPAAAASTASPPSSASGAVEGKPTVLVAEKLGAAGLALLREFANVDCSYGLSPEELRAKISLCDALIVRSGTKVGRDVFEASGGRLRVVGRAGVGIDNVDLAAATEHGCLVVNAPTANTVAAAEHGIALLTAMARNIAQADASLKAGKWARNKYVGVSLVGKTLAILGFGKVGSEVARRAKGLGMQVIAHDPYASADRARAIGVELVSMEEAMTTADFISLHMPLTPATNKMLNDEAFAKMKKGVRIINVARGGVIDEEALVRALDAGIVAQAALDVFTKEPPTADDKLVLHENVTVTPHLGASTVEAQEGVAIEIAEAVTGALRGELAASAVNAPMVPAEVLSELAPFVVLAEKLGRLAVQLVAGGGGIKSVKVTYASARAPDDLDTRLLRAMITKGVIEPISDVFVNLVNADFTAKQRGIRISEERILMDGLPETPLDHIQVQIANVESKFPSAIAETGEITVEGKVKDGVPHLTKVGAFEVDVSMEGSLILCRQVDQPGMIGSVGSVLGEENVNVSFMSVGRIAPRKRAVMAIGVDEEPSKATLTKIGEIPAIEEFVFLKL

SEQ ID NO: 8157 - protein, 613 aa, Oryza sativa
MAAPSQTTATTTHHRVLLPSHHHHRAVPPSLLRLPLRAARRGRLSAAAAAAAPAASTAAPSEPAAGAVPGKPTVLVAEKLGAAGLELLRGFANVDCSYGLSPEELRAKIPLCDALIVRSGTKVGRDVFEASGGRLRVVGRAGVGIDNVDLAAATEHGCLVVNAPTANTVAAAEHGIALLTAMSRNIAQADASLKAGKWQRNKYVGVSLVGKTLAILGFGKVGSEVARRAKGLGMHVIAHDPYASADRAHAIGVELVSMEDALTTADFISLHMPLTPATNKMLNDETFAKMKKGVRIINVARGGVIDEDALVRALDSGIVAQAALDVFTKEPPAPDSKLVLHENVTVTPHLGASTVEAQEGVAIEIAEAVIGALKGELAASAVNAPMVPAEVLSELAPYVVLAEKLGRLAVQLVAGGGGIKSVKVTYASARAPDDLDTRLLRAMITKGLIEPISSVFVNLVNADFTAKQRGVRITEERILLDGSPETPIDYIQVHIAHVESKFPSAISESGEITVEGKVKDGIPHLTKVGSFQVDVSLEGSLILCRQVDQPGMIGAVGSVLGEENVNVSFMSVGRIAPRKHAVMAIGVDEEPKKSTLTKIGEIPAIEEFVFLKL

SEQ ID NO: 8158 - protein, 605 aa, Triticum aestivum
MAAPSPTTAAATHHRALLPAPARRAALSLARASRGRICVSAPAAPAASTASPPATAAVAVEGKPTVLVAEKLGAAGLALLREFANVDCSYGLSPEELRAKISLCDALIVRSGTKVGRDVFEASGGRLRVVGRAGVGIDNVDLAAATEHGCLVVNAPTANTVAAAEHGIALLCAMARNVAQADASLKAGKWARTKYVGVSLVGKTLAILGFGKVGSEVARRAKGLGMHVIAHDPYASADRARAIGVDLVSMEEAMTTADFISLHMPLTPSTNKMLNDEAFAKMKKGVRIINVARGGVIDEDALVRALDAGIVAQAALDVFTKEPPAADSKLVLHENVTVTPHLGASTVEAQEGVAIEIAEAVTGALKGELAASAVNAPMVPAEVLSELAPYVMLAEKLGRLAVQLVAGGGGIKSVKVTYASARAPDDLDTRLLRAMITKGVIEPISDVFVNLVNADFTAKQRGIRVSEEKIVMDGSPETPLEYIQVQIANVESKFPSAISDSGLVTVEGRVKDGIPHLTKVGAFEVDVSMEGSLILCRQVDQPGMIGSVGSVLGEENVNVSFMSVGRIAPRKTAIMAIGVDEEPSKATLTKIGEIPAIEEFVFLKL

SEQ ID NO: 8159 - protein, 551 aa, Pennisetum glaucum
PASGAVPGKPTVLVAEKLGAAGLALLREFANVDCSYGLSPEDLRAKISLCDALIVRSGTKVGRDVFEASGGRLRVVGRAGVGIDNVDLAAATEHGCLVVNAPTANTVAAAEHGIALLTAMARNIAQADAALKAGQWQRNKYVGVSLVGKTLAILGFGKVGSEVARRAKGLGMHVIAHDPYASADRARAIGVELVSMEEAMTTADFISLHMPLTPATNKMLNDEAFAKMKKGVRIINVARGGVIDEEALVRALDSGVVAQAALDVFTKEPPAPDSKLVLHENVTVTPHLGASTVEAQEGVAIEIAEAVIGALKGELAASAVNAPMVPAEVLSELAPFVVLAEKLGRLAVQLVAGGGGIKSVKVTYASARAPDDLDTRLLRAMITKGLIEPISSVFVNLVNADFTAKQRGVRITEERIMLDGSPETPIDYIQVQIAHVESKFPSAISETGEITVEGRVKDGVPHLTKVGAFQVDVSLEGSLILCRQVDQPGMIGSVGSVLGEENVNVSFMSVGRIAPRKHAVMAIGVDEEPSKGTLTKIGEIPAIEEFVFLKL

SEQ ID NO: 8160 - protein, 433 aa, Secale cereale
AVPDHRRRRPPPTTRRPPPGLGPPRGPRPAIRAPPPARARTRRPHLRLRARAPAASTASPPATAAVAVEGKPTVLVAEKLGAAGLALLREFANVDCSYGLSPEELRAKISLCDALIVRSGTKVGRDVFEASGGRLRVVGRAGVGIDNVDLAAATEHGCLVVNAPTANTVAAAEHGIALLCAMARNVAQADASLKAGKWARTKYVGVSLVGKTLAILGFGKVGSEVARRAKGLGMHVIAHDPYASADRARAIGVDLVSMEEAMTTADFISLHMPLTPSTNKMLNDEAFAKMKKGVRIINVARGGVIDEDALVRALDAGIVAQAALDVFTKEPPAADSKLVLHENVTVTPHLGASTVEAQEGVAIEIAEAVTGALKGELAASAVNAPMVPAEVAVRACTLCYARRKAWAPSCPASCWRWRYQVCEGDLCIRKGSR

SEQ ID NO: 8161 - protein, 432 aa, Echinochloa colona
MSRNIAQADASLKAGKWLRNKYVGVSLVGKTLAILGFGKVGSEVARRAKGLGMHVIAHDPYASADRARAIGVELVSMEEAMTTADFISLHMPLTPATNKMLNDEAFAKMKKGVRIINVARGGVIDEEALVRALDSGIVAQAALDVFTKEPPAPDNKLVLHENVTVTPHLGASTVEAQEGVAIEIAEAVIGALKGELAASAVNAPMVPAEVLSELAPFVVLAEKLGRLAVQLVAGGGGIKSVKVTYASARAPDDLDTRLLRAMITKGLIEPISSVFVNLVNADFTAKQRGVRITEERIMLDGSPETPIDYIQVQIANVESKFPSAISETGEITVEGRVKDGVPHLTKVGAFQVDVSLEGSLILCRQVDQPGMIGSVGSVLGEENVNVSFMSVGRIAPRKHAVMAIGVDEEPSKGTLTKIGEIPAIEEFVFLKL

SEQ ID NO: 8162 - protein, 577 aa, Secale cereale
DSRTQGGRICVSAPAAPAASTASPPATAAVAVEGKPTVLVTEKLGAAGLALLREFANVDCSYGLSPEELRAKISLCDALIVRSGTKVGRDVFEASGGRLRVVGRAGVGIDNVDLAAATEHGCLVVNAPTANTVAAAEHGIALLCAMARNVAQADASLKAGKWARTKYVGVSLVGKTLAILGFGKVGSEVARRAKGLGMHVIAHDPYASADRARAIGVDLVSMEEAMTTADFISLHMPLTPSTNKMLNDEAFAKMKKGVRIINVARGGVIDEDALVRALDAGIVAQAALDVFTKEPPAADSKLVLHENVTVTPHLGASTVEAQEGVAIEIAEAVTGALKGELAASAVNAPMVPAEVLSELAPYVMLAEKLGRLAVQLVAGGGGIKSVKVTYASARAPDDLDTRLLRAMITKGVIEPISDVFVNLVNADFTAKQRGIRVSEEKIVMDGSPETPLEYIQVQIANVESKFPSAVSDSGLVTVEGRVKDGIPHLTKVGAFEVDVSMEGSLILCRQVDQPGMIGSVGSVLGEENVNVSFMSVGRIAPRKTAIMAIGVDEEPSKTTLTKIGEIPAIEEFVFLKL

SEQ ID NO: 8163 - protein, 553 aa, Avena sativa
PSSAAVAVEGKPTVLVAEKLGAAGLALLREFANVDCSYGLSPEELRAKISLCDALIVRSGTKVGRDVFEASGGRLRVVGRAGVGIDNVDLAAATEHGCLVVNAPTANTVAAAEHGIALLCGMARNIAQADASLKAGKWARNKYVGVSLVGKTLAILGFGKVGSEVARRAKGLGMHVIAHDPYASADRARAIGVELVSMEEAMTTADFISLHMPLTPATNKMLNDETFAKMKKGVRIINVARGGVIDEDALVRALDAGIVAQAALDVFTKEPPAADSKLVLHENVTVTPHLGASTVEAQEGVAIEIAEAVTGALKGELAASAVNAPMVPAEVLSELAPFVVLAEKLGRLAVQLVAGGGGIKSVKVTYASARAPDDLDTRLLRAMITKGVIEPISDVFVNLVNADFTAKQRGIRISEERILMDGSPETPLDYIQVQIANVESKFPSAISESGEITVEGKVKDGVPHLTKVGAFEVDVSMEGSLILCRQVDQPGMIGAVGSVLGEENVNVSFMSVGRIAPRKRAVMAIGVDEEPSKATLTKIGEIPAIEEFVFLKL

SEQ ID NO: 8164 - protein, 616 aa, Secale cereale
MAAPSPTPPPRPPPTTASSSRPRPAARPSPGRPRSASPRAPAPRAAASASPRPPPPPRPPRPRPRRPRWPSRASPRCSWPRSSAPRGWPCSASSPTSTAPTASPPTELRAKISLCDALIVRSGTKVGRDVFEASGGRLRVVGRAGVGIDNVDLAAATEHGCLVVNAPTANTVAAAEHGIALLCAMARNVAQADASLKAGKWARTKYVGVSLVGKTLAILGFGKVGSEVARRAKGLGMHVIAHDPYASADRARAIGVDLVSMEEAMTTADFISLHMPLTPSTNKMLNDEAFAKMKKGVRIINVARGGVIDEDALVRALDAGIVAQAALDVFTKEPPAADSKLVLHENVTVTPHLGASTVEAQEGVAIEIAEAVTGALKGELAASAVNAPMVPAEVLSELAPYVMLAEKLGRLAVQLVAGGGGIKSVKVTYASARAPDDLDTRLLRAMITKGVIEPISDVFVNLVNADFTAKQRGIRVSEEKIVMDGSPETPLEYIQVQIANVESKFPSAVSDSGLVTVEGRVKDGIPHLTKVGAFEVDVSMEGSLILCRQVDQPGMIGSVGSVLGEENVNVSFMSVGRIAPRKTAIMAIGVDEEPSKTTLTKIGEIPAIEEFVFLKL

SEQ ID NO: 8165 - protein, 577 aa, Cocos nucifera
GGGAAAAAAALPRLPLRRSGRLVFVSAQHGGVGAKPTVLVAEKLGEAGLELLKDFANVDCSYNLSPEELCTKISLCDALIVRSGTKVGREVFESASGRLRVVGRAGVGIDNVDLAAATEHGCLVVNAPTANTVAAAEHGIALLTAMARSIAQADASLKAGKWQRSKYVGVSLVGKTLAVLGFGKVGSEVARRAKGLGMHVIAHDPYAAADRARAIGVELVTFNEAISTADFISLHMPLTPSTSKILNDEAFAKMKKGVRIVNVARGGVIDEEALVRALDSGIVAQAALDVFTEEPPSADNKLVLHENVTVTPHLGASTMEAQEGVAIEIAEAVVGALKGELAATAVNAPMVPAEVLSELAPFVVLAEKLGRLAVQLVAGGSGVKLVKVTYASARGPDDLDTRVLRAMITKGLIEPISSVFVNLVNADFTAKQRGIRIAEERIVLDGSPENPLEFIQVQIANVESKFASAMSETGEIRVEGRVKDGIPHLTKVGSFQVDVSVEGSLILCRQVDQPGMIGTVGTILGEQNINVSFMSVGRVAPRKHAVMAIGVDEEPDKETLTKIGEIPAIEEFVFLKL

SEQ ID NO: 8166 - protein, 570 aa, Cocos nucifera
AAALPRLPLRRSGRLVFVSAQHGGVGAKPTVLVAEKLGEAGLELLKDFANVDCSYNLSPEELCTKISLCDALIVRSGTKVGREVFESASGRLRVVGRAGVGIDNVDLAAATEHGCLVVNAPTANTVAAAEHGIALLTAMARSIAQADASLKAGKWQRSKYVGVSLVGKTLAVLGFGKVGSEVARRAKGLGMHVIAHDPYAAADRARAIGVELVTFDEAILAADFISLHMPLTPSTSKILNDEAFAKMKKGVRIVNVARGGVIDEEALVRALDSGIVAQAALDVFTEEPPSADHKLVLHEKVTVTPHLGASTMEAQEGVAIEIAEAVVGALKGELAATAVNAPMVPAEVLSELAPFVVLAEKLGRLAVQLVAGGSGVKSVKVTYASARAPDDLDTRLLRAMITKGLIEPISSVFVNLVNADFTAKQRGVRITEERIVLDGSPENPLEFIQVQIANVESKFASAMSETGEIRVEGRVKDGIPHLTKVGSFQVDVSLEGSLILCRQVDQPGMIGTVGSILGERNVNVSFMSVGRIAPRKHAVMAIGVDEEPNNETLKKIGEIPAIEEFVFLKL

SEQ ID NO: 8167 - protein, 600 aa, Elaeis guineensis
MAASTAPSNLISSPSLHPPSSLSRRLLHPAAAALPRLPLRRSGRLVLVAAQHGGVGAKPTVLVAEKLGEAGLELLKDFANVDCSYNLSPEELCTKISLCDALIVRSGTKVVREVFESSGGRLRVVGRAGVGIDNVDLAAATEHGCLVVNAPTANTVAAAEHGIALLTAMARNIAQADASLKAGKWQRSKYVGVSLVGKTLAVLGFGKVGSEVARRAKGLGMHVIAHDPYAAADRARAIGVELVTFDEAISAADFISLHMPLTLSTSKILNDDAFAKMKKGVRIVNVARGGVIDEEALVRALDSGIVAQAALDVFTEEPPSADHKLVLHEKVTVTPHLGASTMEAQEGVAIEIAEAVVGALKGELAATAVNAPMVPAEVLSELAPFVVLAEKLGRLAVQLVAGGSGVKSVKVTYASARAPDDLDTRLLRAMITKGLIEPISSVFVNLVNADFTAKQRGVRITEERIVLDGSPENPLEFIQVQIANVESKFASAMSETGEIRVGGRVKDGIPHLTEVGSFQVDVSLEGSLILCRQVDQPGMIGTVGSILGEQNVNVSFMSVGRIAPRKHAVMAIGVDEEPNKETLKKIGEIPAIEEFVFLKL

SEQ ID NO: 8168 - protein, 581 aa, Amorphophallus konjac
PTSPSSMRLSAPAASSLPSSLSRRISFHPAVLVTRRAGARRGRLVVMAAAGGGMDAKPTVLVAEKLGEAGLELLKGFANVDCTYNLTQEELCTKISLCDALIVRSGTKVGREVFESSGGRLRVVGRAGVGIDNVDLAAATEHGCLVVNAPTANTVAAAEHGIALLAAMARNIAQADASLKAGNWQRNKYVGVSLVGKTLAVMGFGKVGSEVARRAKGLGMHVIAHDPYAAADRARAIGVALVTFDEAISTADFISLHMPLTPSTLKILNDEAFAKMKKGVRIVNVARGGVIDEDALVRALDSGMVAQAALDVFTEEPPAPDNKLVLHERVTVTPHLGASTMEAQEGVAIEIAEAVVGALKGELAATAVNAPMVPAEVLSELAPFVVLAEKLGRLAVQLVAGGSGVKSVKVTYASARAPDDLDTRLLRAMITKGLIEPISSVFINLVNADFTAKQRGVRITEERILLDGSPENPLDYIRVQIANVESKFASAMSDSGEITVEGRVKGGVPYLTKAGSFQVDISLEGSIILCRQVDQPGMIGKVGSILAEQNVNVSFMTVGRIAPRKHAVMAIGVDDEPTKEP

SEQ ID NO: 8169 - protein, 421 aa, Sorghum bicolor
MAAASNGEGGHGQGRFDVIVVGAGIMGSCAAYAASSRGARVLLLERFDLLHHRGSSHGESRTIRATYPQAHYPPMVRLSRRLWDEAQADAGYAVLTPTPHLDLGPADDPALVAAIRNGGATEVALAAAAAGDDESASASWPWAGVFRVPDGWTAAPSELGGVMKATKAVAMFQALAVKKGAVLRDRAEVVDVTTSSKRGEGEGSIISVRTSSGEEFHGTKCIVTVGAWTSKLIRSVSGLDLPVQPVHTLICYWKVKPGHEQELTPEAGFPTFASYGDPYIYGTPSMEFPGLIKIAMHGGPPCDPDGRDWSTGGLVEPVARWIDAVMPDHVDTAGGPVIRQCCMYSVTPDDDYVVDFLGGEFGKDVVVGAGFSGHGFKMGPAVGRILAEMALDGVARTAADAGVDLRPLRIGRFAENPKGNL

SEQ ID NO: 8170 - protein, 412 aa, Panicum virgatum
MAASNGGGDAPGRFDVIVVGAGIMGSCAAYAASSRGARALLLERFDLLHHRGSSHGESRTIRATYPQAHYPPMVRLSRRLWEEAQADAGYRVLTPTPHLDLGPRDDPELRAAIRNGGAAVVAGGSSWPWAGVFRVPDGWAAASSELGGVMKATKAVAMFQALAVKKGAVVRDRMEVVDVAKRGEGSILVRTASGEEFHGAKCIVTVGAWTSKLVKSVVGMDLPVQPVHTLICYWKVKPGHESELTAEAGFPTFASYGDPYIYSTPSMEFPGLIKIAKHGGPPCDPDSRDWSTGAADLAEPVARWIDAVMPGHVDTAGGPVIRQSCMYSMTPDEDYVIDFLGGEFGKDVVVGAGFSGHGFKMGPAVGRILAEMAMDGESSSAVEAGVDLKPLRIDRFVGNPKGNLSSPGDQGQ

SEQ ID NO: 8171 - protein, 407 aa, Echinochloa colona
RRPRRGPGRFDVIVVGAGIMGSCAAYAAASRAARVLLLERFDLLHHRGSSHGESRTIRATYPQAHYPPMARLSRRLWEEAQAEAGYRVLTPTPHLDLGPRDDPDFLAAVRNGGAAEVAAGGGEGEPWPWAGVFRVPDGWAAATSELGGVMKATKAVAMFQALAVKKGAVVRDRTEVVDVAKRGEGSILVRTASGEEFHGAKCIITVGAWTSKLVKSVTGMDLPVQPVHTLICYWKVRPGHERELTTEAGFPTFASYGDPYIYSTPSMEFPGLIKIAKHGGPPCDPDGRDWSTGAAGLADPVARWIDAVMPAHVDTAGGPVIRQACMYSMTPDEDYVVDFLGGEFGKDVVVGAGFSGHGFKMGPAVGRILAEMAMDGEARTAAEAGVDLKPLRIGRFVDNPKGNLKNS

SEQ ID NO: 8172 - protein, 409 aa, Setaria italica
MAASNGEAVHGRFDVIVVGAGIMGSCAAYAASSRGARALLLERFDLLHHRGSSHGESRTIRATYPQPHYPPMARLSRRLWEEAQADAGYRVLTPTPHLDLGPRDDPALRASIRNGGAAEVAASWPWAGVFRVPEGWTAATSELGGVMKATKAVAMFQALAVRKGAVVRDRTEVVDIAKPADGSILVRTASGEEFHGAKCIVTVGAWTSKLVKSVIGMDLPVQPVQTLICYWKVKPGHESELTTEAGFPTFASYGDPYIYSTPSMEFPGLIKIAKHGGPPCDPDSRDWSTGAADLAEPVARWIDAFMPGHVDTAGGPVIRQSCMYSMTPDEDYVIDFLGGEFGKDVVVGAGFSGHGFKMGPAIGRILAEMAMDGEARTAAEAGVDLQPLRIDRFVDNPKGNLKNPGDQDK

SEQ ID NO: 8173 - protein, 417 aa, Panicum virgatum
MAASNGGDAPGRFDVIVVGAGIMGSCAAYAASSRGARALLLERFDLLHHRGSSHGESRTIRATYPQAHYPPMVRLSRRLWEEAQADAGFRVLTPTPHLDLGPRDDPELRAAIRNGGGAVVAGGGAESASSWPWAGVFRVPDGWAAASSELGGVMKATKAVAMFQALAVKKGAVVRDRMEVVDIARRGEGSILVRTASGEEFHGAKCIVTVGAWTSKLVKSVVGMDLPVQPVHTLICYWKVKPGHESELTAEAGFPTFASYGDPYIYSTPSMEFPGLIKIAKHGGPPCDPDSRDWSTGAAGLAEPVARWIDAVMPGHVDTAGGPVIRQSCMYSMTPDEDYVIDFLGGEFGKDVVVGAGFSGHGFKMGPAVGRILAEMAMDGESRSAVEAGVDFEPLRIGRFVDNPKGNLNTRGDQGQK

SEQ ID NO: 8174 - protein, 198 aa, Sorghum bicolor
MATEEAAKPSPIPPYPEMILAAIEGLGDKNGSNKSAISKFIEDKYGELPPAHASLLTAHLARMKESGELIFLKNNYFRADAPDAPPKRGRGRPPKARDPNAPPPPPKSPASAGTGRGRGRPPKAKSALDAAVKQATAGMPKARGRPPKKAKTSEDGASPAPKPAPTPAPAGDGSTPVKRGRGRPPKVRPVVPSETAAA

SEQ ID NO: 8175 - protein, 196 aa, Setaria italica
MATEEAAKPSPLPPYPEMILAAIEGLGDKNGSNKSAISRYIEGKYGELPPAHASLLTAHLARMKESGELIFLKNNYFRADAPDAPPKRGRGRPPKVRDPNAPPPPPKAPSTGSPRPRGRPPKPKDPLDAAVAQATAGMPKARGRPPKKAKIDATAAAAPSPAAAAPAGGDGSAPVKRGRGRPPKVRPAVPSETAAA

SEQ ID NO: 8176 - protein, 183 aa, Zea mays
MATEEVAKPSPIPPYPEMILAAIEDLGDKSGSNKSAISRYIEGKYDGDLPPAHASLLAAHLARMKESGELVFVKNNYFRADAPDAPPKRGRGRPPKARDPGAPVSPPSGRGRGRPPKPKDPLDAAVKQATAGMPRARGRPPKKAKTEGGASPAPAGDGSTPVKRGRGRPPKVRPVVPSETAAA

SEQ ID NO: 8177 - protein, 217 aa, Zea mays
MAGAGDKVDYVFKVVLIGDSAVGKSQILARFARNEFSLDSKATIGVEFQTRTLVIDHRSVKAQIWDTAGQERYRAVTSAYYRGALGALLVYDITRRQSFDHIPRWLDELRAHADKNIVIMLVGNKSDLEEQRAVSTEDAKEFAEKENLFFLETSALQATNVESSFQTVLTEIFKIHSKKNMVSEPKSNGAAPAMPGTKVLVPGPAQEIPKSKCCSSM

SEQ ID NO: 8178 - protein, 217 aa, Setaria italica
MAGAGEKVDYVFKVVLIGDSAVGKSQILARFARNEFSLDSKATIGVEFQTRTLVIDHRSVKAQIWDTAGQERYRAVTSAYYRGALGALLVYDITRRQSFDHIPRWLDELRAHADKNIVIMLVGNKSDLEEQRAVSTEDAKEFAEKENLFFLETSALQATNVESAFQTVLTEIFKIHSKKNMVSEPKSNGAAPAMPGKKVLVPGPAQEIPKSKCCSSM

SEQ ID NO: 8179 - protein, 217 aa, Sorghum bicolor
MAGAGDKVDYVFKVVLIGDSAVGKSQILARFARNEFSLDSKATIGVEFQTRTLVIDHRSVKAQIWDTAGQERYRAVTSAYYRGALGALLVYDITRRQSFDHIPRWLDELRAHADKNIVIMLVGNKSDLEEQRAVSTEDAKEFAEKENLFFLETSALQATNVESAFQTVLTEIFKIHSKKNMVSEPKSNGVAPAMAGTKVLVPGPAQEIPKSKCCSSM

SEQ ID NO: 8180 - protein, 217 aa, Panicum virgatum
MARAGEKVDYVFKVVLIGDSAVGKSQILARFARNEFSLDSKATIGVEFQTRTLVIDHRSVKAQIWDTAGQERYRAVTSAYYRGALGALLVYDITRRQSFDHIPRWLDELRAHADKNIVIMLVGNKSDLEEQRAVSTEDAKEFAEKENLFFLETSALQATNVESAFQTVLTEIFKIHSKKNMVSEPKSNGSAPAMPGKKVLVPGPAQEIPKSKCCSSM

SEQ ID NO: 8181 - protein, 217 aa, Cynodon dactylon
MAGAAEKVDYVFKVVLIGDSAVGKSQILARFARNEFSLDSKATIGVEFQTRTLVIDSRSVKAQIWDTAGQERYRAVTSAYYRGALGALLVYDITRRQSFDHIPRWLDELRAHADKNIVIMLVGNKSDLEEQRAVSTEDAKEFAEKENLFFLETSALQATNVESAFQTVLTEIFKIHSKKNMVSEPKSNGAAPAMAGKKVLVPGPAQEIPKSKCCSSM

SEQ ID NO: 8182 - protein, 212 aa, Pennisetum glaucum
GEKVDYVFKVVLIGDSAVGKSQILARFARNEFSLDSKATIGVEFQTRTLVIDNRSVKAQIWDTAGQERYRAVTSAYYRGALGALLVYDITRRQSFDHIPRWLDELRAHADKNIVIMLVGNKSDLEEQRAVSTEDAKEFAEKENLFFLETSALQATNVESAFQTVLTEIFKIHSKKNMVPEPKSNGAAPAMPGKVLVPGPVQEIPKSKCCSSM

SEQ ID NO: 8183 - protein, 217 aa, Setaria italica
MAGGADKVDYVFKVVLIGDSAVGKSQILARFARNEFSLDSKATIGVEFQTRTLVIDHKSVKAQIWDTAGQERYRAVTSAYYRGALGALLVYDITKRQSFDHIPRWLEELRGHADKNIVIMLVGNKSDLEEERAVSTEDAKEFAEKENLFFLETSALQATNVENAFQTVLTEIFKIHSKKNMAADPKANGAAPSLAGKKVLVPGPAQEIPKSKCCSSM

SEQ ID NO: 8184 - protein, 216 aa, Pennisetum glaucum
AGSGDKVDYVFKVVLIGDSAVGKSQILARFARNEFSLDSKATIGVEFQTRTLVIDHKSVKAQIWDTAGQERYRAVTSAYYRGALGALLVYDITKRQSFDHIPRWLEELRGHADKNIVIMLVGNKSDLEEERAVSTEDAKEFAEKENLFFLETSALQATNVENAFQTVLTEIFKIHSKKNMAADPKANGAAPSLAGKKVLVPGPAQEIPKSKCCSSM

SEQ ID NO: 8185 - protein, 217 aa, Saccharum officinarum
MAGGGDKVDYVFKVVLIGDSAVGKSQILARFARNEFSLDSKATIGVEFQTRTLVIDHKSVKAQIWDTAGQERYRAVTSAYYRGALGALLVYDITKRQSFDHIPRWLEELRGHADKNIVIMLVGNKSDLEEERAVSTEDAKEFAEKENLFFLETSALQATNVENAFQTVLTEIFKIHGKKNMAADPKANGAAPSLAGKKVIVPGPAQEIPKSKCCSSM

SEQ ID NO: 8186 - protein, 223 aa, Echinochloa colona
MSRGGSHGELGQRIDYVFKVVLIGDSAVGKSQLLARFARNEFNLDSKATIGVEFQTRTLVIDKRSVKAQIWDTAGQERYRAVTSAYYRGALGALLVYDITRRQSFDHIPRWLDELRAHADKNIVIMLVGNKSDLEEQRAVSTEDAKEFAEKENLFFLETSALQATNVESAFQNVLTEIFKIHSKKNMVSEPKSNGAAPAMPGKKVLVPGPAQEIPKSKCCSSM

SEQ ID NO: 8187 - protein, 216 aa, Leymus cinereus x Leymus triticoides
  Sequence also found in Organisms: Triticum aestivum
MASGEKVDYVFKVVLIGDSAVGKSQILARFARNEFSLDSKATIGVEFQTRTLVIDHKSVKAQIWDTAGQERYRAVTSAYYRGALGALLVYDITKRQSFDHIPRWLEELRGHADKNIVIMLVGNKSDLEDERAVSTEDAKEFAEKENLFFLETSALQATNVESAFQTVLSEIFKIHSKKNIVTDPKANGAAPPLAGKKVLVPGPAQEIPKSKCCSSM

SEQ ID NO: 8188 - protein, 217 aa, Sorghum bicolor
MKGGGDKVDYVFKVVLIGDSAVGKSQILARFARNEFSLDSKATIGVEFQTRTLVIDHKSVKAQIWDTAGQERYRAVTSAYYRGALGALLVYDITKRQSFDHIPRWLEELRGHADKNIVIMLVGNKSDLEEERAVSSEDAKEFAEKENLFFLETSALQATNVENAFQTVLTEIFKIHSKKNMAADPKANGAAPSLAGKKVIVPGPAQEIPKSKCCSSM

SEQ ID NO: 8189 - protein, 217 aa, Zea mays
MAGGGDKVDYVFKVVLIGDSAVGKSQILARFARNEFSLDSKATIGVEFQTRTLVIEHKSVKAQIWDTAGQERYRAVTSAYYRGALGALLVYDITKRQSFDHIPRWLEELRGHADKNIVIMLVGNKSDLEDERAVSTEDAKEFAEKENLFFLETSALQATNVENAFQTVLTEIFKIHSKKNMAADPRANGAAPSLAGKKVIVPGPAQEIPKSKCCSSM

SEQ ID NO: 8190 - protein, 200 aa, Panicum virgatum
GDSAVGKSQILARFARNEFSLDSKATIGVEFQTRTLVIDHRSVKAQIWDTAGQERYRAVTSAYYRGALGALLVYDITRRQSFDHIPRWLDELRAHADKNIVIMLVGNKSDLEEQRAVSTEDAKEFAEKENLFFLETSALQATNVESAFQTVLTEIFKIHSKKNMVSEPKSNGSAPAMPGKKVLVPGPAQEIPKSKCCSSM

SEQ ID NO: 8191 - protein, 216 aa, Brachypodium distachyon
MAGGDKVDYVFKVVLIGDSAVGKSQILARFARNEFSLDSKATIGVEFQTRTLLIDHKSVKAQIWDTAGQERYRAVTSAYYRGALGALLVYDITKRQSFDHIPRWLEELRGHADKNIVIMLVGNKSDLEDERAVSTEDAKEFAEKENVFFLETSALQATNVENAFQTVLSEIFKIHSKKNIAAEPKANGSAPSLAGKKVLVPGPAQEIPKSKCCSSM

SEQ ID NO: 8192 - protein, 216 aa, Secale cereale
MASGEKVDYVFKVVLIGDSAVGKSQILARFARNEFSLDSKATIGVEFQTRTLVIDHKSVKAQIWDTAGQERYRAVTSAYYRGALGALLVYDITKRQSFDHIPRWLEELRGHADKNIVIMLVGNKSDLEDERAVSTEDAKEFAEKENLFFLETSALQATNVENSFQTVLSEIFKIHSKKNIVTDPKANGAAPPLAGKKVLVPGPAQEIPKSKCCSSM

SEQ ID NO: 8193 - protein, 216 aa, Festuca arundinacea
MAGGEKVDYVFKVVLIGDSAVGKSQILARFARNEFSLDSKATIGVEFQTRTLVIDHKSVKAQIWDTAGQERYRAVTSAYYRGALGALLVYDITKRQSFDHIPRWLEELRGHADKNIVIMLVGNKSDLEDERAVSTEDAKEFAEKENLFFLETSAMQATNVENSFQTVLSEIFKIHSKKNIAADPKVNGAAPSLAGKKVLVPGPAQEIPKSKCCSSM

SEQ ID NO: 8194 - protein, 216 aa, Oryza sativa
MAGGEKVDYVFKVVLIGDSAVGKSQILARFARNEFSIDSKATIGVEFQTRTLLIDHKSVKAQIWDTAGQERYRAVTSAYYRGALGALLVYDITKRQSFDHIPRWLEELRGHADKNIVIMLVGNKSDLEDERAVSTEDAKEFAEKENLFFLETSALQATNVENAFQTVLSEIFKIHSKKNMAADPKANGAAPSLAGKKVVVPGPAQEIPKSKCCSSM

SEQ ID NO: 8195 - protein, 216 aa, Avena sativa
MAGGEKVDYVFKVVLIGDSAVGKSQILARFARNEFSLDSKATIGVEFQTRTLVIDHKSVKAQIWDTAGQERYRAVTSAYYRGALGALLVYDITKRQSFDHIPRWLEELRGHADKNIVIMLVGNKSDLEDERAVSTEDAKEFAEKENIFFLETSAMQATNVENSFQTVLSEIFKIHSKKNITADPKANGAAPSLAGKKVLVPGPAQEIPKSKCCSSM

SEQ ID NO: 8196 - protein, 216 aa, Lolium multiflorum
MAGGEKVDYVFKVVLIGDSAVGKSQILARFARNEFSLDSKATIGVEFQTRTLLIDHKSVKAQIWDTAGQERYRAVTSAYYRGALGALLVYDITKRQSFDHIPRWLEELRGHADKNIVIMLVGNKSDLEDERAVSTEDAKEFAEKENLFFLETSAMQATNVENSFQTVLSEIFKIHSKKNIAADPKVNGAAPSLAGKKVLVPGPAQEIPKSKCCSSM

SEQ ID NO: 8197 - protein, 209 aa, Echinochloa colona
DYVFKVVLIGDSAVGKSQILARFARNEFSLDSKATIGVEFQTRTLVIDHKSVKAQIWDTAGQERYRAVTSAYYRGALGALLVYDITKRQSFDHIPRWLEELRGHADKNIAIMLVGNKSDLEEERAVSTEDAKEFAEKENLFFLETSALQATNVENAFQTVLTEIFKIHSKKNMAPDPKANGAAPSLAGKKVLVPGPAQEIPKSKCCSSM

SEQ ID NO: 8198 - protein, 216 aa, Avena sativa
MAGGEKVDYVFKVVLIGDSAVGKSQILARFARNEFSLDSKATIGVEFQTRTLVIDHKSVKAQIWDTAGQERYRAVTSAYYRGALGALLVYDITKRQSFDHIPRWLEELRGHADKNIVIMLVGNKSDLEDERAVSTEDAKEFAEKENIFFLETSAMQATNVENSFQTVLSEIFKIHSNKNIMADPKANGAAPSLAGKKVLVPGPAQEIPKSKCCSSM

SEQ ID NO: 8199 - protein, 213 aa, Avena sativa
MAGGEKVDYVFKVVLIGDSAVGKSQILARFARNEFSLDSKATIGVEFQTRTLVIDHKSVKAQIWDTAGQERYRAVTSAYYRGALGALLVYDITKRQSFDHIPRWLEELRGHADKNIVIMLVGNKSDLEDERAVSTEDAKEFAEKENIFFLETSAMQATNVENSFQTVLSEIFKIHSNKNIMADPKANGAAPSLAGKKVLVPGPAQEIPKSKCC

SEQ ID NO: 8200 - protein, 223 aa, Echinochloa colona
MSRGGSHGELGQRIDYVFKVVLIGDSAVGKSQILARFARNEFSLDSKATIGVEFQTRTLVIDHKSVKAQIWDTAGQERYRAVTSAYYRGALGALLVYDITKRQSFDHIPRWLEELRGHADKNIVIMLVGNKSDLEEERAVSTEDAKEFAEKENLFFLETSALQATNVENAFQTVLTEIFKIHSKKNMAPDPKANGAAPSLAGKKVLVPGPAQEIPKSKCCSSM

SEQ ID NO: 8201 - protein, 218 aa, Musa acuminata
MAGGSDKIDYVFKVVLIGDSAVGKSQILARFARNEFSLDSKATIGVEFQTRTLVIQHKSVKAQIWDTAGQERYRAVTSAYYRGAVGALMVYDITRRQSFDHISRWLEELRSHADRNIVIMLVGNKTDLEDQRAVTTEDAREFAQKENLFFLETSALEATNVENAFQMVLTEIFNIVNKKNLTSDPQSNNSAPALPGKKVIIPGPAQEIPKSKTCCKTS

SEQ ID NO: 8202 - protein, 218 aa, Cocos nucifera
MAAVGEKIDYVFKVVLIGDSAVGKSQILARFARDEFSLDSKATIGVEFQTRTLVIQHKSVKAQIWDTAGQERYRAVTSAYYRGAVGALLVYDITKRQSFDHIPRWLEELRSHADKNIVIMLVGNKSDLEDQRAVSTEDASEFAQKENLFFLETSALEARNVETAFQTVLTEIFNIINKKNVVSEPQGNGNAPTLSGKKIVIPGPAQEIPKKKMCCQAS

SEQ ID NO: 8203 - protein, 219 aa, Musa acuminata
MAGGGSEKIDYVFKVVLIGDSAVGKSQILARFARDEFSLDSKATIGVEFQTRTLVIQHKSVKAQIWDTAGQERYRAVTSAYYRGAVGALLVYDITKRQSFDHIPRWLEELRSHADRNIVIMLVGNKTDLEDQRAVTTEDAREFAQKENLFFLETSALEATNVENAFQTVLTEIFNIVNKKNLTSDPQSNNAAPTQPGKKIIVPGPAQEIPKNKTCCNTS

SEQ ID NO: 8204 - protein, 216 aa, Ananas comosus
MGDRVDYVFKVVLIGDSAVGKSQILARFARNEFALDSKATIGVEFQTRTLVIDHKSVKAQIWDTAGQERYRAVTSAYYRGAVGALLVYDITRRQTFDHIPRWLDELRAHADKNIVIMLVGNKTDLVDQRTVPTEDAREFAEKENLFFLETSALEATNIENAFQTVLTEIFNIVNKKNLASDSQSNGNGSAPISGKKIIVPGPAQEIPKSKACCKSL

SEQ ID NO: 8205 - protein, 220 aa, Musa acuminata
AGMAGGSDKIDYVFKVVLIGDSAVGKSQILARFARNEFSLDSKATIGVEFQTRTLVIQHKSVKAQIWDTAGQERYRAVTSAYYRGAVGALMVYDITRRQSFDHISRWLEELRSHADRNIVIMLVGNKTDLEDQRAVTTEDAREFAQKENLFFLETSALEATNVENAFQMVLTEIFNIVNKKNLTSDPQSNNSAPALPGKKVIIPGPAQEIPKSKTCCKTS

SEQ ID NO: 8206 - protein, 218 aa, Elaeis guineensis
MAAVGEKIDYVFKVVLIGDSAVGKSQILARFARDEFSLDSKATIGVEFQTRTLVIQHKSVKAQIWDTAGQERYRAVTSAYYRGAVGALLVYDITKRQSFDHIPRWLEELRSHADKNIVIMLVGNKSDLEDQRAVSTEDASEFAQKENLFFLETSALEARNVETAFQTVLTEIFNIINKKTVVSDPQGNGNAPTLSGKKIVIPGPAQEIPKNKMCCQTS

SEQ ID NO: 8207 - protein, 219 aa, Phalaenopsis aphrodite
MAAGGDKIDYVFKVVLIGDSAVGKSQILARFARNEFSLDSKATIGVEFQTRTLVIQHKSVKAQIWDTAGQERYRAVTSAYYRGAVGALLVYDITKRQSFDHIPRWLEELRSHADKNIVIMLVGNKSDLEDQRAVSTEDAKDFAQKEGLFFLETSALEATNVEAAFMTVLTEIFGIVSKRNLTADGQSNGGAAPPLAGKKIVVTGPAQVIPKSRTCCQSS

SEQ ID NO: 8208 - protein, 219 aa, Musa acuminata
MAGGGSDKIDYVFKVVLIGDSAVGKSQILARFARNEFSLDSKATIGVEFQTRTLVIQHKSVKAQIWDTAGQERYRAVTSAYYRGAVGALIVYDITRRQCFDHIPRWLEELRSHADKNIVIMLVGNKTDLEDQRAVPMEDAREFAQKENLFFLETSALDATNVENAFQTVLTEIFNIVNKKSLTSDPQSNNSAPTLPAKKIIIPGPAQEIPKSKMCCKAS

SEQ ID NO: 8209 - protein, 219 aa, Musa acuminata
MAGGGSEKIDYVFKVVLIGDSAVGKSQILARFARDEFSLDSKATIGVEFQTRTLVIQHKSVKAQIWDTAGQERYRAVTSAYYRGAVGALLVYDVTKRQSFDHIPRWLEELRSHADRNIVIMLVGNKTDLEDQRAVTTEDAREFAQKENLFFLETSALEATNVENAFQTVLTEIFNIVNKKNLTSDPQSNNAAPTQPGKKIIVPGPAQEIPTNKTCCNTS

SEQ ID NO: 8210 - protein, 219 aa, Musa acuminata
MAGGGSDKIDYVFKVVLIGDSAVGKSQILARFARNEFSLDSKATIGVEFQTRTLVIQHKSVKAQIWDTAGQERYRAVTSAYYRGAVGALIVYDITRRQCFDHIPRWLEELRSHADKNIVIMLVGNKTDLEGQRAVPMEDAREFAQKENLFFLETSALDATNVENAFQTVLTEIFNIVNKKSLTSDPQSNNSAPTLPAKKIIIPGPAQEIPKSKVCCKAS

SEQ ID NO: 8211 - protein, 218 aa, Zingiber officinale
MAGGSDKIDYVFKVVLIGDSAVGKSQILARFARDEFSLDSKATIGVEFQTRTLVIQHKSVKAQIWDTAGQERYRAVTSAYYRGAVGALLVYDITKRQSFDHIPRWLEELRSHADRNIVIMLVGNKTDLEDQRTITTEDAREFAQKENLFFLETSALEATNIENAFQTVLTEIFNIVNKKNLTSDPQSNNTAPTLPGKKIIVPGPAQEIPKSKTCCTTS

SEQ ID NO: 8212 - protein, 218 aa, Elaeis guineensis
MAAGGEKIDYVFKVVLIGDSAVGKSQILARFARNEFSLDSKATIGVEFQTRTLVIQHKSVKAQIWDTAGQERYRAVTSAYYRGAVGALLVYDITKRQTFDHIPRWLEELRSHADKNIVIMLVGNKTDLEDQRAVTTEDASEFAQKENLFFLETSALEATNVETAFETVLTEIFTIVNRKNLVSEPQGNGNGPALSGKKLLIPGPAQAIPKNKMCCQTS

SEQ ID NO: 8213 - protein, 222 aa, Amaranthus tuberculatus
MAGYGDSSQKVDYVFKVVLIGDSAVGKSQILARFARDEFSLDSKATIGVEFQTRTLVIQHKSVKAQIWDTAGQERYRAVTSAYYRGAVGALLVYDITKRQTFEHIPRWLDELRGHADKNIVIMLVGNKSDLEDQRAVATEDAKEFAEKEGLFFLETSALEATNVETAFITVLTEIFNIVNRKTLAANEDQSNGNAALLPGKQILVPGPAQEIPAKKGMCCSS

SEQ ID NO: 8214 - protein, 222 aa, Amaranthus tuberculatus
MAGYGDSSQKVDYVFKVVLIGDSAVGKSQILARFARDEFSLDSKATIGVEFQTRTLVIQHKSVKAQIWDTAGQERYRAVTSAYYRGAVGALLVYDITKRQTFEHIPRWLDELRGHADKNIVIMLVGNKSDLEDQRAVATEDAKEFAEKEGLFFLETSALEATNVETAFITVLTEIFNIVNRKTLAANEDQSNGNAALLPGKQILVPGPAQEIPAKKGVCCSS

SEQ ID NO: 8215 - protein, 222 aa, Amaranthus tuberculatus
MAGYGDSSQKVDYVFKVVLIGDSAVGKSQILARFARDEFSLDSKATIGVEFQTRTLLIQHKSVKAQIWDTAGQERYRAVTSAYYRGAVGALLVYDITKRQTFEHIPRWLDELRGHADKNIVIMLVGNKSDLEDQRAVATEDAKEFAEKEGLFFLETSALEATNVETAFITVLTEIFNIVNRKTLAANEDQSNGNAALLPGKQILVPGPAQEIPAKKGMCCSS

SEQ ID NO: 8216 - protein, 221 aa, Amaranthus tuberculatus
AGYGDSSQKVDYVFKVVLIGDSAVGKSQILARFARDEFSLDSKATIGVEFQTRTLVIQHKSVKAQIWDTAGQERYRAVTSAYYRGAVGALLVYDITKRQTFEHIPRWLDELRGHADKNIVIMLVGNKSDLEDQRAVATEDAKEFAEKEGLFFLETSALEATNVETAFITVLTEIFNIVNRKTLAANEDQSNGNAALLPGKQILVPGPAQEIPAKKGMCCSS

SEQ ID NO: 8217 - protein, 223 aa, Actinidia deliciosa
MASGYGDASQKIDYVFKVVLIGDSAVGKSQILARFARNEFSLDSKATIGVEFQTRTLVIQHKSVKAQIWDTAGQERYRAVTSAYYRGAVGAMLVYDITKRQTFDHIPRWLEELRAHADKNIVIILIGNKTDLEEQRAVPTEDAKEFAEKEGLFFLETSALEATNVETAFMTVLTEIFNIVNKKNLVASEDQANGNPASLAGKKILIPGPAQEIPAKSKMCCTS

SEQ ID NO: 8218 - protein, 223 aa, Populus trichocarpa
MASGGGYGDASQKIDYVFKVVLIGDSAVGKSQILARFARNEFSLDSKATIGVEFQTRTLVIDHKSVKAQIWDTAGQERYRAVTSAYYRGAVGAMLVYDITKRQTFDHIPRWLEELRNHADKNIVIILIGNKSDLEDQRAVPTEDAKEFAQKEGLFFLETSALQATNVENAFMTVLTEIFNIVNKKNLVAGEDQSNGNPASLSGKKIIIPGPAQEIPAKSKCCS

SEQ ID NO: 8219 - protein, 217 aa, Allium cepa
MAEKIDYVFKVVLIGDSAVGKSQILARFARNEFSLDSKATIGVEFQTRTLVISHKSVKAQIWDTAGQERYRAVTSAYYRGAVGALLVYDITKRQTFDHIPRWLEELRSHADKNIVIMLIGNKSDLEDQRAVPTDDAKEFAQKENLFFLETSALESTNVEPAFNTVLTEIFNIVNKKNLVAEGLGNGNGAAPALPGKKIIVPGPDQVIPKTRPCCSSF

SEQ ID NO: 8220 - protein, 220 aa, Amorphophallus konjac
MAGGSVGDKVDYVFKVVLIGDSAVGKSQILARFARNEFSLDSKATIGVEFQTRTLVIQHKSVKAQIWDTAGQERYRAVTSAYYRGALGAMLVYDITKRQTFDHIARWLEELRSHADKNLVIMLIGNKSDLEDQRVVSTEDATEFAQKEGLFFLETSALQATNVETAFTTVLTEIFDVMTKKTLASDNPADNNAPALSGKKIIIPGPAQEIPKSKACCSAH

SEQ ID NO: 8221 - protein, 224 aa, Cajanus cajan
MASGGGYGDANQKVDYVFKVVLIGDSAVGKSQILARFARNEFSLDSKATIGVEFQTRTLVIQHKSVKAQIWDTAGQERYRAVTSAYYRGAVGAMLVYDITKRQSFDHIPRWLEELRNHADKNIVIILIGNKSDLENQRAVSTEDAKEFAEKEGLFFLETSALEATNVETAFMTVLTEIFNIVNKKNLAADDNQGNGNSASLSGKKIIVPGPAQEIPKRSMCCQS

SEQ ID NO: 8222 - protein, 218 aa, Cocos nucifera
MAAGGEKIDYVFKVVLIGDSAVGKSQILARFAHNEFSLDSKATIGVEFQTRTLVIQHKSVKAQIWDTAGQERYRAVTSAYYRGAVGALLVYDITKSQSFDHIPRWLEELRSHADKNIVIMLVGNKTDLEDQRAVTTEDASELAQKENLSFLETSALEATNVETAFQTVLTEIFNIVNRKNLVSEPQGNGNGPALSGKTIVVPGPALVIPKNKVCCQTS

SEQ ID NO: 8223 - protein, 217 aa, Allium cepa
MAEKIDYVFKVVLIGDSAVGKSQILARFARNEFSLDSKATIGVEFQTRTLVISHKSVKAQIWDTAGQERYRAVTSAYYRGAVGALLVYDITKRQTFDHIPRWLEELRSHADKNIVIMLIGNKSDLEDQRAVPTDDAKEFAQKENLFFLETSALESTNVEPAFNTVLTEIFNIVNKKNLVAEGQGNGNGAAPTLPGKKIIVPGPDQVIPKTRPCCSSF

SEQ ID NO: 8224 - protein, 525 aa, Sorghum bicolor
MVTSVLLILRETSPWALVGAAASVALLWLVAWTLEWAWWTPRRLDRALRAQGLKGTKYRLLTGDVRENARLNREARTKPLALGSHDIIPRVLPMLHNVVKEYGTNSFTWFGPVPRVIIPDPELVREVLSNKFGHFGKPRFSRLGKLLANGLANHEGEKWAKHRRILNPAFHHEKIKRMLPVFATCCTDMINRWENSMSSEGSSEIDVWPEFQNLTGDVISRTAFGSNYQEGRNIFQLQGEQAERLIQSFQTIFIPGYWFLPTKNNRRMKEIDREICKVLHGIIRKRERAFIDGEGSNDDLLGLLVESNMRESNGNAKLGMSTKDIIEECKLFYFAGMETTSVLLTWTLIVLSMHPEWQERARDEVLNHFGRGRPDFDSLNRLKIVTMILYEVLRLYPPVILLTRRTYKEMELGGITYPSGVSLLLPIIFIHHDPNIWGKDASEFNPQRFEDGISNATKHQAAFFPFGWGPRICIGQNFALLEAKMALCTILQRFSFELSPSYTHAPYTVITLHPQHGAQIRLKKL

SEQ ID NO: 8225 - protein, 525 aa, Setaria italica
MATRALLLLREAPPWAVAGAAAAVALLWLAAWTLEWAWWTPRRLDRALRAQGLKGTRYRLFTGDVRENARLNREARTKPLPLGCHDIIPRVLPMLHKVVKENGTVSFTWFGPTPRVMIPDPESVKEVLSNKFGHFGKQQFSRAGKLLGDGVANHEGEKWAKHRRILNPAFHHEKIKKMLPVFATCCVDVINRWENSMSSEGSSEIDIWPEFQNLTGDVISRTAFGSSYQEGRRIFQLQGELAERLIQSFQAIFIPGYWFLPTKNNRRMREINREIHKILREIIGKREKAMKNGETNNDDLLGLLLESNMRQSNGNAKLGLTTEHVIEECKLFYFAGMETTSVLLTWTLVVLSMHPEWQEQAREEVLNHFGRARPDFESLNRLKIVTMILYEVLRLYPPVVLLSRRTYKGMELGGIKYPAGVNLLLPIIFIHHDPNIWGKDAGMFNPERFADGISNATKHQAAFFPFGGGPRICIGQNFALLEAKMALCTILQRFSFELSPSYTHAPYTVITLHPQHGAPIRLKKL

SEQ ID NO: 8226 - protein, 525 aa, Avena sativa
MATRALQMLWEASPWSLAGAVAAMTLLWLAAWILEWAWWTPRRLGRALQAQGLRGTRYRLFTGDVPENARLNREARSKPLPLGSHEIIPRVQPMFDKAIKENGKMSFTWFGPTPRVLIPDPEFVREVLSNKFGHYGKQKPSRMGKLLANGVVNHEGEKWAKHRRILNPAFHHEKIKRMLPVFSTCCEEMITRWENSMSAEGLSEIDIWPEFQNLTGDVISRTAFGSNYQEGMKIFQLQGELAERLIQGFQTLFIPGYWFLPTKNNRRMRAIDREIRSILRGIIAKKDRAIKNGEASSDDLLGLLLESNARESNGKADLGMSTEDIIEECKLFYFAGMETTSVLLTWTLILLSMHPEWQEQAREEVLHHFGRTTPDFDNLSRLKIVTMILYEVLRLYPPVVFITRRTYKAMELGGIKYPAGVNLMLPILFIHHDPNIWGKDASEFNPQRFADGISNAAKHPAAFFPFGGGPRICIGQNFALLEAKMALSTILQRFSLELSPSYTHAPYTVITLHPQHGAQIRLKKI

SEQ ID NO: 8227 - protein, 525 aa, Sorghum bicolor
MATRVLLMLRETSPWALAGAAASVALLWLVAWTLEWAWWTPRRLDRALRAQGLKGTRYRLFTGDLRETARVNREARKNPLPLGCHDIAPRVQPMLHSAMKEYGKLSFTWFGPTPRVMIPDPELVKEVLSNKFGHFGKPRSSRIGKLLANGVVNHDGEKWAKHRRILNPAFHHEKIKRMLPVFSTCCIETIIRWENSMPSEGSSEIDVWPEFQNLTGDVISRTAFGSNYQEGRRIFQLQGELAERLIQSIQTIFIPGYWFLPTKNNRRMKEIDLEIRKILREIIGKREKATRNGETNNDDLLGLLLESNTRQSNGNASLGLTTEDVIEECKLFYFAGMETTSVLLTWTLIVLSMHPEWQERAREEVLSHFGRTRPDFDSLSRLKIVTMILHEVLRLYPPATFLTRRTYKEMELGGIKYPAGVNLLLPIIFIHHDPDIWGKDASEFNPERFANGISNATRHQAAFFPFGGGPRICIGQSFALLEAKMALCTILQRFSFELSPSYTHAPYTVITLHPQHGAQIRLKKL

SEQ ID NO: 8228 - protein, 525 aa, Avena sativa
MATRALQMLWEASPWSLAGAVAAMALLWMAAWILEWAWWTPRRLGRALQAQGLRGTRYRLFTGDVPENARLNREARSKPLPLGSHEIIPRVQPMFDKAIKENGKISFTWFGPTPRVLIPDPEFVREVLSNKFGHYGKQKPSRMGKLLANGVVNHEGEKWAKHRRILNPAFHHEKIKRMLPVFSTCCEEMITRWENSMSAEGLSEIDIWPEFQNLTGDVISRTAFGSNYQEGMKIFQLQGELAERLIQGFQTLFIPGYWFLPTKNNRRMRAIDREIRTILRGIIAKKDRAIKNGEASSDDLLGLLLESNARESNGKADLGMSTEDIIEECKLFYFAGMETTSVLLTWTLILLSMHPEWQEQAREEVLHHFGRTTPDFDNLSRLKIVTMILYEVLRLYPPVVFITRRTYKAMELGGIKYPAGVNLTLPILFIHHDPNIWGKDASEFNPQRFADGISNAATHPGAFFPFGGGPRICIGQNFALLEAKMALSTILQRFSLELSPSYTHAPYTVITLHPQHGAQIRMKKI

SEQ ID NO: 8229 - protein, 525 aa, Brachypodium distachyon
MATQALLMLSEASPWSLAGAAAAVVLLSLAACILEWAWWTPRRLGRALQAQGLRGTRYRLFTGDVTENVRLNKEARSKPLPLGSHDIIPRVQPMFCKTVKENGKVSFTWFGPTPRVMIPDPELVREILSNKFGHYGKPKSSRIGKLLADGVVNHEGEKWAKHRRILNPAFHHEKIKRMLPVFSICCEEMIARWENSLSSKGLSEIDVWPEFQNLTGDVISRTAFGSNYQEGMKIFQLQEELAERLIQAFQTLFIPGYWFLPTKNNRRMRAIDREIRTILRGIIGKKDRAIKNGEASSDDLLGLLVESNMRESNGKAALGMSTEDIIEECKLFYFAGMETTSVLLTWTLILLSMHPEWQDQAREEVLHHFGRTTPDFENLGRLKIVTMILYEVLRLYPPVVFLTRRTYKEMELGGIKYPAGVNLMLPLLFIHHDPNLWGKDAGEFNPKRFSDGISNAAKHPGAFFPFGGGPRICIGQNFALLEAKMALSTILQRFSFELSPSYTHAPYTVITLHPQHGAPIRMKKI

SEQ ID NO: 8230 - protein, 525 aa, Avena sativa
MATRALQMLWEASPWSLAGAVAAMALLWMAAWILEWAWWTPRRLGRALQAQGLRGTRYRLFTGDVPENARLNREARSKPLPLGSHEIIPRVQPMFDKAIKENGKMSFTWFGPTPRVLIPDPEFVREVLSNKFGHYGKQKPSRMGKLLANGVVNHEGEKWAKHRRILNPAFHHEKIKRMLPVFSTCCEEMITRWENSMSAEGLSEIDIWPEFQNLTGDVISRTAFGSNYQEGMKIFQLQGELAERLIQGFQTLFIPGYWFLPTKNNRRMRAIDREIRTILRGIIAKKDRAIKNGEASSDDLLGLLLESNARESNGKADLGMSTEDIIEECKLFYFAGMETTSVLLTWTLILLSMHPEWQEQAREEVLHHFGRTTPDFDNLSRLKIVTMILYEVLRLYPPVVFITRRTYKAMELGGIKYPAGVNLTLPILFIHHDPNIWGKDASEFNPQRFADGISNAATHPGAFFPFGGGPRICIGQNFALLEAKMALSTILQRFSLELSPSYTHAPYTVITLHPQHGAQIRMKKI

SEQ ID NO: 8231 - protein, 525 aa, Panicum virgatum
MAARALLMLREASPWALAGAAAAVALLWLVAWTAEWAWWTPRRLDRALRAQGLKGTRYRLFTGDLAENARINREARTKPLPLGCHDIAPRVQPMLHRAIKEYGKMSFTWFGPIPRVMIPDPELVKEVLSNKFGHFGKPRSSRIGKLLADGVVNHDGEKWAKHRRILNPAFHHEKIKRMLPVFSTCCAETITKWENSMPSEGSFEVDVWPEFQNLTGDVISRTAFGSSYQEGMKIFQLQGELAERLVQSFQTIFIPGYWFLPTKNNRRMREIDREIRKTLREIIRKREKAIKDGKTNNDDLLGLLLESNMNESKGNAKLGLSTEDVIEECKLFYFAGMETTSVLLTWTLIVLSLHPEWQEGAREEVLNHFGRAKPDFDSLNHLKTVTMILYEVLRLYPPATFIVRRTYKEMELGSIIYPAGVNLQLPILFIHHDPEIWGKDASEFNPARFADGVSNATKHQGAFFPFGGGPRICIGQNFALLEAKMALCTILQRFSFELSPSYTHAPYTVITLHPQHGAQIRLKKL

SEQ ID NO: 8232 - protein, 525 aa, Avena sativa
MATRALQMLREASPWSLAGAAAAMALLWLAAWILEWAWWIPRRLGRALQAQGLRGTRYRLFTGDVPENSRLNREARSKPLPLGSHDIMPRVQPMLSNTIKDNGKLSFTWFGPEPRVLIPDPELVREILSNKFGHYGKPKSSRFGRLLANGLVNHEGEKWAKHRRILNPAFHHEKIKRMLPVFSTCSEEMITRWENSMSSGGLSEVDVWPEFQNLTGDVISRTAFGSSYQEGMKIFQLQGELGERLMEAFQTLFIPGYWFLPTKNNRRMRAIDREICTILRGIIGKKDRAIKNGETSSDDLLGLLVESNMRESDGKADLGMTTEDIIEECKLFYFAGMETTSVLLTWTLILLSMHPEWQEQARKEVLHHFGKTRPDFENLSRLKTVTMILYEVLRLYPPAVFLTRRTYKAMELGGIKYPAGVNLMLPILFIHHDPNIWGKDASEFNPQRFADGISNAAKHPAAFFPFGGGPRICIGQNFALLEAKMALSTILQRFSFELSPSYTHAPYTVLTLHPQHGAPIMLKKI

SEQ ID NO: 8233 - protein, 524 aa, Panicum virgatum
MAARALLMLREASPWALAGAAAAVALLWLVAWTAEWAWWTPRRLDRALRARGLKGTRYRLFTGDLAENARINREARTKPLPLGCHDIAPRVQPMLHRAIKEYGKMTFTWFGPIPRVMIPDPELVKEVLSNKFGHFGKQSSRIAKLLAEGVVSHEGEKWAKHRRILNPAFHHEKIKRMLPVFSTCCAQTITKWENSMPSEGSFEVDVWPEFQNLTGDVISRTAFGSSYQEGMKIFQLQGELAERLVQSFQTIFIPGYWFLPTKNNRRMREIDREIRKILLEIITKREKAIKDGKPSNDDLLGLLLESNMNESKGNAKLGLSTEDVIEECKLFYFAGMETTSVLLTWTLIVLSMHPEWQERAREEVLNHFGRANPDFDSLSRLKTVTMILYEVLRLYPPVTLIVRRTYKEMELGSITYPAGVNLVLPILFIHHDPEIWGKDASEFNPARFADGVSNATKHQGAFFPFGGGPRICIGQNFALLEAKMALCTILQRFSFELSPSYTHVPYTVLTLHPQHGAQIRLKKL

SEQ ID NO: 8234 - protein, 518 aa, Setaria italica
MLWEASPWALAGAAAAVALLWLVAWTVEWAWWIPRRLDRALRAQGLKGTAYRLFTGDLRESARINREARAKPLPLGSHEIAARVQPLLYRATKEYGKVSFTWFGPVPRVMIPDPELVKEVLSNKFGHFGKPRSTRIGKLLANGVVNHEGEKWAKHRRILNPAFHHEKIKRMLPVFSTCCDETITRWENSMPSEGSSEIDVWPEFQNLTGDVISKTAFGSSYQEGRKIFQLQGELAERLVQSFQTIFIPGYWFLPTKNNRRMREIDREIRTILHEIIGKREKAMKNGETNNDDLLGLLLESNMKQSNGNAKLGLTTEDVIEECKLFYFAGMETTSVLLTWTLVVLSMHPEWQERAREEVLSHFGRAKPDFDSLSRLKTVTMILYEVLRLYPPATFLTRRTYKDMELGGIRYPAGVNLLLPILFIHHDPDIWGKDASEFNPARFSDGISNATKHQGAFFPFGGGPRICIGQNFALLEAKMALCTILQRFSFELSPSYTHAPYTVITLHPQHGAPIRLKKL

SEQ ID NO: 8235 - protein, 523 aa, Panicum virgatum
MATRALPLLRESPPWAVACAAAALLWLVAWTLEWAWWTPRWLDRALRDQGLKGTRYRLFTGDLRENTRLNREARAKPLPLGCHDIIPRVLPMLHNAVKENGAASFTWFGPNPRVMIPDPESVREVLSNKFGHFGKQRFSRVGKLLGNGVANHEGEKWAKHRRILNPAFHHEKIKRMLPVFATCCINVINRWEKIMSSEGSSEIDIWPEFQNLTGDVISRTAFGSSYQEGMKIFELQGELAERLVQSFQPVFIPGYWFLPTRNNRRMREISREIHKILCDIIGKREKAMKNGETNSNDLLGLLLESNMRQSNGNAKLGLTTEDVIEECKLFYFAGMETTSVLLTWTLIVLSMHPEWQEKAREEVLNHFGRDRPDFENLNRLKTVTMILYEVLRLYPPIVLFSRSTYKEMELGGIKYPAGVNLILPVIFIHRDPSIWGEDAGKFNPERFADGISNASKHQAAFFPFGGGPRICIGQNFALLEAKMALCPILQRFSFDLSPSYIHAPYTVITLHPQHGAQIRLKKL

SEQ ID NO: 8236 - protein, 525 aa, Avena sativa
MVTRALQMLREASPWNLAGAAAAMALLWLAAWILEWAWWTPRRLGRALQAQGLRGTRYRLFTGDVPENARLNREARSKPLPLGSHDIMPRVQPMLSNTIKDNGKLSFTWFGPEPRVLIPDPELVREILSNKFGHYGKPKSSRFGRLLANGLVNHEGEKWAKHRRILNPAFHHEKIKRMLPVFSTCSEEMITRWENSMPSGGLSEVDVWPEFQNLTGDVISRTAFGSSYQEGMKIFQLQGELGERLMEAFQTLFIPGYWFLPTKNNRRMRAIDREICTIMRGIIGKKDRAIKNGETSSDDLLGLLVESNMRESDGKADLGMTTEDIIEECKLFYFAGMETTSVLLTWTLILLSMHPEWQEQARKEVLHHFGKNRPDFENLSRLKTVTMILYEVLRLYPPAIFLTRRTYKAMELGGIKYPAGVNLMLPILFIHHDPNIWGKDASEFNPQRFADGISNAAKHPAAFFPFGGGPRICIGQNFALLEAKMALSTILQRFSFELSPSYTHAPYTVLTLHPQHGAPIMLKKI

SEQ ID NO: 8237 - protein, 525 aa, Lolium multiflorum
MATRALQMLGEASPWNLACAAAAMAVLWLAAWILEWAWWTPRRLGRALEAQGLKGTRYRLFTGDVPENARLNKEARSKPLPLGSHDIIPRVQPMISNAIKENGKLSFTWFGPEPRVTILDPESVREILSNKFGHYGKPRSSRFGKLLANGLVNHQGEKWAKHRRILNPAFHHEKIKRMLPVFSACSEEMITRWENSMSSQGVSEVDVWPEFQNLTGDVISRTAFGSSYQEGTKIFQLQGEQAERLMQAFQTLFIPGYWFLPTKNNRRMRAIDREICTILRGIIEKKDRAIKSGEASSDDLLGLLLESNRRESNGKADLGMSTEDIIEECKLFYFAGMETTSVLLTWTLILLSMHPEWQEQARKEVLHHFGRTTPDFENLSRLKIVTMVLYEVLRLYPPAIFVTRRTYKEMELGGITYPAGVNLMLPILFIHHDPNIWGKDASEFNPERFADGISNAVKHPAAFFPFGGGPRICIGQNFALLEAKMALSTILQRFSFELSPSYTHAPYTVLTLHPQHGAPIVLRKI

SEQ ID NO: 8238 - protein, 525 aa, Festuca arundinacea
MATRALQMLGEASPWNLACAAAAMAVLWLAAWILEWAWWTPRRLGRALEAQGLKGTRYRLFTGDVPQNARLNKEARSKPLPLGSHDIIPRVQPMISNAIKENGKLSFTWFGPEPRVTIPDPEPVREILSNKFGHYGKPKSSRFGKLLANGLVNHQGEKWAKHRRILNPAFHHEKIKRMLPVFSACSEEMITRWENSMSSQGVSEVDVWPEFQNLTGDVISRTAFGSSYQEGTKIFQLQGEQAERLMQAFQTLFIPGYWFLPTKNNRRMRAIDREICTILRGIIEKKDRAIKSGEASSDDLLGLLLESNRRESNGKADLGMSTEDIIEECKLFYFAGMETTSVLLTWTLILLSMHPEWQEQARKEVLHHFGRTTPDFENLSRLKIVTMVLYEVLRLYPPAIFVTRRTYKAMELGGITYPAGVNLMLPILFIHHDPNIWGKDASEFNPQRFADGISNAVKHPAAFFPFGGGPRICIGQNFALLEAKMALSTILQRFSFNLSPSYTHAPYTVLTLHPQHGAPIVLRKI

SEQ ID NO: 8239 - protein, 525 aa, Setaria italica
MATRALLTLREASPWTLAGAAAAAALLWLVAWTLEWAWWTPRRLERALRAQGLRGTRYRLFTGDVRENARRNREARTKPLPLGCHDIIPRVQPLFHDLAKENGKLSFSWFGPTPRMMIPDPELVREVLSNKFGHFGKPKTIRVVKLISNGLFNHEGEKWAKHRRILNPAFHHEKIKRMLPVFSTCCIEMITRLENAMSPEGSSEIDVWPEFQNLTGDAISRTAFGSSFHEGRRIFQLQEELAERVIQSFRTIFIPGYWFLPTKNNRRIGQIDQEISKLLRGIIEKRDKVIKDRETNNDDLLGLLVESNMRESNGKVNLGMTTEDIIEECKLFYFAGMETTSVLLTWTIVVLSMHPKWQELAREEVLNYFGRARPDFDSLSRLKIVTMILYEVLRLYPPVIFLTRRTYKEIELGGIKYPAGVNLLLPLLFIHHDPIIWGKDASEFNPERFADGISNATKHQTAFFPFGWGPRICIGQNFALLEAKMALCTILQHFSFELSPSYTHAPYTVIILHPEHGAQIKLKKL

SEQ ID NO: 8240 - protein, 525 aa, Panicum virgatum
MAARALLMLREASPWALAGAAAAVALLWLVAWTAEWAWWTPRRLDRALRAQGLKGTRYRIFTGDLWENVRINREARTKPLPLGCHVIAPRVQPMLHRAIKEYGKMSFTWFGPIPRVMIPDPELVKEILSNKFGHFGKPRSTRIGKLLANGVVNHEGEKWAKHRRILNPAFHHEKIKRMLPVFSTCCAETITKWEDSMPSEGSLEVDVWPEFQNLTGDVISRTAFGSSYQEGMKIFQLQGELAECFVQSLKTIFIPGYWFLPTKNNRRMREIYQEIRKILREIIGKREKAIKDGKPNNDDLLGLLLESNMNESKGNAKLGLSTEDVIEECKLFYFAGMETTSVLLTWTLIVLSMHPEWQERAREEVLNHFGIAKPDFDSLSRLKTVTMILYEVLRLYPPVTLMVRRTYKEMELGSIRYPAGVNLLLPILFIHHDPEIWGKDASEFNPARFADGVSNATKHQGAFFPFGGGPRICIGQNFALLEAKMALCTILQRFSFELSPSYTHAPYTVITLHPQHGAQIRLKKL

SEQ ID NO: 8241 - protein, 791 aa, Sorghum bicolor
MTAQTKKRGAAENGDGGVSLGLAAFIANNEDVGPIVRHAFESGKPEALLHSLHNIVKMKEVEIEEICRLHYEEFILAVDELRGVLVDADELKGTLSDENLRLQEVASALLLKLDELLEIYSVNSNVGEALATLKICLQVTNLCKICNRDIAEAKLLSALKTLELIEKDYLQNIPLKLLKKVIHKQVPMVKLYIEKKVCSEFNEWLVYIRRTAKEIGQVAIDQTSLTHQKDEGMCARQREAEESSRVGFDVNAYTLDVEHMSEEAMLEFDLAPVYRAHHIHIGLGLGEKFREYYYNNRLMQLNLDLQISTSQPFVESYQPFLAQVAGFFIIEDRVLRTADGLLSESQVDTMLETAISKVTQILEEQFSRIDAANHLLLIKGYVSLFGATLKKYGYRSMSLVEILDKTRDKYLELLLSDCRKKLNYAFSKDSYERMVIKKENEYDTNIAAFQLEPVEGVPNLPYVAPFSSSVPNACRIVRSFIEELVSYLSHSGSTNIYDVVKSYLDKFLIETLNDGFLNLIHGGSLEFPQVVQIAGNIAILEQSCDMFLWHAARLCGVPRGLLEKPHSGLAARAVLKASQNAAYSGLITLVNSKIDEFMLQLTSINWTLEETPEHANDYMNEVIIYLHEVVSSGQQIVPRDALFKVVSGALSHISDSITTVLLSDRVKRFNANAVASIDIDLKVLEGFADDTYRMTGFSDLRKETSFRDCLVEIRQLINLLLSNQPESFVNPVTREQSYGALDHKKVAIICDKFKDAPDSLFGSLSSRATVQMQSARKKSLDVLKRRLKDFS

SEQ ID NO: 8242 - protein, 442 aa, Setaria italica
MSSPSRGGGGAPEDQGAGGEAGVERGGRGTWRHAAFHVATTIATPAAYAPLPFAVASLGWPLGVCSLVIGTLVTWCSSLAVASLWQWNGEKHTSYRLLAKSIFGPWGYWYVSSFQQVASVGNNIAIQIAAGSSLKAVYKHYYAADDRAMTLQQFILLFGAFELLLSQLPDIHSLRWVNAICTASTVGFAATTIGVTVHDGYRIDRKEVSYSLQGTTATKIFRAFNALGTIAFSFGDAMLPEIQSTVREPVRANMYRGVSAAYTIIVVSYWTLAFSGYWAFGSQVQSYILSSLTAPRWAIVMANLFAVIQIAGCFQIYCRPTFAHFEEQVRAKNRSCRSCLWRLMYTSAYMAAITLVSAAMPFFGDFVSICGAVGFTPLDFVLPTLALMKTSKLPDNLGLRYAAKALSSAVAILFSIIGALACIGAVRSIAIDVKTYKFFHDM

SEQ ID NO: 8243 - protein, 789 aa, Setaria italica
MTAQTKKRGAAENGDGGIGLGLAAFIANNEDLGPIVRHAFESGKPEALLHSLRNIVKMKEVEIEEICRLHYEEFILAVDELRGVLVDADELKGTLSDENLRLQEVASALLLKLDKLLELYSVNRSVGEALATLKICLQVTSLCKICNRDIAEAKLHSALKTLELIEKDYMQNIPLELLKKVIQKQIPIVKLYIEKKVCGEFNEWLVYIRRIGKEIGHAAIGQVNLARQKDAGMCARQREAEECSRVGFNEHAYILDVENMDEEAMLEFDLAPVYRAYHIHIGLGLGEKFREYYFNNRLMQLNSDLQISTSQPFVESHQPFLAQIAGFFIIEDRVLRTADGLLSESQVETMWETAISKVTSILEQQLSLMDTANHLLNVKGYISLLGTTMKKYGYQATSLVEILGKNRDKYLELLISDCRKQIKNVLSKDSYEQMVIKKENEYDMNVAALQLEPIDVVPDLPYVAPFSSSVPTACRIVRAFIEDLVRYLSYGSSMNFYDVVKSYLDKFLIEVLNEGFLNLIHGGSLEFQQMVQIAGNIAVFERSCDMFLCHAAQLCGVPRRILEKPHSGLTAKAVLKATQNAAYNGLITLVNSKVDEFMLQLTSINWTVEEAPEHANDYMNEVVIYLHEVVSSGQQIVPRDALYKVVSGALSHIADSIITVLLSDRVKRFNANAVAGIDIDLKMLEGFADDTYHSTGLSELRKETSFKDCLVEIRQLINLLLSNQPESFMNPVTREKNYGSLDHKKVAIICDKFKDAPDSLFGSLSSRATVQSARKKSLDVLKRRLKDFS

SEQ ID NO: 8244 - protein, 789 aa, Setaria italica
MTAQTKKRGAAENGDGGIGLGLAAFIANNEDLGPIVRHAFESGKPEALLHSLRNIVKMKEVEIEEICRLHYEEFILAVDELRGVLVDADELKGTLSDENLRLQEVASALLLKLDKLLELYSVNRSVGEALATLKICLQVTSLCKICNRDIAEAKLHSALKTLELIEKDYMQNIPLELLKKVIQKQIPIVKLYIEKKVCGEFNEWLVYIRRIGKEIGHAAIGQVNLARQKDAGMCARQREAEECSRVGFNEHAYILDVENMDEEAMLEFDLAPVYRAYHIHIGLGLGEKFREYYFNNRLMQLNSDLQISTSQPFVESHQPFLAQIAGFFIIEDRVLRTADGLLSESQVETMWETAISKVTSILEQQLSLMDTANHLLNVKGYISLLGTTMKKYGYQATSLVEILGKNRDKYLELLISDCRKQIKNVLSKDSYEQMVIKKENEYDMNVAALQLEPIDVVPDLPYVAPFSSSVPTACRIVRAFIEDLVRYLSYGSSMNFYDVVKSYLDKFLIEVLNEGFLNLIHGGSLEFQQMVQIAGNIAVFERSCDMFLCHAAQLCGVPRRILEKPHSGLTAKAVLKATQNAAYNGLITLVNSKVDEFMLQLTSINWTVEEAPEHANDYMNEVVIYLHEVVSSGQQIVPRDALYKVVSGALSHIADSIITVLLSDRVKRFNANAAAGIDIDLKMLEGFADDTYHSTGLSELRKETSFKDCLVEIRQLINLLLSNQPESFMNPVTREKNYGSLDHKKVAIICDKFKDAPDSLFGSLSSRATVQSARKKSLDVLKRRLKDFS

SEQ ID NO: 8245 - protein, 789 aa, Panicum virgatum
MTAQTKKRGAAENGDGGIGLGLAAFIANNEDLGPIIRHAFESGKPEALLHSLSNIVKMKEVEIEEICRLHYEEFILAVDELRAVLVDADDLKGTLSDENLQLQEVASALLLKLDELLELYSVNRSVGEALATLKICLKVTSLCKICNRDIAQGKLYSALKTLELIEKDYLQNIPLKLLKKVIQKQIPVMKLYIEKKVCSEFNEWLVYVRRIGKEIGQAAIDQASLARQKDEGMCARQREAEECSHVGFDGHAYSLDVENMDEEAMLEFDLAPVYRAHHIHIGLGHGEKFREYYFNNRLMQLHLDLQISTSQPFVESHQPFLSQIAGFFIIEDRVLRTADGLLSESQVATMWETAISKVTSILEQQFSLMDTANHLLNVKGYISLLGTTMKKYGYQTTLLVEILGKNRDKYLELLISDCRKQIKNILSKDSYERMVIKKENEYNMYVSALQLEPTDVAPDLPYVAPFSSSVPNACRIVRSFIEDLVRYLSYGSSMNSYDVVKSYLDKFLIEVLNDAFLKLIHGGSLEFQQMVQIAGNIAVLEQSCDMFLCHAAQVCGIPRRLLEKPHSGLTAKAVLKASRNAAYSGLITLVNSKVDEFMLQLPSINWTVEEAPEHANDYMNEVIIYLHDVVSSGQQIVPREALYKVVSGALSHIADSIITVLLSDRVKRFNANAVAGIDIDLKMLEGFADDTYHSTGLSDLRKDASFKDCLVEIRQLIDLLLSNQPESFMNPVTREKNYGSLDHKKVAIICDKFKDAPDSLFGSLSSRATVQSARKKSLDVLKRRLKDFS

SEQ ID NO: 8246 - protein, 687 aa, Sorghum bicolor
MSSAVKDQLQQMSTTCDSLLLELNVIWDEVGEPDMARDRMLLELEQECLDVYRRKVDQANRCRAQLRQAIAEAEAELAGICSAMGEPPIHVRQSNKKLHGLREELNAIVPYLEEMRKKKVERWDQFLDVIEQIKKVASEIRPADFVPFRIPVDQSDLSLRKLEELTKELQSLQKEKSDRLKQVMEHLNTLHSLCEVLGVDFKQTVYEVHPSLGETDGSKNLSNSTIESLASAVNRLRELKVQRMQKLQDLASSMLELWNLMDTPLEEQQMFQNVTCNIAASEHEITEPNTLSTDFLSYVESEVLRLEQLKASKMKDLVLKKKTELEEHRRRAHLIGEEGYAAEFSDEAIEAGAVDPALVLEQIEAHIATVKEEAFSRKDILEKVERWLNACEEEAWLEDYNKDDNRYNAGRGAHLTLKRAEKARILVNKIPGLVDVLTTKIVAWETERGKEFTYDGVRLLSMLEEYMIVRQEKELEKKRQRDQKKIQDQLKAEQEALYGSKPSPSKPQSTKKAPRHSMGGANRRLSLGGPTTHAPKTDIMHSKTARAAKKAEDLGALSPSSRGLDIAGLPVKKLCFNASTLREAETPRKPFAQIMPGNNVSSIPARPISNDTEEENKTPKTFAGLNPKTPATVTAPMQMAATPAVANKVVATPETLFQKAELPALPADIEYSFEERRLALYVARQVA

SEQ ID NO: 8247 - protein, 706 aa, Zea mays
MSSAVKDQLQQMSTTYDSLLLELNMIWDEVGEPDMARDRMLLELEQEWLDVYRRKVDQANRCRAQLRQAIADAEAELAGICSAMSEPPIHVRQSNQKLHGLREELNAIVPYLEEMRKKKVERWDQFVDVIEQIKKVASEIRPSDFVPFIIPVDQSDLSLRKLDELTKELQSLQKEKSDRLKQVMEHLSTLHLLCEVLGVDFKQTVYEVHPSLGEADGSKNLSNSTIERLASAVNRLRELKVQRMQKLQDLASSMLELWNLMDTPLEEQQMFQNLTCNIAASEHEITGPNTLSTDFLSYVESEVLRLEQLKASKMKDLVLKKKTELEDHRRRAHLIGEEGYAAEFSDEAIEAGAVDPALVLEQIEAHIATVKEEAFSRKDILEKVERWLNACEEEAWLEDYNKDDNRYNAGRGAHLTLKRAEKARILVNKIPGLVDVLTTKIVAWETERGKEFTYDGVRLRSMLEDYIIIRQEKELEKKRQRDQKKIQDQLKAEQEALYGSKPSPSKTQSTKKVPRQSMGGANRRLSLGGATTQAPKTDIMHSKTARAAKKAEDLGALSPSSRGLDIAGLPIKKLSFNASTLREAETPRKPFAQIMPGNNVSSMPARPISNDTEEENKTPKTFAGLNPKTPVTVTAPMQLAVTPAVANKVIATPATLFQEKAESPALPGDIEYSFEERRLAVYLARQVAFFVHSPSPSCANTQLLLS

SEQ ID NO: 8248 - protein, 688 aa, Echinochloa colona
MSSTVKEQLQQMSTTCDSLLLELNVIWDEVGEPHTARDRMLLELEQECLEVYRRKVDLANRCRAQLRQSIAEAEAELAGICSAMGEPPIHVRQSNQKLHGLREELNAIVPYLEEMRKKKVERWDQFVDVMDQIKKVASEIRPADFVPFKVPVDQSDLSLRKLEELSKELQSLQKEKSDRLKQVMEHLSTLHSLCEVLGIDFKQTVYEVHPSLGEPDGSKNLSNSTIERLASAVNGLREMKVQRMQKLQDLASSMLELWNLMDTPLEEQQMFQNVTCNIAASEQEITEPNTLSIDFLSYVESEVLRLEQLKASKMKDLVLKKKTELEEHRRRAHLIGEEGYAAEFSTEAIEAGAVDPALVLEQIEAHIATVKEEAFSRKDVLEKVERWLNACEEEAWLEDYNKDDNRYNAGRGAHLTLKRAEKARILVNKIPGMVDVLTTKILAWEKEREKEFTYDGVRLLSMLEEYMIVRQEKELEKKRQRDQKKIQDQLKAEQEALYGSKPSPSKPQSTKKVPRNSMGGANRRLSLGGATIQAPKTDILHSKTARAAKKTEDLGTLSPSSRGLDIAGLPIKKLTFNASTLREAETPRKPFAQIMPGNNVSSMPARPISKDTEEENKTPKTFTAFDPKTPMTDTAPMQLTMTPAVANKVIATPVSLFQEKLGHPALPEEIEYSFEERRLAVYLARQMA

SEQ ID NO: 8249 - protein, 688 aa, Echinochloa colona
MSSAVKEQLQQMSTTCDSLLLELNVIWDEVGEPHTARDRMLLELEQECLEVYRRKVDLANRCRAQLRQSIAEAEAELAGICSAMGEPPIHVRQSNQKLHGLREELNAIVPYLEEMRKKKVERWDQFVDVMDQIKKVASEIRPADFVPFKVPVDQSDLSLRKLEELSKELQSLQKEKSDRLKQVMEHLSTLHSLCEVLGIDFKQTVYEVHPSLGEPDGSKNLSNSTIERLASAVNGLREMKVQRMQKLQDLASSMLELWNLMDTPLEEQQMFQNVTCNIAASEQEITEPNTLSIDFLSYVESEVLRLEQLKASKMKYLVLKKKTGLEEHRRRAHLIGEEGYAAEFSTEAIEAGAVDPALVLEQIEAHIATVKEEAFSRKDVLEKVERWLNACEEEAWLEDYNKDDNRYNAGRGAHLTLKRAEKARILVNKIPGMVDVLTTKILAWEKEREKEFTYDGVRLLSMLEEYMIVRQEKELEKKRQRDQKKIQDQLKAEQEALYGSKPSPSKPQSTKKVPRNSMGGANRRLSLGGATIQAPKTDILHSKTARAAKKTEDLGTLSPISRGLDIAGLPIKKLSFNASTLREAETPRKPFAQIMPGNNVSSMPARPISKDSEEENKTPKTFTVFDPKTPMTDTAPMQLTMTPAVANKVIATPVSLFQEKLGHPALPEEIEYSFEERRLAVYLARQMA

SEQ ID NO: 8250 - protein, 690 aa, Setaria italica
MSSAVKEQLQQMSTTCDSLLLELNVIWDEVGEPHSARDRMLLELEQECLEVYRRKVDMANRCRAQLRQAIAEAEAELAGICSAMGEPPIHVRQSNQKLQGLREELNAIVPYLEEMRKKKVERWDQFVDVIDQIKKVASEIRPADFVPFKFPVDQSDLSVRKLEELTKELQSLQKEKSDRLKQVMEHLNTLHSLCEVLGIDFKQTVHDVHPSLGEADGSKNLSNSTIERLASAVNGLREMKVQRMQKLQDLASSMLELWNLMDTPLEEQQMFQNVTCNIAASEHEITEPNTLSVDYLSYVESEVLRLEQLKASKMKDLVLKKKTELEEHRRRAHLIGEEGYAAEFSTEAIEAGAVDPALVLEQIEAHIATVKEEAFSRKDILEKVERWLNACEEEAWLEDYNKDDNRYNAGRGAHLTLKRAEKARILVNKIPGMVDVLTTKILAWQKEREKEFTYDGVRLLSMLEEYMIVRQEKELEKKRQRDQKKIQDQIKAEQEALYGSKPSPSKPQSTKKVPRNSMGGANRRLSLGGATMQAPKTDILHSKTARAAKKTEELGTLSPSSRGLDIAGLPIKKLTFNASTLRETETPRKPFAQIMPGNNVSSTPARPTFNDNTEEENKTPKTFNAALDLKTPMTVTAPMQLAMTPSVGNKVIATPVSLFQEKPEQPMLPEEIEYSFEERRLAVYLARQMA

SEQ ID NO: 8251 - protein, 687 aa, Panicum virgatum
MSSAVKDQLQQMSTTCDSLLLELNVIWDEVGEPHSARDRMLLELEQECLEVYRRKVDLANRCRAQLRQAIAEAEAELAGICSAMGEPPVHVRQSNQKLHGLREELNAIVPYLEEMRQKKVERWDQFVDVMDQIKKVASEIRPADFVPFKVPVDQSDLSLRKLEELTKELQSLQKEKSERLKQVMEHLNILHSLCEVLGIDFKQTLYEVHPSLGEADGSKNLSNSTIERLASAVNGLREMKVQRMQKLQDLASSMLELWNLMDTPLEEQQMFQNITCNIAASEHEITEPNTLSIDFLSYVESEVLRLEQLKASKMKDLVLKKKTELEEHRRRAHLIGEEGYAAEFSTEAIEAGAVDPALVLEQIESHIATVKEEAFSRKDILEKVERWLNACEEEAWLEDYNKDDNRYNAGRGAHLTLKRAEKARILVNKIPGMVDVLTTKIHAWEKEREKEFTYDGVRLLSMLEEYMIVRQEKELEKKRQRDQKKIQDQIKAEQEALYGSKPSPSKPQSTKKAPRNSIGGANRRQSLGGATMQAPKTDILHSKTARAAKKTEDLGSLSPSSRGLDIAGLPVKKLTFNASTLREVETPRKPFSQIMPGNNVPSTPARPISNDEEENKTPKTFATLNHKTPVTMTAPMQVAMTPAVANKVIATPVSLFQEKPEQPMLPEEIEYSFEERRLAVYLARQVT

SEQ ID NO: 8252 - protein, 689 aa, Oryza sativa
MSSAVKDQLHQMSTTCDSLLLELNVIWDEVGEPDTTRDRMLLELEQECLEVYRRKVDQANRSRAQLRKAIAEGEAELAGICSAMGEPPVHVRQSNQKLHGLREELNAIVPYLEEMKKKKVERWNQFVHVIEQIKKISSEIRPADFVPFKVPVDQSDLSLRKLDELTKDLESLQKEKSDRLKQVIEHLNSLHSLCEVLGIDFKQTVYEVHPSLDEAEGSKNLSNTTIERLAAAANRLREMKIQRMQKLQDFASSMLELWNLMDTPLEEQQMFQNITCNIAASEQEITEPNTLSTDFLNYVESEVLRLEQLKASKMKDLVLKKKAELEEHRRRAHLVGEEGYAEEFSIEAIEAGAIDPSLVLEQIEAHIATVKEEAFSRKDILEKVERWQNACEEEAWLEDYNKDDNRYNAGRGAHLTLKRAEKARTLVNKIPGMVDVLRTKIAAWKNERGKEDFTYDGVSLSSMLDEYMFVRQEKEQEKKRQRDQKKLQDQLKAEQEALYGSKPSPSKPLSTKKAPRHSMGGANRRLSLGGATMQPPKTDILHSKSVRAAKKTEEIGTLSPSSRGLDIAGLPIKKLSFNASTLRETETPRKPFAQITPGNSVSSTPVRPITNNTEDDENRTPKTFTALNPKTPMTVTAPMQMAMTPSLANKVSATPVSLVYDKPEVTLQEDIDYSFEERRLAIYLARQMV

SEQ ID NO: 8253 - protein, 688 aa, Brachypodium distachyon
MGSAAKDQLLPCDKLLLELKVIWDEVGEPDTARDKTLLELEQECLDVYRRKVDQANRCRAQLRQSIAEAEAELAGICSAIGEPPVHVRQSNQKLHGLREELNAIVPYLEEMKTKKVERWNQFVHVIEEIKKISSEIRPSDFLPFKKPVDQSDLSLRKLEELTKELESLQKEKSDRVKQVMEHLNTLHSLCEVLGIDFKQTIHEVHPSLDEADGSKNLSNTTIDRLASAVNRLREMKIQRMQKLQDFASTMLELWNLMDTPIEEQQMFQNVTCNIAASEHEITEPNILSIDFLGYVESEVIRLEQLKGSKMKDLVLKKKSELEEHRRRAHLIGEEGYSDEFNIEAIESGAIDPALVLEQIEAHIATVKDEAFSRKDILEKVERFLNACEEEAWLEDYNKDDNRYNAGRGAHLTLKRAEKARILVNKIPGMVDVLSSKIIAWENERGKEFTYDGVRLISMLDEYMIVRQEKEQEKKRQRDQKKVQDQLKAEQEALYGSKPSPSKPQSTKKAPRNSIGGANRRLSVGGAPFQVPKTDILHSKTVRAAKRTEDIATLSPGSRGIDIADLPIKKLSFNASALRETETPRKPFAQIMPASSVPSTPVRPITNDMEDENRTPNPKTFGALNPKTPMTVAAPMQLAMTPAVGNKVAATPVSLVYEKPELALPEEIEYSFEERRLAAYLAREKLLSC

SEQ ID NO: 8254 - protein, 689 aa, Hordeum vulgare
MGGAVKDQQQQLHPCDSLLLELNVIWDEVGEPDSVRDKTLLELEQECLDVYRRKVDQANRCRAQLRQSIAEAEAELAGICSAIGEPPVHIRQSNQNLHGLREELNAIIPYLEEMRTKKVERWNQFVRVLEEIKKISSEIRPADFVPFKTPVDQSDLSLRKFEELTKELESLQKEKRERLQQVMDHLNTLHSICEVLGIDFKQTVHEVHPSLDEAEGSKNLSNTTIERLASAVNRLREIKIQRMQKLQDFASTMLELWNLMDTPIEEQQMFQNVTCNIAASEHEITEPNTLSIDFLSYVEAEVLRLEQLKGSKMKDLVLKKKSELEEHRRRAHLIGEDGYSDEFNIEAIESGAIDPALVLEQLEAHIATVKDEAFSRKDILEKVERFLNACEEEAWLEDYNKDDNRYNAGKGAHLTLKRAEKARILVNKIPGMVDVLTTKIIAWENERGKEFTYDGVRLLSTLDEYMIVRQEKEQEKKRQRDQKKLHDQLKAEQEALYGSKPSPSKPQSIKKAPRHSMGGVNRRVSIGGATMQAPKTDILHSKNVRAAKRTEDIAHLSPASRGLDIGDLPIKKLSFNATALRETETPRKPFAQIMPPASSVPSTPARSVTNDTEDENRTPNPKTYGAALNLKTPTVAAPMQLAMTPTVANKVTAAPVSLVYEKPEPALPEAVEYSFEEKRLAVYLSREVV

SEQ ID NO: 8255 - protein, 507 aa, Sorghum bicolor
MRGGTLQINWHDQQPVLSLDFHPASRRLATAGADHDIKIWEVASDGSDDKLPTATFKYALVPNNTAHSSAVNVLRFSPSGEYLASGADGGGIILWKLHPADDGEAWKIHKTLLFHHKDVLDLQWSHDSAFLVSASVDNTCIIWEASKGTVHQKIEGHLHYVQGVAWDPLGQYIASLSSDRTCKIYANKPQGKSKNAERLNFVCQHTLVKIEYQNHDESKPPIKSHLFHDETLPSFFRRLAWSPDGSFLVLPAGLSKHSSEVINTAYIMSRRDLSRPAIQLPGASKAIVAVRFCPVLFKPRGSNPDGLFKLPYRVVFAVATLNSLYVYDTESVPPILVHAGLHYAAITDIAWSSDAKYLAASSRDGYCTIIEFENEELGELHILPGSKEVAKGNLTPETKKPVSADSMKVDISASTLKMEASPVAVGVRAPLLPTENITRTGELAEGNVTCENKKPVTVDSMEVDVDDNKVKEATIPVVAEVTPPPVPTKNSASSKPAKRRITPIAIN

SEQ ID NO: 8256 - protein, 505 aa, Setaria italica
MRGGTVQINWHDLQPVLSLDFHPASRRLATAGADHDVKIWVISSDGSESKLPTATFQSGLVPNGTAHSSAVNVLRFSPSGEYLASGADGGGIILWKLYSTEDGEAWKIHKTLLFHHKDVLDLQWSRDSAFLASASVDNTCIIWDAVKGTVQQKLEGHLHYVQGVAWDPLGQYIASLSSDRTCKIYANKPQGKSKNAEKVNFVCQHTLVKIEYPNHDESKPPVKSHLFHDETLPSFFRRLAWSPDGSFLVLPAGLSKHSSEVINTAYVMSRRDLSRPAIQLPGASKAIVAVRFCPVLFRPRGSNSDGFFKLPYRVVFAVATLNSVYVYDTESVPPILIHAGLHYAAITDIAWSFDAKYLAVSSRDGYCTIIEFENEELGQPHILPGSKEVAKGNMTCEKKPLPVDSMEVDVSASKLKMEVNPVAAGVTVPPMLAENVTLRTGELAEGNVTCENKKPVAVDIMEVDVSDKVKTVTSPVAIEVTPPPVSTKNNASSKPTKKRITPIAI

SEQ ID NO: 8257 - protein, 59 aa, Saccharum officinarum
MASIAGSSALSFARPVKAINTNSLAFSTARKGNAFLRLQPMTMRSASCADKKDTVGHAP

SEQ ID NO: 8258 - protein, 113 aa, Triticum aestivum
MASIAGSSALSFARPVKAINTNSLAFSPARKGNTFLRLQPMPMRSVSCAAKKDTTDKVCEIVKKQLLFLTILKFAVNRNSLNSVQIHWDTVEIVMSLEEHFDISVEESSAQTI

SEQ ID NO: 8259 - protein, 132 aa, Setaria italica
MASIAGSALSFARPVKAVNTSSLSFSAARKGNAFLRLHSVPKRFAVCYAAKKDTVDKVCEIVKKQLAVPEGTEVCGASKFSDLGADSLDTVEIVMGLEEEFDISVEESSAQSIATVEDAAELIDKLVAEKSP

SEQ ID NO: 8260 - protein, 132 aa, Pennisetum glaucum
MASIAGSALSFARPVKAVNTSSLSFSAARKGNAFLRLHSVPKRFAVCYAAKKDTVDKVCEIVKKQLAVPEGTEVCGDSKFSDLGADSLDTVEIVMGLEEEFDISVEESSAQSIATVEDAAELIDKLVAAKSP

SEQ ID NO: 8261 - protein, 878 aa, Sorghum bicolor
MVTEMAARGGEAAAFGASEADRGDFEVFRSGSAPPTVEGALGAAAAAAAGGLLVDDELRSDPAYQSYYYSNAHLNPRLPPPLLSKEDWRSSHHRLRSSAGFGGIGDGRRQQQQQASAAEGTVGLPGIDLGRQRSFSSVFQEDSYQRDMDRQTASHNTNDLLGSSGIQYGLNRGPGTIGGLHSSNSLRSLDEFQNTDLPSNTFASILGSSLSRSASPDPELVRRAPSPSLPPIGVKVSNTDKKINGGSSSFRRSSSAIGESDDLVAALSGMNLSSRAMSGQTMDQSQLYQDVDNVQKFLFDRQGDQTNGNQQHYMRRPEHGQSKLPDGYSSNLVNSSTMRNQINAGSFTSFDSLSLGSGFASPRIGSRSPGGTVSSRQNLAGMSNMLNYNGIGSPTASPSLQTSIDPAYIQYLAQLAATCDDPLMDRGHLGNSYMDLLGTQKANLGPLLQSQKQYGYYGNLGFNLGYAGSPLTSPVLPSSPIAPGSPLRHGERNMRFPSGMRNFGNSFGSWNSGMGGKMDANLMPSLLEEFKSNKSKSYELSEIAGHVVEFSADQYGSRFIQQKLETASTEEKDMVFSEIMPQALTLMTDVFGNYVVQKFFEHGSTAQIKELAGQLIGRVLALSLQMYGCRVIQKAIEVVDLDLQTKMVAELEGHVMRCVRDQNGNHVIQKCIECIPQHAIEFIVSTFYGQVVMLSTHPYGCRVIQRVLEHCDDPKTQQIMMDEILQSVCLLAQDQYGNYVVQHVLEHGKPHERSAIIEKLIGQIVQMSQQKFASNVIEKCLAFGNPVERQVLIGEMLGSTSESEPLEVMMKDQFANYVVQKVLETCDDQQREMILTRIKTHLNTLKKYTYGKHIVARVEKLVAAGEKRLGLQPACTAA

SEQ ID NO: 8262 - protein, 871 aa, Zea mays
MVTEMAARGGEAAAFGAEADRGDFEVFRSGSAPPTVEGALGAAAAAADLLVDDDLRADPAYQSYYYSNAHLNPRLPPPLLSKEDWRSSHHRLRSAAFGGIGDGRRQQQPAAQGTVGLPGIDLARQRSFSTVFQEDSYQRDMDRQTASHNSSESLCSSGIQYGLNRGPGTIGGLHSSNSLRSLDEIPNNDLPSNTFASLLGSSLSRSASPDPELVRRAPSPSLPPIGVKVGNTDKMNGGSSSFRRSSSAIGGSDDLVAALSGMNLSSRAMSGQTMDQSQLYQDVDNVQKFLFDRQGDQPNGNQQHYMRRPEHGQSKLSDGYSANLANSSTMRNQINSGSFTSFDSLSLGSGFPSPRIGSRSPGGTVSSRQNLAGMSNMLNYNGIGSPTASPSLQTSIDPAYIQYLAQIAATWDDPLMDRSHLGSSYMDLLGTQKANLGPLLQSQKQYGYCGNLGFNLGGYAGSPLASPVLPSSPIAPGSPLRHGDRNMRFPSGMRNFGNSFGSWNSGMSGKMDANLMPSLLEEFKSNKSKSYELSEIAGHVVEFSADQYGSRFIQQKLETASTEEKDMVFSEIMPQALTLMTDVFGNYVVQKFFEHGSTAQIKELAGQLIGRVLALSLQMYGCRVIQKAIEVVDLDLQTKMVAELEGHVMRCVRDQNGNHVIQKCIECIPQHAIEFIVSTFYGQVVMLSTHPYGCRVIQRVLEHCDDPKTQQIMMDEILQSVCLLAQDQYGNYVVQHVLEHGKPHERSAIIEKLIGQVVQMSQQKFASNVIEKCLAFGNPVERQVLIGEMLGSTSESEPLEVMMKDQFANYVVQKVLETCDDQQREMILTRIKTHLNTLKKYTYGKHIVARVEKLVAAGEKRLGLQPACTAA

SEQ ID NO: 8263 - protein, 871 aa, Setaria italica
MVTEMAARGGEAFGAEADRDFEVFRSGSAPPTVEGAMGAAAAAGSLFLDDDLRADPAYQSYYYSNAHLNPRLPPPLLSKEDWRSSHHRLRSSGLGGIGDGRRQQQPAAAAEGTVGLPGIDLGRHRSFSNVFQDDSYQRDMDRQTANHSSNDLLGSSGIQYGLHRGSGAMGGLHSSNNSRGLDEIQNNDLSSNTYASILGSSLSRSASPDPELVRRAPSPSLPPIGVKVGANDKKINGGSSSFRRSSSAIGESDDLVAALSGMSLSSRAMSGQTMDQSQLYQDVDNVQKFLFDRQGDQSNGNQQHSYMRRPEHGQSKVPDGYSPNLANSSTMRNQINAGSFTSFDNLSLGSGFASPRIGSRSPGGTISSRQNLAGMSNMLNYSGIGSPTASPSLQTPIDPAYIQYLAQLAASCDDPLMDRGHLGNSYMDLLGPQKANLGPLLQSQKQYGYYGNLGFNLGYAGSPLTSPVLPSSPIAPGSPLRHGDRSMRFPSGMRNFGGSFGSWNSGMGGKMDANLMPSLLEEFKSNKSKSYELSEIAGHVVEFSADQYGSRFIQQKLETASTEEKDMVFSEIMPQALTLMTDVFGNYVVQKFFEHGSTAQIKELAGQLIGRVLALSLQMYGCRVIQKAIEVVDLDLQTKMVAELEGHVMRCVRDQNGNHVIQKCIECIPQHAIEFIVSTFYGQVVMLSTHPYGCRVIQRVLEHCDDPKTQQIMMDEILQSVCLLAQDQYGNYVVQHVLEHGKPHERSAIIEKLIGQIVQMSQQKFASNVIEKCLAFGNPVERQVLIGEMLGSTSESEPLEVMMKDQFANYVVQKVLETCDDQQREMILTRIKTHLNTLKKYTYGKHIVARVEKLVAAGEKRLGLQPACTAA

SEQ ID NO: 8264 - protein, 871 aa, Panicum virgatum
MVTEMAARGGEAFGAEADRDFEVFRSGSAPPTVEGAMGAAAAAGSLFLDDELRADPAYQSYYYSNAHLNPRLPPPLLSKEDWRSSHHRLRSSGLGGIGDGRRQQPQAAAAEGTAGLPGIDLGRQRSFSNVFQEDSYQRDMDRQTANHNSNDLLGSSGIQYGLHRGPGAMGGLHSSNNSRGLDEIQNNDLSSNTYASILGSSLSRSASPDPELVRRAPSPSLPPIGVKVSANDKKINGGSSSFRRSSSAIGEPDDLVAALSGMSLSSRAMSGQTMDQSQLYQDVDNVQKFLFDRQGDQANGNQQHSYMRRPEHGQSKVPDSYSANLANSSTMRNQINAGSFTSFDNLSLGSGFASPRIGSRSPGGTVSSRQNLAGMSNMLNYSGIGSPTASPSLQTPIDPAYIQYLAQLAATCDDPLMDRGHLGNSYMDLLGPQKANLGPLLQSQKQYGYYGNLGFNLGYGGSPLTSPVLPSSPIAPGSPLRHGDRNMRFPSGMRNFGSSFGSWNSGMSGKMDANLMPSLLEEFKSNKSKSYELLEIAGHVVEFSADQYGSRFIQQKLETASTEEKDMVFSEIMPQALTLMTDVFGNYVVQKFFEHGSTAQIKELAGQLIGRVLALSLQMYGCRVIQKAIEVVDLDLQTKMVAELEGHVMRCVRDQNGNHVIQKCIECIPQHAIEFIVSTFYGQVVMLSTHPYGCRVIQRVLEHCDDPKTQQIMMDEILQSVCLLAQDQYGNYVVQHVLEHGKPHERSAIIEKLIGQIVQMSQQKFASNVIEKCLAFGNPVERQVLIGEMLGSTSESEPLEVMMKDQFANYVVQKVLETCDDQQREMILTRIKTHLNTLKKYTYGKHIVARVEKLVAAGEKRLGLQPACTAA

SEQ ID NO: 8265 - protein, 871 aa, Panicum virgatum
MVTEMAARGGEAFGAEADRDFEVFRSGSAPPTVEGAMGAATAAGSLFLDDEVRADPAYQSYYYSNAHLNPRLPPPLLSKEDWRSSHHRLRSSGLGGIGDGRRQQPQAAAAEGTVGLPGIDLGRQRSFSNVFQEDSYQRDMDRQTANHNSNDLLGSSGIQYGLHRGPGAMGGLHSSNNSRGLDEIQNNDLSSNTYASILGSPLSRSASPDPELVRRAPSPSLPPIGVKVSANDKKINGGSSSFRRSSSAIGEPDDLMAALSGMSLSSRTMSGQTMDQSQLYQDVDNVKKFLFDRQGDQANGNQQHSYMRRPEHGQSKVPDGYSANLANSSTMRNQINAGSFTSFDNLSLGSGFASPGIGSSSPGGTVSSRQNLAGMSNMLNYSGIGSPTASPSLQTPIDPAYIQYLAQLAATCDDPLMDRGHVGNSYMDLLGPQKANLGPLLQSQKQYGYYGNLGFNLGYGGSPLTSPVLPSSPIAPGSPLRHGDRNMRFPSGMRNFGSSFGSWNSGMGGKMDANLMPSLLEEFKSNKSKSYELSEIAGHVVEFSADQYGSRFIQQKLETASTEEKDMVFSEIMPQALTLMTDVFGNYVVQKFFEHGSTAQIKELAGQLIGRVLALSLQMYGCRVIQKAIEVVDLDLQTKMVAELEGHVMRCVRDQNGNHVIQKCIECIPQHAIEFIVSTFYGQVVMLSTHPYGCRVIQRVLEHCDDPKTQQIMMDEILQSVCLLAQDQYGNYVVQHVLEHGKPHERSAIIEKLIGQIVQMSQQKFASNVIEKCLAFGNPVERQVLIGEMLGSTSESEPLEVMMKDQFANYVVQKVLETCDDQQREMILTRIKTHLNTLKKYTYGKHIVARVEKLVAAGEKRLGLQPACTAA

SEQ ID NO: 8266 - protein, 882 aa, Oryza sativa
MVTEMATRGEAAAAAAADRDMELFRSGSAPPTVEGAMASAAAAAGDVFLDDELRADPVYQSYYYSNAHLNPRLPPPLLSKEDWRSAQHRLRSSALGGIGDGRRQPAAAAQGDGLVGLPGIDLDRQGSFSSIFQESSYQLDMGKQGADRNSSDFLDSSRPQYALHRETSRAMGGLQSDSNIQSLAEVQNNDSSAHTYASLLGSSLSRSASPDPELVRRVPSPCLPPIGVKVSADDKKNNGGSSSFRRSSSAIGESDNLIAALSGMNLSSSGAASGQQTVTQSELYQDVDNVRKFLFDRQGDQSNGNQQHSYMKHPEQGHFKAPDGYSANSPNSSMIRNQINAASFTSFDNLSAGSGFASPRIGSRSPGGTLSSRQNLVGGSNFLNYNGIGSPNAATSLQTAIDPSYIQYLQAAEIAAQLAASCDDPLMASGHLGSSYMDLLGPQKAYASPLLQSQKNCGYYGNLGFGLGYSGSPLMSPVLPSSPAAPGSPLRHGERSMRMQSGIRNFGGSFGSWNPDLGGKMNINMMPSLLEEFKSNKSKSYELSEIAGHVVEFSADQYGSRFIQQKLETASTEEKDMVFSEIMPQALTLMTDVFGNYVVQKFFEHGSPTQIKELADQLIGRVLALSLQMYGCRVIQKAIEVVGLDQQTKMVAELDGHVMRCVRDQNGNHVIQKCIECIPQHAIQFIVSTFYGQVVMLSTHPYGCRVIQRVLEHCDDPTTQQIMMDEILQSVCLLAQDQYGNYVVQHVLEHGKPHERSAIIEKLIGQIVQMSQQKFASNVIEKCLAFGNPVERQILIGEMLGSTNESEHLEVMMKDQFANYVVQKVLETCDDQQREAILTRIKAHLNTLKKYTYGKHIVARVEKLVAAGEKRLGLQPACTSAA

SEQ ID NO: 8267 - protein, 244 aa, Trifolium pratense
MASSENSVESKSSLTKLAPLEAVLFDIDGTLCDSDPLHYYAFREMLQEIGFNGGNPITEEFFIATVAGKHNDDIAADLFPGDRERGLKFVDDKEAMFRRLAAEQLKPLNGLAKVRKWIEDRGLKRAAVTNAPRPNAELMLSILGLTDFFEAVIIGGECEHAKPHPEPYLKGLEALKASKDHTFIFEDSVSGIKAGVAAGMPVIGISTRNPEDLLMGAKPAFLIKDYDDPKLWAALEELDKSGSH

SEQ ID NO: 8268 - protein, 244 aa, Trigonella foenum-graecum
MASSENSIDSKNSLIKLAPIEAVLFDIDGTLCDSDPLHYYAFREMLQEVGFNGGNPITEEFFIATVAGKHNDDIALDLFPGDREQGLKFLVDKEAMFRRLAAEQLKPLNGLDKVRKWIEDRGLKRAAVTNAPRPNAELILSKLGLSDFFEAVIIGDECEHAKPHPEPYLKGLEALKASKDHTFIFEDSVSGIKAGVAAGMPVIGISTRNPEDLLMGAKPAFLIKDYDDPKLWAALEELDKSGSH

SEQ ID NO: 8269 - protein, 244 aa, Trifolium pratense
MASSENCVERKSSLTKLAPLEAVLFDIDGTLCDSDPLHYYAFREMLQEIGFNGGNPITEEFFIATVAGKHNDDIAKDLFPGDLERGLKFVDDKEAMFRRLAAEQLKPLNGLAKVRKWIEDRGLKRAAVTNAPRPNAELMLSILGLTDFFEAVIIGGECEHAKPHPEPYLKGLEALKASKDHTFIFEDSVSGIKAGVAAGMLVIGISIRNLEDLLMGAKPAFLIKDYDDPKLWAALEELDKSGSH

SEQ ID NO: 8270 - protein, 244 aa, Cicer arietinum
MASSENGVDSKSSLTRLVPLEAVLFDIDGTLCDSDPLHYYAFREMLQEIGFNGGTPITEEFFIATVAGKHNNDIALALFPGDLERGLKFLDDKEAMFRRLASEQLKPLNGLEKVRKWVESRGLKRAAVTNAPRPNAELALSKLGLSDFFDAVIIGDECEHAKPHPDPYLKGLEALKASKDHTFVFEDSVSGIKAGVAAGMPVIGISTRNPEDLLMGAKPAFLIKDYDDPKLWAALEELDKSSSH

SEQ ID NO: 8271 - protein, 200 aa, Trifolium pratense
MLQEIGFNGGNPITEEFFIATVAGKHNDDIAKDLFPGDLERGLKFVDDKEAMFRRLAAEQLKPLNGHDKVRKWIEDRGLKRAAVTNAPRANAELMLSILGLTDFFEAVIIGGECEHAKPHPEPYLKGLEALKASKDHTFIFEDSVSGIKAGVAAGMPVIGISTRNPEDLLMEAKPAFLIKDYDDPKLWAALEELDKSGSN

SEQ ID NO: 8272 - protein, 245 aa, Lotus japonicus
MTASSANRVESQSSLTRLAPLEAVLFDIDGTLCDSDPLHYYAFREMLQEIGFNGGVPITEEFFIETVAGKHNDDIAAALFPGDLERGLKFVDDKEAMFRRLAAEQVKPLNGLDKVRKWIEDRGLKRAAVTNAPRANAELMLSILGLTDFFEAVIIGGECEHAKPHPEPYLKGLEALKASKDHTFVFEDSVSGIKAGVAAGMPVIGIATRNPEDLLMEAKPAFLIKDYADPKLWAALEELDKTNAS

SEQ ID NO: 8273 - protein, 247 aa, Cajanus cajan
MTASSENCISSQSSLTKLAPLEAVLFDIDGTLCDSDPLHYYAFREMLLEIGFNGGVPIDEEFFIETVAGKHNDDIALALFPGDLERGLKFVDDKEAMFRRLAAEQLKPLNGLDKVKKWIENHGLKRAAVTNAPRANAELMISLLGLSDFFEAIIIGGECEHAKPHPDPYLKGLEALKASKDHTFVFEDSVSGIKAGVAAGMPVIGLATRNPESLLMEAKPAFLIKDYDDPKLWAALEELDKAGAPSV

SEQ ID NO: 8274 - protein, 244 aa, Lotus japonicus
RASSENCVESKNFLTKLAPLEAVLFDIDGTLCDSDPLHYDALREMLQEIGFNGGIPITEEFFIKNFAGKHSNDTALFVFPGDLERGLKFVEEKEAMFRRLAAEQLKPLSGLDKVMKWIENHGLKRAAVTNAPRENAELIISKLGLSYFFDAVILGDECEHAKPHPEPYLKGLEALKASKNHTFVFEDSVSGIKAGVAAGMPVIGLATRNPEDLLMEAKPAFLIKDYDDPKLWAALEELDNAGTS

SEQ ID NO: 8275 - protein, 249 aa, Glycine max
MTVSSENCVSSQSSLTRLAPLEAVLFDIDGTLCDSDPLHYYAFREMLLEIGFNEGVPITEEFFIETVAGKHNDDIASVLFPGDLERGLKFVDDKEAMFRRLAAEQVKPLNGLDKVRKWIENHGLKRAAVTNAPRANAELMISILGLSDFFDAVIIGGECERAKPHPDPYLKGLEALKASKDHTFVFEDSVSGIKAGVAAGMPVIGIATRNPENLLMEAKPAFLIKDYEDPKLWAALEELDKAGAFSLNY

SEQ ID NO: 8276 - protein, 247 aa, Phaseolus vulgaris
MTASSDCISSQSSLTRLAPLEAVLFDIDGTLSDSDPLHYHAFREMLLEIGFNGGAPITEEFFIETVAGKHNDDIALALFPDDLPRGLKFVEDKEAMFRKLAAEQLKPLNGLDKVRKWIENRGLKRAAVTNAPRENAELMISVLGLSDFFEAVIIGGECEHAKPHPDPYLKGLEALKASKDHTFVFEDSFSGIKAGVAAGMPVIGLATRNPENLLMEAKPAFLIKDYDDAKLWAALEELDKASSTLSV

SEQ ID NO: 8277 - protein, 249 aa, Lupinus angustifolius
IHSTCCLLPSCCGSIKSSLTKLAPLEAVLFDIDGTLCDSDPFHYQAFRVMLQEIGFNGGVPITEEFFIATAAGKHNDDVALALFPDDIERGLKFLEDKEAMFRKLAAEQVKPLSGLDKVRKWIEDRGLKRAAVTNAPRPNAELLLSVLGLSDFFEAVIIGDECEHAKPHPDPYLKGLEALKASKDHTLVFEDSVSGIKAGVAAGMPVIGLATRNPEHLLMEAKPAFLIKDYEDPKLWAALEELDKAGAH

SEQ ID NO: 8278 - protein, 243 aa, Arachis hypogaea
MTVSSESKNSLTQLAPLEAVLFDIDGTLCDSDPLHYYAFREMLKEIGFNGGVPITEEFFIETVAGKHNDDIALALFPGDLERGLKFVDDKEDMFRKLAKEQVKPLNGLDKVREWIESHGLKRAAVTNAPRANAELMISLLGLSDFFHAVIIGGECEHAKPHPDPYLKGLEALKASKDHSFVFEDSVSGIKAGVAAGMPVVGLATRNPEHLLMEAKPAFLIKDYADPKLWEALEELDKAGTKKV

SEQ ID NO: 8279 - protein, 248 aa, Vigna unguiculata
MTASSENCNSSQSSLTKLAPLEAVLFDIDGTLCDSDPLHYLAFSEMLQQIGFNGGAPITEEFFIEIVAGKHNDDIARSLFPDDLPRGLKFVDDKEAMFRRLAADQLKPLNGLDKVRKWIEARGLKRAAVTNAPRANAELMISLLGLSDFFDAVIIGSECEHAKPHPDPYLKGLEALKASRDHSFVFEDSFSGIKAGVAAGMPVVGLATRNPENLLMEAKPAFLIKDYDDPKLWAALEELDKASSAPSV

SEQ ID NO: 8280 - protein, 234 aa, Cajanus cajan
MSSLTRLAPLEAVLFDVDGTLCDSDPLHYYALREMLQQIGFNGGAPITEEYFIETFSGKHSDDTALIVFPGDLERGLKFVEDKEDMFRRVAADQLNPLKGLDKVRKWVENHGLKRAAVTNAPRANAELMISKLGLLDFFDAVIIGDECEHAKPHPDPYLKALEVLKASKDHAFVFEDSVSGIKAGVAAGMPVIGLATRNPEHLLMEAKPAFLIKDYEDPKLWAALEELDKAGAR

SEQ ID NO: 8281 - protein, 295 aa, Trigonella foenum-graecum
MRMRKSLICWICFLVIGFVQISKSNGFYLPGSYMHTYANGDPIYAKVNSLTSIETELPFSYYSLPYCQPLGGIKKSAENLGELLMGDQIDNSPYLFKMNVNQSSYLCTTAPLNEHEVKLFKQRTRNLYQVNMILDNLPVMRFANQNGVKIQWTGFPIGYTPSDGSADYVINHLKFTVLVHEYEGNGVEIIGTGEEGMGVIAESDKKKESGFEIVGFHVVPCSVKRDPEVMTKLHMYDNISSTNCPNELEKYQPIREQERISFTYEVEFVKSDIRWPSRWDAYLKMEGSRCIGSRF

SEQ ID NO: 8282 - protein, 660 aa, Trifolium pratense
MELATMRMRNPLICWIFVVVAFVRISNAFYLPGSYMHTYSNGDSIFAKVNSLTSIETELPFSYYSLPYCQPLGGIKKSAENLGELLMGDQIDNSPYLFKMNVNQSTYLCTTPPLNEHEVKLLKQRTRDLYQVNMILDNLPVMRFASQNGVKIQWTGFPIGYTPSDGSADYIINHLKFTVLVHEYEGNGVEIIGTGEEGMGVIAESDKKKESGFEIVGFHVVPCSVKRDPEVMTKLHMYDNISSINCPSELDKYQPIKEQERISFTYEVEFVKSDIRWPSRWDAYLKMEGSRVHWFSILNSLMVIFFLAGIVFVIFLRTVRRDLARYEELDKETQAQMNEELSGWKLVVGDVFREPCCSNLLCVMVGDGVQILGMAAVTIVFAALGFMSPASRGMLLTGMIILYLFLGIASGYVSVRLSRTIKGTSEGWKSISWFAACFFPGIAFTILTALNFVLWGSNSTGALPISLFFELFFLWFCISVPLTLIGGFLGTKAEQIEYPVRTNQIPREIPARKYPSWLLVLGAGTLPFGTLFIELFFILSSIWLGRFYYVFGFLLVVLLLLTIVCAEVSVVLTYMHLCVEDWRWWWKAFYASGSVALYVFLYSINYLVFDLQSLSGPISAILYIGYSLLMAIAIMLSTGTIGFLVSFYFVHYLFSSVKID

SEQ ID NO: 8283 - protein, 662 aa, Trifolium pratense
MELATMRMRNPLIWWICIFVVVAFVRISNAFYLPGSYMHTYSNGDSIYAKVNSLTSIETELPFSYYSLPYCKPLGGIKKSAENLGELLMGDQIDNSPYLFKMNVNESSYLCTTPPLNEHEVKLLKQRSRDLYQVNMILDNLPVMRFASQNGVKIQWTGFPIGYTPSDGSVDYIINHLKFTVLVHEYEGNGVEIIGTGEEGMGVIAESDKKKESGFEIVGFHVVPCSVKRDPEVMTKLHMYDNISSINCPSELDKYQPIKEQERISFTYEVEFVKSDIRWPSRWDAYLKMEGSRVHWFSILNSLMVIFFLAGIVFVIFLRTVRRDLARYEELDKETQAQMNEELSGWKLVVGDVFREPCCSNLLCVMVGDGVQILGMAAVTIVFAALGFMSPASRGMLLTGMIILYLFLGIASGYVSVRLSRTIKGTSEGWKSISWFAACFFPGIAFSILTALNFVLWGSNSTGALPISLFFELFFLWFCISVPLTLIGGFLGTKAEQIEYPVRTNQIPREIPARKYPSWLLVLGAGTLPFGTLFIELFFILSSIWLGRFYYVFGFLLVVLLLLTIVCAEVSVVLTYMHLCVEDWRWWWKAFYASGSVALYVFLYSINYLVFDLQSLSGPISAILYIGYSLLMAIAIMLSTGTIGFLVSFYFVHYLFSSVKID

SEQ ID NO: 8284 - protein, 659 aa, Cicer arietinum
MRMRKPLIWWICLFFFVAFVQIQITNAFYLPGSYMHTYSNGDPIYAKVNSLTSIETELPFSYYSLPYCQPLGGIKKSAENLGELLMGDQIDNSPYLFRMNVNQSIYLCTTTSLKEHEVKLLKQRTRDLYQVNMILDNLPVMRFANQNGIKIQWTGYPIGYTPPDGNADYIINHLKFTVLVHEYEGNGVEIIGTGEEGMGVIAETDKNKASGYEIVGFHVVPCSVKRDPQVMTKLHMYDNISSINCPSELDKYQPIKEQERISFTYEVEFVKSDIRWPSRWDAYLKMEGARVHWFSILNSLMVIFFLAGIVFVIFLRTVRRDLARYEELDKETQAQMNEELSGWKLVVGDVFREPCCSKLLCVMVGDGVQILGMAGVTIIFAALGFMSPASRGMLLTGMILLYLFLGIASGYVSVRLWRTIKGTSEGWRSISWFAACFFPGIAFTILTALNFVLWGSNSTGALPISLYFELFFLWFCISVPLTLIGGFMGTKAEQIEYPVRTNQIPREIPARKYPSWLLVLGAGTLPFGTLFIELFFILSSIWLGRFYYVFGFLLVVLLLLTIVCAEVSVVLTYMHLCVEDWRWWWKAFYASGSVALYVFLYSINYLVFDLQSLSGPVSAVLYLGYSLLMAIAIMLSTGTIGFLVSFYFVHYLFSSVKID

SEQ ID NO: 8285 - protein, 661 aa, Cajanus cajan
MEVPTRRKPLIYWLCLSVIVNVFVQFSNAFYLPGSYMHTYSNGDQIYAKVNSLTSIETELPFGYYTLPYCQPLGGVKKSAENLGELLRGDQIDNSPYLFRMNVNQSIYLCTTNPLNEHEVKLLKHRTRDLYQVNMILDNLPVMRFANQNGVKIQWTGFPVGYTPPDGSADYIINHLKFTVLVHEYEGNGVEIIGTGEEGMGVISEADKKKVSGYEIVGFQVVPCSVKRDPEAMTKLHMYDNISVTNCPAELDKYQPIREQERISFTYEVEFVKSDIRWPSRWDAYLKMEGSRVHWFSILNSLMVIFFLAGIVFVIFLRTVRRDLTRYEELDKEAQAQMNEELSGWKLVVGDVFREPDHPKLLCVMVGDGVQILGMSAVTIVFAALGFMSPASRGMLLTGMIILYLFLGIAAGYVSVRLWRTIKGTSEGWRSISWSSACFFPGIAFIILTALNFLLWGSKSTGAIPISMYFELLFLWFCISVPLTLIGGFMGTKAPQIDYPVRTNQIPREIPARKYPSWLLVLGAGTLPFGTLFIELFFILSSIWLGRFYYVFGFLLVVLLLLVIVCAEVSVVLTYMHLCVEDWRWWWKSFFASGSVALYVFLYSINYLVFDLQSLSGPISAILYLGYSLLMAIAIMLSTGTIGFLMSFYFVHYLFSSVKID

SEQ ID NO: 8286 - protein, 661 aa, Glycine max
MEVPTRRKPVIYWICLFVIVNAFVQISNAFYLPGSYMHTYSNGDNIYAKVNSLTSIETELPYSYYSLPYCKPLGDIKKSAENLGELLRGDHIDSSPYLFRMNVNQSIYLCTSTALKENEVKLLKQRTRDLYQVNMILDNLPVMRFANQNGIKIQWTGFPVGYTPPDGSADYIINHLKFKVLVHEYEGNGVEIIGTGEEGMGVISEAEKKKVSGYEIVGFQVIPCSVKRDPEVMTKLHMYDNISSTNCPSELDKYQPIKEQERISFTYEVEFVKSDIRWPSRWDAYLKMEGSRVHWFSILNSLMVIFFLAGIVFVIFLRTVRRDLTRYEELDKEAQAQMNEELSGWKLVVGDVFREPDGSRLLCVMVGDGVQILGMAAVTIVFAALGFMSPASRGMLLTGMIILYLFLGIAAGYVSVRLWRTIKGTSEGWRSISWLSACFFPGIAFIILTGLNFLLWGSKSTGAIPISLYFELLFLWFCISVPLTLIGGFMGTKAQQIEYPVRTNQIPREIPARKYPSWLLVLGAGTLPFGTLFIELFFILSSIWLGRFYYVFGFLLVVLLLLVIVCAEVSVVLTYMHLCVEDWQWWWKSFFASGSVALYVFLYSINYLVFDLQSLSGPVSAILYLGYSLLMAIAIMLSTGTIGFLMSFYFVHYLFSSVKID

SEQ ID NO: 8287 - protein, 661 aa, Glycine max
MGVPTWRKPVIYWVCLFVIINAFVQISNAFYLPGSYMHTYSNGDPIYAKVNSLTSIETELPYSYYSLPYCKPLGKIKKSAENLGELLRGDQIHNSPYLFHMNVNQSIYLCITTALNENEVKLLKQRTRDLYQVNMILDNLPVMRFANQNGIKIQWTGFPVGYTPPDGSADYIINHLKFTVLVHEYEGNGVEIIGTGEEGMGVISEADKKKVSGYEIVGFQVTPCSVKRDPEVMTKLHMYDNIYSTNCPSELDKYQPIKEQERISFTYEVEFVKSDIRWPSRWDAYLKMEGSRVHWFSILNSLMVIFFLAGIVFVIFLRTVRRDLTRYEELDKEAQAQMNEELSGWKLVVGDVFREPDGSKLLCVMVGDGVQILGMAAVTIVFAALGFMSPASRGMLLTGMIILYLFLGIAAGYVSVRLWRTIKGTSEGWRSISWLSACFFPGIAFIILTGLNFLLWGSKSTGAIPISLYFELLFLWFCISVPLTLIGGFMGTKAQQIEYPVRTNQIPREIPARKYPSWLLVLGAGTLPFGTLFIELFFILSSIWLGRFYYVFGFLLVVLLLLVIVCAEVSVVLTYMHLCVEDWQWWWKSFFASGSVALYVFLYSINYLVFDLQSLSGPVSAILYLGYSLLMAIAIMLSTGTVGFLMSFYFVHYLFSSVKID

SEQ ID NO: 8288 - protein, 661 aa, Phaseolus vulgaris
MEVSTRRKPVIYCVCLFFIVNFFLQISDAFYLPGSYMHTYSNGDQIYAKVNSLTSIETELPYSYYSLPYCKPLGGIKKSAENLGELLRGDQIDNSAYLFRMNVNHSIYLCTTPPLTEVEVNLLKQRTRDLYQVNMILDNLPVMRFANQNGMKIQWTGFPVGYTPPDGTADYIINHLKFKVLVHEYEGNGVEIIGTGEEGMGVISEADKKKVSGYEIVGFQVIPCSVKRDPEVMTKLHMYDSIASSNCPSELDKYQPIKEQERISFTYEVEFVKSDIRWPSRWDAYLKMEGSRVHWFSILNSLMVIFFLAGIVFVIFLRTVRRDLTRYEELDKEAQAQMNEELSGWKLVVGDVFREPECSKLLCVMVGDGVQILGMAAVTIVFAALGFMSPASRGMLLTGMIILYLFLGIAAGYVSVRLWRTIKGTSEGWRSISWLSACFFPGIAFIILTGLNFLLWGSKSTGAIPISLYFELLFLWFCISVPLTLIGGFMGTKAQQIDYPVRTNQIPREIPARKYPSWLLVLGAGTLPFGTLFIELFFILSSIWLGRFYYVFGFLLVVLLLLVIVCAEVSVVLTYMHLCVEDWRWWWKSFFASGSVALYVFLYSINYLVFDLQSLSGPVSAILYLGYSLLMAIAIMLSTGTIGFLMSFYFVHYLFSSVKID

SEQ ID NO: 8289 - protein, 652 aa, Lotus japonicus
IPLICWVCISLIVFVQFSNAFYLPGSYMHTYSNGDPIYAKVNSLTSIETELPFSYYSLPYCQPLGGIKKSAENLGELLMGDQIDNSPYLFHMNVNQSVYLCTTPPLNENEVKLLKQRTHDLYQVNMILDNLPVMRFATQNGVKIQWTGFPVGYTPPDGSADYIINHLKFTVLVHEYEGSGVEIIGTGEEGMGVISEADKNKASGYEIVGFHVVPCSVKRDPEAMTKLHTYDEMSRTSCPAELDKYQAVREQERISFTYEVEFVRSDIRWPSRWDAYLKMEGARVHWFSILNSLMVIFFLAGIVFVIFLRTVRRDLTRYEEMDKETQAQMNEELSGWKLVVGDVFREPDCSKLLCVMVGDGVQILGMAAVTIVFAALGFMSPASRGMLLTGMIILYLFLGSAAGYVSVRLWSTIKGTSEGWRSISWFAACFFPGIAFVILTGLNFILWSSKSTGAIPISLYFELIFLWFCISVPLTLIGGFMGTKAPQIEFPVRTNQIPREIPTRKYPSWLLVLGAGTLPFGTLFIELFFILSSIWLGRFYYVFGFLSIVLLLLIIVCAEVSVVLTYMHLCVEDWRWWWKAFFASGSVALYVFLYSINYLVFDLQSLSGPISAILYLGYSLLMAIAIMLSTGTIGFLMSFYFVHYLFSSVKID

SEQ ID NO: 8290 - protein, 659 aa, Cicer arietinum
MELTTVRKSFTYWVFLSVIVFAQVSNGFYLPGSYMHTYSNGEFINAKVNSLTSIETELPFSYYSLPYCQPPGGIKKSAENLGELLMGDQIDNSPYRFRMNVNETVYLCTTSPLNEHEVKLLKQRTRDLYQVNMILDNLPVMRYTSQNGVKIQWTGFPVGYTPPDGSADYIINHLKFTVLVHEYEGRGVEIIGTGEEGLGIITEADKKKASGYEIVGFHVVPCSIKYDPEVMAKHKMFDSISTVSCPNELDKYQVIKERERISFTYEVEFVKSDIRWPSRWDAYLKMEGSRVHWFSILNSLMVIFFLAGIVFVIFLRTVRRDLTRYEELDKEAQAQMNEELSGWKLVVGDVFREPDCSKLLCVMVGDGVQILGMAAVTIVFAALGFMSPASRGMLLTGMIILYLILGIAAGYVSVRLWRTMKGTTEGWRSISWSAACFFPGIAFIILTVLNFILWNSNSTGAIPISLYFELFFLWFCISVPLTLIGGFMGTKAEPIEYPVRTNQIPREIPARKYPSWLLVLGAGTLPFGTLFIELFFILSSIWLGRFYYVFGFLLVVLLLLIVVCAEVSVVLTYMHLCVEDWRWWWKAFYASGSVALYVFLYSINYLVFDLQSLSGPVSATLYLGYSLIMAIAIMLSTGTIGFLMSFYFVHYLFSSVKID

SEQ ID NO: 8291 - protein, 657 aa, Lupinus angustifolius
MELVRKPSICWVFVFVVIFAHVSNGFYLPGSYMHTYSNGDPIFAKVNSLTSIETELPFSYYSLPYCKPLGGIKKSAENLGELLMGDQIDNSPYRFRMNVNESIYLCTTTPLNEHEVKLLKQRTHDLYQVNMILDNLPVMRYATQNGVKIQWTGFPVGYTPPDGSADYIINHLKFRVFIHEYEGSGIEIIGTGEEGLGVISEADKKKASGYEIVGFQVVPCSIKYDPEAMTKLHTYDNVSSINCPNELDKYQQIREQERISFTYEVEFVKSDVRWPSRWDAYLKMEGSRVHWFSILNSLMVILFLAGIVFVIFLRTVRRDLTRYEELDKEAQAQMNEELSGWKLVVGDVFREPECSKLLCVMVGDGVQILGMAGVTIVFAALGFMSPASRGMLLTGMIILYLIQGIVAGYVSVRLWRTIKGTSEGWRSISWLAACFFPGIAFVILTVLNFILWGSHSTGAIPISLYFELFFLWFCISVPLTLIGGFLGTKAQPIEYPVRTNQIPREIPSRKYPSWLLVLGAGTLPFGTLFIELFFILSSIWLGRFYYVFGFLLVVLLLLVIVCAEVSVVLTYMHLCVEDWRWWWKAFFASGSVALYVFLYSINYLVFDLQSLSGPVSATLYLGYSLLMAVAIMLSTGTIGFLMSFYFVHYLFSSVKID

SEQ ID NO: 8292 - protein, 656 aa, Lupinus angustifolius
MELVRKPSIFRVFGCVIVFAQVSSGFYLPGSYMHTYSNEDPIYAKVNSLTSIETELPFSYYSLPYCKPLGGIKKSAENLGELLMGDQIDNSPYRFRMNVNETIYLCTTTPLNEHEVKLLKQRTRDLYQVNMILDNLPVMRYANQNGVKIQWTGFPIGYTPPDGSADYIINHLKFTVLVHEYKGSSVEIIGTGEEGLGVISEADKKASGYEIVGFQVAPCSIKYDSEVMTKLHMYDNMSSINCPSELHKYQVIREQERISFTYEVEFVKSDIRWPSRWDAYLKMEGSRVHWFSILNSLMVVFFLAGIVFVIFLRTVRRDLTRYEELDKETQAQMNEELSGWKLVVGDVFREPECSKLLCVMVGDGVQILGMAGVTIVFAALGFMSPASRGMLLTGMIILYLIQGIVAGYVSVRLWRTIKGTSEEWRSISWLAACFFPGIAFIILTVLNFILWGSHSTGAIPISLYFELFFLWFCISVPLTLIGGFLGTKAQTIEYPVRTNQIPREIPARKYPSWLLVLGAGILPFGTLFIELFFILSSIWLGRFYYVFGFLLVVLLLLVIVCAEVSVVLTYMHLCIEDWRWWWKAFFASGSVALYVFLYSINYLVFDLQSLRGPVSATLYLGYSLLMAVAIMLSTGTVGFLMSFYFVHYLFSSVKID

SEQ ID NO: 8293 - protein, 428 aa, Trigonella foenum-graecum
MTKHKMYDSISSVSCPNELDKYQVIKEQERISFTYDVEFVKSDIRWPSRWDAYLKMEGSRVHWFSILNSLMVIVFLAGIVLSFLKNCKKGLTRYEELDKEAQAQMNEELSGWKLVVGDVFREPECSKLLCVMVGDGVQILGMAAVTIVFAALGFMSPASRGMLLTGMIILYLILGIAAGYVSVRLWRIIKGTSEGWRSISWSAACFFPGIAFIILTVLNFILWNSNSTGAIPISLYFELFFLWFCISVPLTLIGGFMGTKGEPIEYPVRTNQIPREIPARKYPSWLLVLGAGTLPFGTLFIELFFILSSIWLGRFYYVFGFLLVVLLLLVVVCAEVSVVLTYMHLCVEDWRWWWKAFYASGSVALYVFLYSINYLVFDLQSLSGPVSATLYLGYSLLMAIAIMLSTGTIGFLMSFYFVHYLFSSVKID

SEQ ID NO: 8294 - protein, 659 aa, Medicago truncatula
MELPTLRKPFIYWVFFSFTVFAQVSNGFYLPGSYMHTYSNGEYINAKVNSLTSIETELPFSYYSLPYCQPPGGIKKSAENLGELLMGDQIDNSPYRFRMNKNETLYLCTTAPLNEHEVKLLKQRTRDLYQVNMILDNLPVMRYTSQNGVKIQWTGYPVGYTPSDGGADYIINHLKFTVLVHEYEGRGVEIIGTGEEGLGIISEADKKKASGYEIVGFHVVPCSIKYDPEAMAKHKMYDSISSVSCPNELDKYQVIKEQERISFTYDVEFVKSDIRWPSRWDAYLKMEGSRVHWFSILNSLMVIIFLAGIVFVIFLRTVRRDLTRYEELDKEAQAQMNEELSGWKLVVGDVFREPECSKLLCVMVGDGVQILGMAGVTIVFAALGFMSPASRGMLLTGMIILYLILGIAAGYVSVRLWRIIKGTSEGWRSVSWSAACFFPGIAFVILTVLNFILWNSNSTGAIPISLYFELFFLWFCISVPLTLIGGFMGTKGEPIEYPVRTNQIPREIPARKYPSWLLVLGAGTLPFGTLFIELFFILSSIWLGRFYYVFGFLLVVLLLLIVVCAEVSVVLTYMHLCVEDWRWWWKAFYASGSVALYVFLYSINYLVFDLQSLSGPVSATLYLGYSLLMAIAIMLSTGTIGFLMSFYFVHYLFSSVKID

SEQ ID NO: 8295 - protein, 657 aa, Cajanus cajan
MELRKPFICHWVFLFVIIFAQFVNGFYLPGSYMHTYSNRDFIYAKVNSLTSIETELPFGYYSLPYCQPDGGVKKSAENLGELLMGDQIDNSPYRFQMNVNETVYLCTTSLLNEHEVKLLKQRTRDLYQVNMILDNLPVMRFTNQNGVKIQWTGFPVGYTPPDGSADYIINHLKFTVLVHEYEGSGVEIVGTGEEGLGVISESDKKKASGYEIVGFQVVPCSIKYDPEVMLKHKRYDTLSPISCPAELDKYQVIREQERISFTYEVEFVKSDIRWPSRWDAYLKMEGSRVHWFSILNSLMVIFFLAGIVFVIFLRTVRRDLTRYEELDKETQAQMNEELSGWKLVVGDVFREPDCSKLLCVMVGDGVQILGMAGVTIVFAAFGFMSPASRGMLLTGMIILYLILGIAAGYVSVRLWRTIKGTTEGWRSISWSAACFYPGIAFVILTVLNFILWSSNSTGAIPISLYFELFFLWFCISVPLTLIGGFMGTKAQPIEYPVRTNQIPREIPARKYPSWLLVLGAGTLPFGTLFIELFFILSSIWLGRFYYVFGFLLVVLLLLVIVCAEVSVVLTYMHLCVEDWRWWWKAFFASGSVALYVFLYSINYLVFDLQSLSGPVSATLYLGYSLLMAIAIMLSTGTIGFLMSFYFVHYLFSSVKID

SEQ ID NO: 8296 - protein, 480 aa, Trifolium pratense
MGLPTMRKPFICWVFLSFVVFAQVSNGFYLPGTYMHTYSNGEFINAKVNSLTSIETELPFSYYSLPYCQPPGGIKKSAENLGELLMGDQIDNSAYRFRMNVNETLYLCTTSPLNEHEVKLLKQRTRDLYQVNMILDNLPVMRYTSQNGVKIQWTGFPVGYTPSDGGADYIINHLKFTVFVHEYEGRGVEIIGTGEEGMGIISEADKKKASGYEIVGFHVVPCSIKYDPEAMKKHKMYDGISSVSCPNELDKYQIIKEQERISFTYDVEFVKSDIRWPSRWDAYLKMEGSRVHWFSILNSLMVIVFLAGIVFVIFLRTVRRDLTRYEELDKEAQAQMNEELSGWKLVVGDVFREPDCSTLLCVMVGDGVQILGMAGVTIVFAALGFMSPASRGMLLTGMIILYLILGIAAGYVSVRLWRIIKGTSEGWRSISWSAACFFLALLSLSSQYSISFYGTATVPVLYPFPCILSCSSSGSVFQYL

SEQ ID NO: 8297 - protein, 498 aa, Trifolium pratense
MELPTMRKPFICWVFLSVVVFAQVSNGFYLPGSYMHTYSNGEFINAKVNSLTSIETELPFSYYSLPYCQPPGGIKKSAENLGELLMGDQIDNSPYRFRMNVNETLYLCTTSPLNEHEVKLLKQRTRDLYQVNMILDNLPVMRYTSQNGVKIQWTGFPVGYTPSDGGEDYIINHLKFTVFVHEYEGRGVEIIGTGEEGIGIISEADKKKASGYEIVGFHVVPCSIKYDPEAMKKHKMYDGISSVSCPNELDKYQVIKEQERISFTYEVEFVKSDIRWPSRWDAYLKMEGSRVHWFSILNSLMVIVFLAGIVFVIFLRTVRRDLTRYEELDKEAQAQMNEELSGWKLVVGDVFREPDYSTLLCVMVGDGVQILGMAAVTIVFAALGFMSPASRGMLLTGMIILYLILGIAAGYVSVRLWRIIKGTSEGWRSISWSAACFFLALLSLSSQYSISFYGTATVPVLYPFPCILSCSSSGSVFQYLWPSLEDLWVQKESQSNIL

SEQ ID NO: 8298 - protein, 657 aa, Glycine max
MELRKSFICHWVFLFVIVFVQVVNGFYLPGSYMHTYSNKDLIYAKVNSLTSIETELPYSYYDLPYCQPDGGIKKSAENLGELLMGDQIDNSPYRFRMNVNETLYLCTTSPLNEHEVKLLKQRTRDLYQVNMILDNLPVMRFTNQNGVKIQWTGFPVGYTPADGGEDYIINHLKFTVLVHEYEGSGVEIVGTGEEGLGVISESDNKKASGYEIVGFQVVPCSIKYDPEVMTKHNRYDTLSPISCPAELDKYQVIKERERISFTYEVEFVKSDIRWPSRWDAYLKMEGSRVHWFSILNSLMVISFLAGIVFVIFLRTVRRDLTRYEELDKETQDQMNEELSGWKLVVGDVFREPDCSKLLCVMVGDGVQILGMAGVTIVFAALGFMSPASRGMLLTGMIILYLILGIAAGYVSVRVWRTIKGTTEGWRSISWLAACFYPGIAFIILTVLNFILWSSNSTGAIPISLYFELFFLWFCISVPLTLIGGFMGTKAQPIEYPVRTNQIPREIPARKYPSWLLVLGAGTLPFGTLFIELFFILSSIWLGRFYYVFGFLLVVLLLLIIVCAEVSVVLTYMHLCVEDWRWWWKAFFASGSVALYVFLYSINYLVFDLQSLSGPVSATLYLGYSLLMAIAIMLSTGTIGFLMSFYFVHYLFSSVKID

SEQ ID NO: 8299 - protein, 282 aa, Phaseolus vulgaris
MELRKPFICSCVFLSVMVFAQVANGFYLPGSYMITYSNKSPIFAKVNSLTSIETELPFSYYSLPYCPPVGGIKKSAENLGELLMGDQIDNSPYRFQMNVNETVYLCTTSPLNEHEVKLLKQRTRDLYQVNMILDNLPVMRFTTQNGVKIQWTGFPVGYTPPDGGADYIINHLKFTVLVHEYEGSGVEIVGTGEESLGVFSESDKKKASGYEIVGFQVVPCSIKYDPEVMVKHKMYDTLSPIGCPAELDKYQVIREQERISFTYEVEFVKSDIKSGHYGGMLI

SEQ ID NO: 8300 - protein, 658 aa, Arachis hypogaea
MELVTKPLMYWVFISIIVFAAQLCNGFYLPGSYMHTYVNGDNIYAKVNSLTSIETELPFSYYSLPYCKPLGGIKKSAENLGELLMGDQIDNSPYRFQMNVNESIYLCTTTPLNEHEVKLLKQRTRDLYQVNMILDNLPVMRFAVQNGVKIQWTGFPVGYTPPGSNDDYIINHLKFTILVHEYEGSNAEIIGTGEEGLGVISESDKSKASGYQIVGFQVSPCSVKYDPEVMTSLHMYDNITSISCPSELDKYQVIKEQERISFTYEVEFVKSDIKWPSRWDAYLKMEGSKVHWFSIMNSLMVIFFLAGIVFVIFLRTVRRDLTRYEELDKEAQAQMNEELSGWKLVVGDVFREPNCSKLLCVMVGDGVQILGMGGVTIVFAALGFMSPASRGMLLTGMILLFLILGIAAGYVSVRLWSTIKGTTEGWRSISWSAACFFPGIAFIILTVLNFILWGSSSTGAIPISLYFELFFLWFCISVPLTMIGGFMGTRAEAIEYPVRTNQIPREIPARKYPSWLLVLGAGTLPFGTLFIELFFILSSIWLGRFYYVFGFLLVVLLLLIIVCAEVSVVLTYMHLCVEDWQWWWKAFFASGSVSLYVFLYSINYLVFDLQSLSGPVSATLYLGYSLLMAVAIMLATGTVGFLTSFYFVHYLFSSVKID

SEQ ID NO: 8301 - protein, 471 aa, Trifolium pratense
MELPTMRKPFICWVFLSVVVFAQVSNGFYLPGSYMHTYSNGEFINAKVNSLTSIETELPFSYYSLPYCQPPGGIKKSAENLGELLMGDQIDNSPYRFRMNVNETLYLCTTSPLNEHEVKLLKQRTRDLYQVNMILDNLPVMRYTSQNGVKIQWTGFPVGYTPSDGGADYIINHLKFTVFVHEYEGRGVEIIGTGEEGMGIISEADKKKASGYEIVGFHVIPCSIKYDPEAMKKHKMYDGISSVSCPNELDKYQIIKEQERISFTYDVEFVKSDIRWPSRWDAYLKMEGSRVHWFSILNSLMVIVFLAGIVFVIFLRTVRRDLTRYEELDKEAQAQMNEELSGWKLVVGDVFREPDYSTLLCVMVGDGVQILGMAAVTIVFAALGFMSPASRGMLLTGMIILYLILGIAAGYVSVRLWRIIKGTSGGGFFLALLSLSSQYSISFYGTATVPVLYPFPCILSCSSSGSVFQYL

SEQ ID NO: 8302 - protein, 457 aa, Trifolium pratense
MELPTMRKPFICWVFLSVVVFAQVSNGFYLPGSYMHTYSNGEFINAKVNSLTSIETELPFSYYSLPYCQPPGGIKKSAENLGELLMGDQIDNSPYRFRMNVNETLYLCTTSPLNEHEVKLLKQRTRDLYQVNMILDNLPVMRYTSQNGVKIQWTGFPVGYTPSDGGADYIINHLKFTVFVHEYEGRGVEIIGTGEEGMGIISEADKKKASGYEIVGFHVIPCSIKYDPEAMKKHKMYDGISSVSCPNELDKYQIIKEQERISFTYDVEFVKSDIRWPSRWDAYLKMEGSRVHWFSILNSLMVIVFLAGIVFVIFLRTVRRDLTRYEELDKEAQAQMNEELSGWKLVVGDVFREPDYSTLLCVMVGDGVQILGMAAVTIVFAALGFMSPASRGMLLTGMIILYLILGIAAGYVSVRLWRIIKGTGGVFSWHCFRYPHSTQFHSMEQQQYRCYTHFLVF

SEQ ID NO: 8303 - protein, 657 aa, Glycine max
MELRIPFICRCVFLFVVVFAQVVNAFYLPGSYMHTYSNKDLIYAKVNSLTSIETELPYNYYSLPYCQPDGGIKKSAENLGELLMGDQIDNSPYRFQMNVNETLYLCTTPLLNEHEVKLLKQRARDLYQVNMILDNLPVMRFTNQNGVTIQWTGFPVGYTPSDGSEDYIINHLKFTVLVHEYEGSGVEIVGTGEEGLGVISESDNKKASGYEIVGFQVVPCSIKYDLEVMTKHKRYDTLSPISCPAELDEYQVIREKERISFTYEVEFVKSDIRWPSRWDAYLKMEGSRVHWFSILNSLMVISFLAGIVFVIFLRTVRRDLTRYEELDKETQAQMNEELSGWKLVVGDVFREPDCSKLLCVMVGDGIQILGMAGVTIVFAALGFMSPASRGMLLTGMIVLYLILGIAAGYVSVRVWRTIKGTTEGWRSISWLAACFYPGIAFIILTVLNFILWSSNSTGAIPISLYFELFFLWFCISVPLTLIGGFMGTKAQPIEYPVRTNQIPREIPARKYPSWLLVLGAGTLPFGTLFIELFFILSSIWLGRFYYVFGFLLVVLLLLIVVCAEVSVVLTYMHLCVEDWRWWWKAFFASGSVALYVFLYSINYLVFDLRSLSGPVSATLYLGYSLLMAIAIMLSTGTIGFLMSFYFVHYLFSSVKID

SEQ ID NO: 8304 - protein, 658 aa, Arachis hypogaea
MGFVRKPLICWVFVSMVVFAAQLSNCFYLPGSYMHTYVNGDKIYAKVNSLTSIETELPFSYYSLPYCKPLGGIKKSAENLGELLMGDQIDNSPYRFQMNVNETIYLCTTTPLNEHEVKLLKQRTRDLYQVNMILDNLPVMRFAVQNGVKIQWTGFPVGYTPPGSNDDYIINHLKFTILVHEYEGSNAEIIGTGEEGLGVISESEKKKASGYEIVGFQVSPCSIKYDPDVMTKLHMYDNTNPITCPSELEKYQVIREQERISFTYEVEFVKSDIRWPSRWDAYLKMEGSRVHWFSIMNSLMVIFFLAGIVFVIFLRTVRRDLTRYEELDKEAQAQMNEELSGWKLVVGDVFREPNCSKLLCVMVGDGVQILGMGGVTIVFAALGFMSPASRGMLLTGMILLFLILGIAAGYVSVRLWSTIKGTTEGWRSISWSAACFFPGIAFIILTVLNFILWGSSSTGAIPISLYFELFFLWFCISVPLTMIGGFMGTRAEAIEYPVRTNQIPREIPARKYPSWLLVLGAGTLPFGTLFIELFFILSSIWLGRFYYVFGFLLVVLLLLIIVCAEVSVVLTYMHLCVEDWQWWWKAFFASGSVSLYVFLYSINYLVFDLQSLSGPVSATLYLGYSLLMAVAIMLATGTVGFLTSFYFVHYLFSSVKID

SEQ ID NO: 8305 - protein, 657 aa, Manihot esculenta
MSKMRMPTVYWASLLVFIFVHACNAFYLPGSYMHTYSTGEPIFAKVNSLTSIETELPFSYYSLPYCKPAGGIKKSAENLGELLMGDQIDNSPYQFRMNVNESVFLCTTPPLSEHEVKLLKQRTRDLYQVNMILDNLPAMRYAKQNGVNIQWTGFPVGYAPQNSNDDYIINHLKFTVLVHEYEGSGVEIIGTGEEGMGVISEADKKKASGYEIVGFEVVPCSVKYDPETMSKLHMYDNISSANCPLELDKSQVIREQERVSFTYEVSFVKSDTRWPSRWDAYLKMEGARVHWFSILNSLMVIFFLAGIVFVIFLRTVRRDLTRYEELDKEAQAQMNEELSGWKLVVGDVFREPDCSKLLCVMVGDGVQITGMAVVTIVFAALGFMSPASRGMLLTGMIILYLFLGIAAGYVSVRLWRTVKGTSEGWRCVSWASACFFPGIAFVILTVLNFILWGSKSTGAIPISLYFVLLALWFCISVPLTLLGGFFGTRAEAIQYPVRTNQIPREIPARKYPSWLLVLGAGTLPFGTLFIELFFILSSIWLGRFYYVFGFLLIVLLLLVIVCAEVSVVLTYMHLCVEDWRWWWKAFFASGSVALYVFLYSINYLVFDLQSLSGPVSAILYLGYSLLMAIAIMLSTGTIGFLMSFYFVHYLFSSVKID

SEQ ID NO: 8306 - protein, 657 aa, Manihot esculenta
MLKMRMPAIYRAFILVVLFAHACNAFYLPGSYMHTYSNGEPIFAKVNSLTSIETELPFSYYSLPYCKPAGGIKKSAENLGELLMGDQIDNSPYRFRMNVNESVFLCTTPPLSEHEVKLLKQRTRDLYQVNMILDNLPAMRYAKQNGVNIQWTGFPVGYAPQNSNDDYIINHLKFTVLVHEYEGSAVEIIGTGEEGMGVISEADKEKASGYEIVGFEVVPCSVKYDPEVMAKLHMYDNISSVNCPLDLDKSQIIREQERVSFTYEVEFVKSDTRWPSRWDAYLKMEGARVHWFSILNSLMVIFFLAGIVFVIFLRTVRRDLTKYEELDKEAQAQMNEELSGWKLVVGDVFREPDCSKLLCVMVGDGVQITGMAVVTIVFAAIGFMSPASRGMLLTGMIILYLFLGIAAGYVSVRLWRTIKGTSEGWRSVSWSAACFFPGIAFVILTALNFILWGSKSTGAIPISMYFVLLSLWFCISVPLTLLGGFFGTRAEAIQYPVRTNQIPREIPARKYPSWLLVLGAGTLPFGTLFIELFFILSSIWLGRFYYVFGFLLIVLLLLVIVCAEVSVVLTYMHLCVEDWQWWWKAFFASGSVALYVFLYSINYLVFDLQSLSGPVSAVLYLGYSLLMAIAIMLSTGTVGFFMSFYFVHYLFSSVKID

SEQ ID NO: 8307 - protein, 654 aa, Euphorbia peplus
MRMPKIYWASILVLLFVNSCNAFYLPGSYMHTYSTGEPIIAKVNSLTSIETELPYGYYSLPYCKPPGGVKNSAENLGELLMGDQIDNSPYRFKMNTNESLFLCTTPPLSEHEVKLLKQRTRDLYQVNMILDNLPAMRYAKQNGINIQWTGFPVGYTPQSSNDDYIINHLKFTVLVHEYEGTGVQIIGTGEEGMGVISEADKQKASGFEIVGFEVVPCSVKYDPEAMSKLHIYDPIAKVNCPMDLDKSQIIREQERVSFTYEVEFVKSDIRWPSRWDAYLKMEGARVHWFSILNSLMVIFFLAGIVFVIFLRTVRRDLTRYEELDKEAQAQMNEELSGWKLVVGDVFREPECSKLLCVMVGDGVQITGMGVVTIVFAALGFMSPASRGMLLTGMIILYLFLGAAAGYVAVRLWRTMKGTSEGWRSVSWSAACFFPGIAFVILTVLNFILWGSKSTGAIPISLYFVLLALWFCISVPLTLLGGFFGTRAEEITFPVRTNQIPREIPARKYPSWLLVLGAGTLPFGTLFIELFFILSSIWLGRFYYVFGFLLIVLLLLVVVCAEVSVVLTYMHLCVEDWRWWWKAFFASGSVALYVFLYSINYLVFDLQSLSGPVSAVLYLGYSLLMAIAIMLSTGTIGFLVSFYFVHYLFSSVKID

SEQ ID NO: 8308 - protein, 657 aa, Ricinus communis
MVKMRMPTVHWASLLVVLFAHTCSAFYLPGSYMHTYSTGEKIVAKVNSLTSIETELPFSYYSLPYCKPPGRIRKSAENLGELLMGDQIDNSPYQFRMNINESVFLCTTPPLSEHEVKLLKQRTRDLYQVNMILDNLPAMRYAKQNGVNIQWTGFPVGYTPQNSNDDYIINHLKFTVLVHEYEGSGVEIIGTGEEGMGVISEADKKKASGFEIVGFEVVPCSVKYDPEVMSKHHMYDSISSVNCPMDLDKSQIIREQERVSFTYEVEFVKSDTRWPSRWDAYLKMEGARVHWFSILNSLMVIFFLAGIVFVIFLRTVRRDLTRYEELDKEAQAQMNEELSGWKLVVGDVFREPECSKLLCVMVGDGVQITGMAVVTIVFAALGFMSPASRGMLLTGMIILYLFLGIAAGYVSVRLWRTMKGSSEGWRSISWSAACFFPGIAFVILTVLNFILWGSKSTGAIPISLYFVLLALWFCISVPLTLLGGFFGTRAEEIQYPVRTNQIPREIPARKYPSWLLVLGAGTLPFGTLFIELFFILSSIWLGRFYYVFGFLLIVLLLLVVVCAEVSVVLTYMHLCVEDWRWWWKAFFASGSVALYVFLYSINYLVFDLQSLSGPVSAILYLGYSLLMAIAIMLSTGTIGFLMSFYFVHYLFSSVKID

SEQ ID NO: 8309 - protein, 652 aa, Theobroma cacao
MPGICSFFVLVILFVHSCHGFYLPGSYMHTYSTSDTIVAKVNSLTSIETELPFSYYSLPYCKPLGGIKKSAENLGELLMGDQIDNTPYRFRMNVNESLYLCTTNALNEHEVKLLKQRTRDLYQVNMILDNLPVMRIAKQNGINIQWTGFPVGYTPPNSNDDYIINHLKFKVLVHEYEGSGVEIIGTGEEGMGVISEADKKKASGFEIVGFEVVPCSVKYDPEVMTKLHMYDNISSVNCPLELEKSQIIREHERISFTYEVEFVKSDIRWPSRWDAYLKMEGARVHWFSILNSLMVITFLAGIVFVIFLRTVRRDLTRYEELDKEAQAQMNEELSGWKLVVGDVFREPDCPKLLCVMIGDGVQITGMAAVTIVFAALGFMSPASRGMLLTGMIILYLFLGIAAGYVAVRLWRTLKGTSEGWRSVSWSVACFFPGIVFVILTVLNFILWGSKSTGAIPISLYFILLSLWFCISVPLTLVGGFLGTRAEAIQYPVRTNQIPREIPARKYPSWLLVLGAGTLPFGTLFIELFFILSSIWLGRFYYVFGFLLIVLLLLIIVCAEVSVVLTYMHLCVEDWRWWWKAFCASGSVALYVFLYSINYLVFDLQSLSGPVSAILYLGYSMIMAIAIMLSTGTIGFITSFYFVHYLFSSVKID

SEQ ID NO: 8310 - protein, 659 aa, Gossypium raimondii
MAFSERKMPGICSVFLLVVLFAHSCHGFYLPGSYMHTYSTSDTIVAKVNSLTSIETELPFSYYSLPYCEPLGGIKKSAENLGELLMGDQIDNSPYRFKMNVNESLYVCTTSPLNEHEVKLLKQRTRDLYQVNMILDNLPVMRIAKQNGVSIQWTGFPVGFTPPNSNDDYIINHLKFKVLVHEYEGSGVQIIGTGEEGMGVISEADKKKASGYEIVGFEVTPCSVKYDPEVMTKLHMYDSISPVNCPLELDKSQIIRERERISFTYEVEFVKSDIRWPSRWDAYLKMEGARVHWFSILNSLMVITFLAGIVFVIFLRTVRRDLTRYEELDKEAQAQMNEELSGWKLVVGDVFREPDCAKLLCVMIGDGVQITGMAAVTIVFAAFGFMSPASRGMLLTGMIILYLFLGIAAGYAAVRLWRTLKGTSEGWRSISWSVACFFPGIVFVILTVLNFILWGSKSTGAIPISLYFVLLSLWFCISVPLTLVGGFLGTRAEAIQYPVRTNQIPREIPARKYPSWLLVLGAGTLPFGTLFIELFFILSSIWLGRFYYVFGFLLIVLLLLIIVCAEVSVVLTYMHLCVEDWRWWWKAFFASGSVALYVFLYSINYLVFDLQSLSGPVSAILYLGYSMIMAIAIMLSTGTIGFITSFYFVHYLFSSVKID

SEQ ID NO: 8311 - protein, 659 aa, Gossypium hirsutum
MAFSERKMPGICSVFLLVVLFAHSCHGFYLPGSYMHTYSTSDTIVAKVNSLTSIETELPFSYYSLPYCKPLGGIKKSAENLGELLMGDQIDNSPYRFKMNVNESLYVCTTSPLNEHEVKLLKQRTRDLYQVNMILDNLPVMRIAKQNGVSIQWTGFPVGFTPPNSNDDYIINHLKFKVLVHEYEGSGVQIIGTGEEGMGVISEADKKKASGYEIVGFEVTPCSVKYDPEVMTKLHMYDSISPVNCPLELDKSQIIRERERISFTYEVEFVKSDIRWPSRWDTYLKMEGARVHWFSILNSLMVITFLAGIVFVIFLRTVRRDLTRYEELDKEAQAQMNEELSGWKLVVGDVFREPDCAKLLCVMIGDGVQITGMAAVTIVFAAFGFMSPASRGMLLTGMIILYLFLGIAAGYAAVRLWRTLKGTSEGWRSISWSVACFFPGIVFVILTVLNFILWGSKSTGAIPISLYFVLLSLWFCISVPLTLVGGFLGTRAEAIQYPVRTNQIPREIPARKYPSWLLVLGAGTLPFGTLFIELFFILSSIWLGRFYYVFGFLLIVLLLLIIVCAEVSVVLTYMHLCVEDWRWWWKAFFASGSVALYVFLYSINYLVFDLQSLSGPVSAILYLGYSMIMAIAIMLSTGTIGFITSFYFVHYLFSSVKID

SEQ ID NO: 8312 - protein, 655 aa, Gossypium raimondii
MGNMPGICWGFQLLILFVHHCYGFYLPGSYMHTYSTKDAIYAKVNSLTSIETELPFSYYSLPYCKPMGGIKKSAENLGELLMGDQIDNSPYRFRMNVNESLYLCTTSPLNEREVKLLKQRTRDLYQVNMILDNLPVMRITKQNGVNIQWTGFPIGYTPPNSNDDYIINHLKFKVLVHEYEGSGVQIIGTGEEGMGVISEADKTKASGFEIVGFEVIPCSVKYDPEVMTKLHMYDNISSVNCPLELDKSQIIREQERISFTYEVEFVKSDIRWPSRWDAYLKMEGSRVHWFSILNSLMVITFLAGIVFVILLRTVRRDLTRYEELDKEAQAQMNEELSGWKLVVGDVFREPNHSKLLCVMIGDGVQIMGMALVTIVFAALGFMSPASRGMLLTGMIILYLFLGIAAGYVAVCLWRTLKGTAEGWRSLSWSVACFFPGIVFVILTALNFILWGSKSTGAIPISLYFILLSLWFCISVPLTLLGGYFGTRAEPIQYPVRTNQIPREIPARKYPSWLLVLGAGTLPFGTLFIELFFILSSIWLGRFYYVFGFLLIVLLLLIIVCAEVSVVLTYMHLCVEDWRWWWNAFFASGSVSLYVFLYSINYLVFDLQSLSGPVSAVLYLGYSMIMAVAIMLATGTIGFITSFYFVHYLFSSVKID

SEQ ID NO: 8313 - protein, 654 aa, Populus trichocarpa
MRTPMICWAFLLLVLFGKACNGFYLPGSYMHTYSTGDEIVAKVNSLTSIETELPFSYYSLPYCQPHGGIKKSAENLGELLMGDQIDNSPYRFRMNVNESVYLCTTKPLSEHEVKLLKQRTRDLYQVNMILDNLPVMRYAKQNGIDIQWTGFPVGYTPQNSNDDYIINHLKFTVLVHEYEGSGVEVIGTGEEGMGMISESDKKKASGFEIVGFVVVPCSVKYDPEVMTKHHIYDNISLVECPLDLDKSQIIREQERISFTYVVEFVKSDIRWPSRWDAYLKMEGARVHWFSILNSLMVIFFLAGIVFVIFLRTVRRDLTRYEELDKEAQAQMNEELSGWKLVVGDVFREPDCPKLLCVMVGDGVQITGMAVVTIVFAAFGFMSPASRGMLLTGMILLYLFLGIAAGYAAVRMWRTIKGTSEGWRSISWSVASFFPGIVFVILTILNFILWGSHSTGAIPISLYFVLLSLWFCISVPLTLLGGFMGTRAEAIQYPVRTNQIPREIPARKLPSWVLVLGAGTLPFGTLFIELFFILSSIWLGRFYYVFGFLLIVLLLLVVVCAEVSVVLTYMHLCVEDWRWWWKAFFASGSVSIFVFLYSINYLVFDLQSLSGPVSAILYLGYSLIMAIAIMLSTGTIGLLTSFYFVHYLFSSVKID

SEQ ID NO: 8314 - protein, 658 aa, Chelidonium majus
MASSSLQFSSIHLYCLYVVLFACVCNGFYLPGSYMHTYSEGDKIFAKVNSLTSIETELPFSYYSLPYCKPEGGIKKSAENLGELLMGDQIDNSPYRFQMNVNESVYLCTTTPLNENEVKLLKQRTRDLYQVNMILDNLPAMRFAKQNGINIQWTGYPVGYAPPQSNEDYIINHLKFKVLIHEYEGGVGIIGTGEEGSVAYTEAEKKKASGYEIVGFEVVPCSIKRDTEAMLKLHMYDAIDPVNCPVDLDKSQIIREQERVSFTYEVEFVKSDIRWPSRWDAYLKMEGARVHWFSILNSLMVIFFLAGIVFVIFLRTVRRDLTRYEELDKEAQAQMNEELSGWKLVVGDVFREPNCSKLLCVMVGDGTQILGMAVVTILFAALGFMSPASRGMLLTGMIILYLFLGIVAGYVGVRLWRTIKGTSEGWRSISWSVSCFFPGIVFIILTALNFVLWGSKSTGAIPLSLYFILFSLWFCISVPLTLVGGFLGTRAEAIQFPVRTNQIPREIPARKYPSWLLVLGAGTLPFGTLFIELFFILSSIWLGRFYYVFGFLLVVFVLLVVVCAEVSVVLTYMHLCVEDWQWWWKAFYASGSVALYVFLYSINYLVFDLRSLSGPVSAILYLGYSLIMAIAIMLSTGTIGFLVSFYFVHYLFSSVKID

SEQ ID NO: 8315 - protein, 659 aa, Panax ginseng
MALSLISKRTYRDAFIYVILISHVCNGFYLPGSYMHTYSTGDEIVAKVNSLTSIETELPFSYYSLPYCKPQGGIKKSAENLGELLMGDQIDNSPYRFRMNVNESVYLCTTSPLSENEVKLLKQRTRDLYQVNMILDNLPAMRFATQNGIKIQWTGFPVGYTPPNTNDDYIINHLKFKVLVHEYEGTGVEIIGTGEEGMGIISETDKKKASGYEIVGFEVLPCSVKYDPEKMAKLHRYDNVTSLICPLELDKSQIIREQERVSFTYEVEFVKSDIRWPSRWDAYLKMEGARVHWFSILNSLMVILFLAGIVFVIFLRTVRRDLTRYDELDKEAQAQMNEELSGWKLVVGDVFREPKFSKLLCVMIGDGVQITGMAVVTIVFAAFGFMSPASRGMLLTGMIILYLFLGTGAGYAGVRLWCTIKGTSEGWRSVSWSVACFFPGIVFVILTALNFILWGSKSTGAIPISLYFIILSLWFCISVPLTLLGGYLGTRAESIQYPVRTNQIPREIPARKYPSWLLVLGAGTLPFGTLFIELFFILSSIWLGRFYYVFGFLLVVLLLLVTVCAEVSLVLTYMHLCVEDWQWWWKAFYASGSVALYVFLYSINYLVFDLQSLSGPVSAILYLGYSLIMAIAIMLSTGTIGFLSSFYFVHYLFSSVKID

SEQ ID NO: 8316 - protein, 656 aa, Citrus clementina
MREKISMILWAFLFAVLFGQVCNGFYLPGSYMHTYSNGEPIDTKVNSLTSIETELPFSYYSLPYCKPLRGVKKSAENLGELLMGDQIDNSPYRFRINKNETLFLCITTPLSENEVKLLKQRTRDLYQVNMILDNLPVMRYAKQNGVSIQWTGFPVGYTPGNSNDDYIINHLKFTVLVHEYKGSGVEIIGTGEEGMGVISEADDKKASGYEIVGFEVVPCSVKYDPEVMTKLHMYDNITSVKCPSELDKSQIIREQERISFTYEVEFVKSNIRWPSRWDAYLKMEGARVHWFSILNSLMVIFFLAGIVFVIFLRTVRRDLTRYEELDKEAQAQMNEELSGWKLVVGDVFREPDHPKLLCVMVGDGVQITGMAIVTIIFAALGFMSPASRGMLLTGMIFLFLFLGIAAGYVAVRMWRTIKGTSEGWRSVAWSAACFFPGIVFVILTVLNFVLWGSKSTSALPISLYFVLLSLWFCISVPLTLLGGFFGTRAEEITYPVRTNQIPREIPARKYPSWLLVLGAGTLPFGTLFIELFFILSSIWLGRFYYVFGFLLIVLLLLVVVCAEVSVVLTYMHLCVEDWRWWWKAFFASGSVALYVFLYSINYLVFDLQSLSGPVSALLYLGYSLIMAVAIMLATGTIGFLTSFYFVHYLFSSVKID

SEQ ID NO: 8317 - protein, 656 aa, Citrus sinensis
MREKISMILWAFLFAVLFGQVCNGFYLPGSYMHTYSNGEAIYTKVNSLTSIETELPFSYYSLPYCKPLRGVKKSAENLGELLMGDQIDNSPYRFRINKNETLFLCITTPLSENEVKLLKQRTRDLYQVNMILDNLPVMRYAKQNGVSIQWTGFPVGYTPGNSNDDYIINHLKFTVLVHEYKGSGVEIIGTGEEGMGVISEADDKKASGYEIVGFEVVPCSVKYDPEVMTKLHMYDNITSVKCPSELDKSQIIRERERISFTYEVEFVKSNIRWPSRWDAYLKMEGARVHWFSILNSLMVIFFLAGIVFVIFLRTVRRDLTRYEELDKEAQAQMNEELSGWKLVVGDVFREPDHPKLLCVMVGDGVQITGMAIVTIIFAALGFMSPASRGMLLTGMIFLFLFLGIAAGYVAVRMWRTIKGTSEGWRSVAWSAACFFPGIVFVILTVLNFVLWGSKSTGALPISLYFVLLSLWFCISVPLTLLGGFFGTRAEEITYPVRTNQIPREIPARKYPSWLLVLGAGTLPFGTLFIELFFILSSIWLGRFYYVFGFLLIVLLLLVVVCAEVSVVLTYMHLCVEDWRWWWKAFFASGSVALYVFLYSINYLVFDLQSLSGPVSALLYLGYSLIMAVAIMLATGTIGFLTSFYFVHYLFSSVKID

SEQ ID NO: 8318 - protein, 659 aa, Amsonia hubrichtii
MALPSICKRKYLAAFIYLVLASHVCHGFYLPGTYMHTYTPGEEITVKVNSLTSIETELPFSYYSLPYCQPQGEIKKSAENLGELLMGDQIDNSPYRFKMNVNQSLYLCTTHPLSEQEVKLLKQRTHDLYQVNMILDNLPAMRYATQNGNRVQWTGFPVGYTPPGGTDDYIINHLQFRVLIHEYEGAGVEIIGTGEEGMGVISEADKKKASGYEIVGFEVVPCSVKYDPEKMTKLHMYDTVQSVNCPMELDKSQVIRKQERVSFTYEVEFVKSNIRWPSRWDAYLKMEGSRVHWFSILNSLMVIFFLAGIVFVIFLRTVRRDLTRYEELDKEAQAQMNEELSGWKLVVGDVFREPNHSKLLAVMVGDGIQILGMAVVSIVFAALGFMSPASRGMLLTGMILLYLFLGIAAGYVGVRMWTTIKGTSEGWRSVSWAIACFFPGIVFVILTVLNFILWGSKSTGAIPISLYFVLLSLWFCISVPLTLLGGFLGKRAEPIQYPVRTNQIPREIPARKYPSWLLVLGAGTLPFGTLFIELFFILSSIWLGRFYYVFGFLLIVLLLLVIVCAEVSVVLTYMHLCVEDWMWWWKAFYASGSVALYVFLYSINYLVFDLQSLSGPVSAILYIGYSLIMAVAIMLATGAIGFLTSFYFVHYLFSSVKID

SEQ ID NO: 8319 - protein, 659 aa, Catharanthus roseus
MAMPSICKRKYWAAFIFLVLVSQICHGFYLPGTYMHTYTTGEEITVKVNSLTSIETELPFSYYSLPYCEPLGGIKKSAENLGELLMGDQIDNSPYRFKMNVNQSLYLCTTYPLSENEVKLLKQRTHDLYQVNMILDNLPAMRYATQNGIKVQWTGYPVGYTPPGGTEDYIINHLQFKVLIHEYEGAGVEIIGTGEEGMGVISEADKKKASGYEIVGFEVTPCSVKYDPEKMTKLHMYDAVPSVSCPLELEKSQVIRQQERVSFTYEVEFVKSNIRWPSRWDAYLKMEGSRVHWFSILNSLMVIFFLAGIVFVIFLRTVRRDLTRYEELDKEAQAQMNEELSGWKLVVGDVFREPNHSKLLAVMVGNGVQILGMAAVSIVFAALGFMSPASRGMLLTGMILVYLFLGIAAGYAGVRLWRTIKGTSEGWRSISWSISCFFPGIVFVILTVLNFILWGSKSTGALPISLYFILLSLWFCISVPLTLLGGFLGTKAEPIQYPVRTNQIPREIPARKYPSWLLVLGAGTLPFGTLFIELFFILSSIWLGRFYYVFGFLLIVLLLLVIVCAEVSVVLTYMHLCVEDWMWWWKAYYASGSVALYVFLYSINYLVFDLQSLSGPVSAILYIGYSLIMAIAIMLGTGAIGFLTSFYFVHYLFSSVKID

SEQ ID NO: 8320 - protein, 659 aa, Nicotiana benthamiana
MASLLISMRRYWAVFLYVILVSHACNGFYLPGSYMHTYSTGEEIIVKVNSLTSIETELPFSYYSLPYCKPPGGVKKSAENLGELLMGDQIDNSPYRFKMNVNESIYLCTTPPLNEHEVKLLKQRTRDLYQVNMILDNLPALRYANQNGLKIQWTGFPVGSSPQNSNEDYIINHLKFRVLIHEYEGAGIQIIGTGEEGMGVISETDKSKASGFEIVGFEVVPCSVKYEPEKMTKLHMYDNSSSISCPLELEKSQIIREQERVSFTYQVEFVKSDIRWPSRWDAYLKMEGARVHWFSILNSLMVIFFLAGIVFVIFLRTVRRDLTKYEELDKEAQAQMNEELSGWKLVVGDVFREPNHSTLLCVMIGDGVQITGMAVVTIVFAAFGFMSPASRGMLLTGMILLYLFLGIAAGYVSVRAWRTIKGTSEGWRSVSWSTACFFPGIVFVILTVLNFILWGSRSTGALPISLFFTLLALWFCISVPLTLLGGYLGTRAEPISYPVRTNQIPREIPARKYPSWLLVLGAGTLPFGTLFIELFFILSSIWLGRFYYVFGFLLIVLLLLVTVCAEVSVVLTYMHLCVEDWMWWWKAFYASGSVALYVFLYSINYLVFDLQSLSGPVSAILYLGYSLIMAVAIMLSTATIGFLTSFYFVHYLFSSVKID

SEQ ID NO: 8321 - protein, 652 aa, Gossypium hirsutum
MPGICWGFQLLILFVHHCYGFYLPGSYMHTYSTKDAIYAKINSLTSIETELPFSYYSLPYCKPMGGIKKSAENLGELLMGDQIDNSPYRFRMNVNESLYLCTTSPLNEREVKLLKQRTRDLYQVNMILDNLPVMRITKQNGVNIQWTGFPIGYTPPNSNDDYIINHLKFKILVHEYEGSGVQIIGTGEEGMGVISEADKTKASGFEIVGFEVIPCSVKYDPEVMTKLHMYDNISSVNCPLELDKSQIIREQERISFTYEVEFVKSDIRWPSRWDAYLKMEGSRVHWFSILNSLMVITFLAGIVFVILLRTVRRDLTRYEELDKEAQAQMNEELSGWKPVVGDVFREPNHSKLLCIMIGDGVQIMGMALVTIVFAALGFMSPASRGMLLTGMIILYLFLGIAAGYVAVCLWRTLKGTAEGWRSLSWSVACFFPGIVFVILTALNFILWGSKSTGAIPISLYFILLSLWFCISVPLTLLGGYFGTRAEPIQYPVRTNQIPREIPARKYPSWLLVLGAGTLPFGTLFIELFFILSSIWLGRFYYVFGFLLIVLLLLIIVCAEVSVVLTYMHLCVEDWRWWWNAFFASSSVSLYVFLYSINYLVFDLQSLSGPVSAVLYLGYSMIMAVAIMLATGTIGFITSFYFVHYLFSSVKID

SEQ ID NO: 8322 - protein, 659 aa, Triphysaria pusilla
MTLPLSSRKKLCTAFTYLALIFQACNGFYLPGSYMHTYSTGDEIYAKVNSLTSIETELPFSYYSLPYCKPIGGIKKSAENLGELLMGDQIDNSPYRFRMNVNESVYICTTPPLNDNDVKLLKQRTRDLYQVNMILDNLPAMRFTNQNGVKIQWTGYPVGYTPPGSNDDYIINHLKFRVLIHEYEGAGVEIIGTGEEGMGVISEADKTKAAGYEIVGFEVVPCSVKYDSDKMTKLHIYDNVTSVNCPLELDKSQIIREKERVSFTYEVEFVKSNVRWPSRWDAYLKMEGARVHWFSILNSLMVIFFLAGIVFVIFLRTVRRDLTRYEELDKEAQAQMNEELSGWKLVVGDVFREPSHSTLLCVMVGDGVQITGMAVVTIVFAAFGFMSPASRGMLLTGMILLYLFLGIASGYVSVRMWTTIKGSSEGWRSISWKTACFFPGIIFVILTFLNFILWGSNSTGAIPISLYFILFSLWFCISVPLTLLGGHFGTRAEPITYPVRTNQIPREIPARKYPSWLLVLGAGTLPFGTLFIELFFILSSIWLGRFYYVFGFLLIVLTLLVVVCAEVSVVLTYMHLCVEDWMWWWKAFYASGSVALYVFLYSINYLVFDLQSLSGPVSATLYLGYSLIMAVAIMLSTGTIGFLTSFYFVHYLFSSVKID

SEQ ID NO: 8323 - protein, 659 aa, Gossypium hirsutum
MVFPERKMPGVCWVFLLLLLFAHICDGFYLPGSYMHTYSTKDTIFAKVNSLTSIETELPFSYYSLPYCKPLGGVKKSAENLGELLMGDQIDNSPYRFRMNVNESLYLCTTSPLNEHEVKLLKQRTRDLYQVNMILDNLPVMRIAKQNGVNIQWTGFPVGYSPPNSNDDYIINHLKFKVLVHEYEGSGVEIIGTGEDGMAVFPKADKKKASGFEIVGFEVVPCSIKYDPEAMTKLHMYDKVSSVNCPLGLGKSQIIRERERISFTYEVEFVKSDIRWPSRWDAYLKMEGARVHWFSILNSLMVITFLAGIVFVIFLRTVRRDLTRYEELDKEAQAQMNEELSGWKLVVGDVFREPDCPKLLCVMIGDGVQIMGMAAVTIVFAAFGFMSPASRGMLLTGMIILYLFLGIVAGYVAVRLWRTLKGTSEGWRSVSWSVACFFPGIVFVILTVLNFILWGSKSTGAIPISLYFVLLSLWFCISVPLTLIGGFIGTRAEAIQYPVRTNQIPREIPARKYPSWLLVLGAGTLPFGTLFIELFFILSSIWLGRFYYVFGFLLIVLLLLIIVCAEVSVVLTYMHLCVEDWRWWWKAFFASGSVSLYVFLYSINYLVFDLQSLSGPVSAILYLGYSMIMAIAIMLSTGTIGFITSFYFVHYLFSSVKID

SEQ ID NO: 8324 - protein, 659 aa, Tabernaemontana elegans
MALPSICKRKFWAAFIYLVLVSHVCHGFYLPGTYMHTYAPAEEITVKVNSLTSIETELPFSYYSLPYCKPQGGIKKSAENLGELLMGDQIDNSPYRFKMNVNQSVYLCTTPPLSEHEVKLLKQRTHDLYQVNMILDNLPAMRYAIQNGIKVQWTGFPVGYTPPGGTDDYIINHLQFRVLIHEYEGAGMEIIGTGEEGMGVISEADKKKTSGYEIVGFEVVPCSVKYDPEKMEKLHMYDTVPSVSCPMELDKSQVIRQQERVSFTYEVEFVKSNIRWPSRWDAYLKMEGSRVHWFSILNSLMVIFFLAGIVFVIFLRTVRRDLTRYEELDKEAQAQMNEELSGWKLVVGDVFREPNHSKLLSVMVADGIQILGMAVVSIVFAAFGFMSPASRGMLLTGMILLYLFLGIAAGYSGVRVWRTIKGTSEGWRSVSWSIACFFPGIVFVILTVLNFILWGSKSTGAIPISLYFVLLSLWFCISVPLTLLGGFLGTKAEPIQFPVRTNQIPREIPARKYPSWLLVLGAGTLPFGTLFIELFFILSSIWLGRFYYVFGFLLIVLLLLVVVCAEVSVVLTYMHLCVEDWMWWWKAFYSSGSVALYVFLYSINYLVFDLQSLSGPVSAILYIGYSLIMAIAIMLATGAIGFLTSFYFVHYLFSSVKID

SEQ ID NO: 8325 - protein, 659 aa, Nicotiana benthamiana
MASPLISTRRYWAVFLYVILVSHACNGFYLPGSYMHTYSTGEEIIVKVNSLTSIETELPFSYYSLPYCKPPGGVKKSAENLGELLMGDQIDNSPYRFKMNVNESIYLCTTPPLNEHEVKLLKQRTRDLYQVNMILDNLPALRYANQNGLKIQWTGFPVGSSPQNSNEDYIINHLKFRVLIHEYEGAGIQIIGTGEEGMGVISETDKSKASGFEIVGFEVVPCSVKSEPEKMTKLHMYDNSSSISCPLELEKSQIIREQERVSFTYEVEFVKSDIRWPSRWDAYLKMEGARVHWFSILNSLMVIFFLAGIVFVIFLRTVRRDLTKYEELDKEAQAQMNEELSGWKLVVGDVFREPNHSTLLCVMIGDGVQITGMAVVTIVFAAFGFMSPASRGMLLTGMILLYLFLGIAAGYVSVRAWRTIKGTSEGWRSVSWSTACFFPGIVFVILTVLNFILWGSRSTGALPISLFFTLLALWFCISVPLTLLGGYLGTRAEPISYPVRTNQIPREIPARKYPSWLLVLGAGTLPFGTLFIELFFILSSIWLGRFYYVFGFLLIVLLLLVTVCAEVSVVLTYMHLCVEDWMWWWKAFYASGSVALYVFLYSINYLVFDLQSLSGPVSAILYLGYSLIMAVAIMLSTATIGFLTSFYFVHYLFSSVKID

SEQ ID NO: 8326 - protein, 613 aa, Panax ginseng
MALSLISKRTYRDAFIYVILISHVCNGFYLPGSYMHTYSTGDEIVAKVNSLTSIETELPFSYYSLPYCKPQGGIKKSAENLGELLMGDQIDNSPYRFRMNVNESVYLCTTSPLSENEVKLLKQRTRDLYQVNMILDNLPAMRFTTQNGIKIQWTGFPVGYTPPNTNDDYIINHLKFKVLVHEYEGTGVEIIGTGEEGMGIISEADKKKASGYEIVGFEVLPCSVKYDLEKMAKLHRYDNVTSLICPLELDKSQIIREQERVSFTYEVEFVKSDIRWPSRWDAYLKMEGARVHWFSILNSLMVILFLAGIVFVIFLRTVRRDLTRYDELDKEAQAQMNEELSGWKLVVGDVFREPKFSKLLCVMIGDGVQITGMAVVTIVFAAFGFMSPASRGMLLTGMIILYLFLGTGAGYAGVRLWCTIKGTSEGWRSVSWLVACFFPGIVFVILTALNFILWGSKSTGAIPISLYFIILSLWFCISVPLTLLGGYLGTRAESIQYPVRTNQIPREIPARKYPSWLLVLGAGTLPFGTLFIELFFILSSIWLGRFYYVFGFLLLVLLLLVTVCAEVSLVLTYMHLCVEDWQWWWKAFYASGSVALYVFLYSINYLVFDLQSF

SEQ ID NO: 8327 - protein, 659 aa, Gossypium raimondii
MVFPESKMPGVCWVFLLLLLFAHICDGFYLPGSYMHTYSTKDTIFAKVNSLTSIETELPFSYYSLPYCKPLGGVKKSAENLGELLMGDQIDNSPYRFRMNVNESLYLCTTSPLNEHEVKLLKQRTRGLYQVNMILDNLPVMRIAKQNGVNIQWTGFPVGYSPPNSNDDYIINHLKFKVLVHEYEGSGVEIIGTGEDGMAVFPKADKKKASGFEIVGFEVVPCSVKYDPKAMTKLHMYDKVSSVNCPLGLGKSQIIRERERISFTYEVEFVKSDIRWPSRWDAYLKMEGARVHWFSILNSLMVITFLAGIVFVIFLRTVRRDLTRYEELDKEAQAQMNEELSGWKLVVGDVFREPDCPKLLCVMIGDGVQIMGMAAVTIVFAAFGFMSPASRGMLLTGMIILYLFLGIVAGYVAVRLWRTLKGTSEGWRSVSWSVACFFPGIVFVILTVLNFILWGSKSTGAIPISLYFVLLSLWFCISVPLTLIGGFIGTRAEAIQYPVRTNQIPREIPARKYPSWLLVLGAGTLPFGTLFIELFFILSSIWLGRFYYVFGFLLIVLLLLIIVCAEVSVVLTYMHLCVEDWRWWWKAFFASGSVSLYVFLYSINYLVFDLQSLSGPVSAILYLGYSMIMAIAIMLSTGTIGFITSFYFVHYLFSSVKID

SEQ ID NO: 8328 - protein, 290 aa, Panax ginseng
MHTYSTGDEILAKVNSLTSIETELPFSYYSLPYCKPQGGIKKSAENLGELLMGDQIDNSPYRFRMNVNESVYLCTTKPLSENEVKLLKQRTRDLYQVNMILDNLPAMRFATQNGVRIQWTGFPVGYTPPNTNDDYIINHLKFKVLVHEYEGTGVQIIGTGEEGMGVISEADKKKTSGYEIVGFEVFPCSVKYDPEKMAKLHRYDNVTSLICPLELDKSQIIREQERVSFTYEVEFVKSDIKWPSRWDAYLKMEGARVHWFSILNSLVVIFFLAGIVLLFLKNGKEGSDEV

SEQ ID NO: 8329 - protein, 649 aa, Solanum phureja
YWALFVYVVLVSHASNGFYLPGSYMHTYSPNEEIVVKVNSLTSIETELPFSYYSLPYCKPPGGVKKSAENLGELLMGDQIDNSPYKFRMNVNESIYLCTTPPLNEHEVKLLKQRTRDLYQVNMILDNLPALRYANQNGLKIQWTGFPVGYSPQNSNDDYIINHLKFRVLIHEYEGAGVQIIGTGEEGMGVISETDKSKTSGFEIVGFEVVPCSVKYEPEKMTQLHMYDNTSSISCPLELDRSQIIREQERVSFTYEVEFVKSDTRWPSRWDAYLKMDGARVHWFSILNSLMVIFFLAGIVFVIFLRTVRRDLTKYEELDKEAQAQMNEELSGWKLVVGDVFREPNHSKLLCVMIGDGVQITGMAVVTIVFAAFGFMSPASRGMLLTGMILLYLFLGIAAGYVSVRAWRTIKGTSEGWRSVAWSTACFFPGIVFVILTVLNFILWGSKSTGALPISLYFILISLWFCISVPLTLLGGHLGTRAEPIQYPVRTNQIPREIPARKYPSWLLVLGAGTLPFGTLFIELFFILSSIWLGRFYYVFGFLLIVLLLLVTVCAEVSVVLTYMHLCVEDWMWWWKAFYASGSVSLYVFLYSINYLVFDLQSLSGPVSAILYLGYSLIMAVAIMLSTGTIGFLTSFYFVHYLFASVKID

SEQ ID NO: 8330 - protein, 297 aa, Triphysaria pusilla
MAPLISRKLCTTFTYLVLIIQACNGFYLPGSYMHTYSTGDEIYAKVNSLTSIETELPFSYYSLPYCKPPGGIKKSAENLGELLMGDQIDNSPYRFRMNVNESVYICTTPPLSDNDVKLLKQRTRDLYQVNMILDNLPAMRFTNQNGVKIQWTGYPVGYTPPGNNNDYIINHLKFRVLIHEYEGAGVEIIGTGEEGMGVISEADTKKAAGYEIVGFEVVPCSVKYDSDKMTKLHIYDNVTSVNCPLELDKSQIIREKERVSFTYEVEFVKSNVRWPSRWDAYLRMKGPVCTGSRFSTL

SEQ ID NO: 8331 - protein, 660 aa, Plantago ovata
MALSLILRRKVCTTFICLVFLLHACNGFYLPGSYMHTYSTGEDIYAKVNSLTSIETELPFSYYSLPYCKPRGGIKKSAENLGELLMGDQIDNSPYRFRMNVNETVYLCTTAPLSENEVKLLKQRTRDLYQVNMILDNLPAMRYTTNQQGVKIQWTGYPIGYTPENSKEDYIINHLKFRVLIHEYEGAGVEIIGTGEEGMGIVTEADKTKASGYEIVGFEVIPCSVKYDPEQMAKLHNYDNITSVSCPQELDKSQVIKEQERVSFTYDVEFIKSDIRWPSRWDAYLKMEGDRVHWFSILNSLMVIFFLAGIVFVIFLRTVRRDLTRYEELDKEAQAQMNEELSGWKLVVGDVFREPFHSKLLCVMVGDGVQILGMAVVTILFAALGFMSPASRGMLLTGMILLYLFLGIAAGYVGVRMWSTVKGSPEEWRSVSWSIACFFPGIVFLILTVLNFILWANKSTGAIPISLYFTVLSLWFCISVPLTLLGGFLGTRAEPIQFPVRTNQIPREIPARKYPSWLLVLGAGTLPFGTLFIELFFILSSIWLGRFYYVFGFLLIVFLLLIVVCAEVSVVLTYMHLCVEDWMWWWKAFYASGSVALYVFLYSINYLVFDLQSLSGPVSAILYLGYSLIMAIAIMLSTGTIGFLTSFYFVHYLFSSVKID

SEQ ID NO: 8332 - protein, 657 aa, Petroselinum crispum
MSLSSGRTCWAAFIYFLLVSRFCNGFYLPGSYMHTYSTGQEIFAKVNSLTSIETELPFSYYSLPYCKPHGGVKKSAENLGELLMGDQIDNSPYRFRMNVNESVYLCTTKPLSENEVKLLKQRTRDLYQVNMILDNLPAMRFATQNGVKIQWTGFPVGYTPPSSEDDYIINHLKFKVFVHEYEGTGVEIIGTGEEGMGVISEADTKKASGYEIVGFEVLPCSVKYDPETMAKLHIYDNVTSLNCPLDLDKSQIISEQERVSFTYEVEFVKSDIKWPSRWDAYLKMEGARVHWFSILNSLMVIFFLAGIVFVIFLRTVRRDLTKYEELDKEAQAQMNEELSGWKLVVGDVFREPNFSKLLCVMIGDGVQITGMAIVTIVFAAFGFMSPASRGMLLTGMIILYLFLGTGAGYAGVRLWCIIKGTSEGWRSVSWSVACFFPGIAFVILTALNFILWGSKSTGAIPIYLYFILLSLWFCISVPLTLLGGYLGTRAEPIKYPVRTNQIPREIPASKYPSWLLVLGAGTLPFGTLFIELFFILSSIWLGRFYYVFGFLLVVLLLLVTVCAEVSVVLTYMHLCIEDWQWWWKSFYASGSVALYVFLYSINYLVFDLQSLSGPVSAILYLGYSLLIAIAIMLSTGTIGFLTSFYFVHYLFSSVKID

SEQ ID NO: 8333 - protein, 657 aa, Aquilegia formosa
MIKMFNWYSFTAILILVCMNVVCNGFYLPGSYMHTYSSGEAIIVKVNSLTSIETELPFGYYTLPYCKPKDGIKKSAENLGELLMGDQIDNSPYRFRMNVSESVYLCTTTPLNEHDVKLFKQRTRDLYQVNMILDNLPAMRFAKQNGINIQWTGFPVGYNPPQTDDDYVINHLKFKVLVHEYEGSGVEIIGTGEEGLGVITETDKGKKSGFEIVGFEVVPCSVKRDPEVMLKMNMYDKIDPVNCPLELDKSQLIREQERISFTYEVEFVKSDIRWPSRWDAYLKMEGARVHWFSILNSLMVIFFLAGIVFVIFLRTVRRDLTKYEELDKEAQAQMNEELSGWKLVVGDVFREPNCARLLCVMVGDGTQITGMAVVTIVFAALGFMSPASRGMLLTGMIVLYLFLGIVAGYVGVRLWRTMKGTSEGWRSISWSVACFFSGIVFAILTVLNFLLWGSKSTGAIPISTYFILLFLWFCVSVPLTLLGGFLGTRAEAISYPVRTNQIPREIPARKYPSWLLVLGAGTLPFGTLFIELFFILSSIWLGRFYYVFGFLLVVLLLLVVVCAEVSVVLTYMHLCVEDWQWWWKAFFASGSVSVYVFLYSINYLIFDLQSLSGPVSATLYLGYSLIMAFAIMLSTGTIGFLISFYFVHYLFSSVKID

SEQ ID NO: 8334 - protein, 652 aa, Arabidopsis lyrata
MFGVYRVFVLLVFVSQLCNGFYLPGSYMHTYSDGDSIFAKVNSLTSIETELPFSYYSLPYCKPLEGIKKSAENLGELLMGDQIDNSAYRFRMRTNESLYLCTTSPLNEHEVKLLKQRTRELYQVNMILDNLPALRFAKQNGVTIQWTGYPVGYSPPNSNDDYIINHLKFKVLVHEYEGNVMEVIGTGEEGMGVISEADKKKALGYEIVGFEVVPCSVKYDPAKMTKLHMYDPVPSVNCPLELDKAQIIKEHERITFTYEVEFVKSETRWPSRWDAYLKMEGARVHWFSILNSLMVIFFLAGIVFVIFLRTVRRDLTKYEELDKEAQAQMNEELSGWKLVVGDVFREPEMSKLLCIMVGDGVRITGMAVVTIVFAALGFMSPASRGMLLTGMIILYLFLGIAAGYAGVRLWRTVKGTSEGWRSLSWSIACFFPGIAFVILTVLNFLLWSSNSTGAIPISLYFELLALWFCISVPLTLFGGFLGTRAEAIQFPVRTNQIPREIPERKYPSWLLVLGAGTLPFGTLFIELFFIFSSIWLGRFYYVFGFLLIVLLLLVVVCAEVSVVLTYMHLCVEDWRWWWKAFYASGSVALYVFAYSINYLVFDLQSLSGPVSAMLYIGYSLLMAIAIMLATGTIGFLTSFYFVHYLFSSVKID

SEQ ID NO: 8335 - protein, 652 aa, Arabidopsis thaliana
MFGVYRVFVLLVFVSQLCNGFYLPGSYMHTYSDGDSIFAKVNSLTSIETELPFSYYSLPYCQPLEGIKKSAENLGELLMGDQIDNSAYRFRMRTNESLYLCTTSPLNEHEVKLLKQRTRELYQVNMILDNLPALRFAKQNGVTIQWTGYPVGYSPPNSNDDYIINHLKFKVLVHEYEGNVMEVIGTGEEGMGVISEADKKKALGYEIVGFEVVPCSVKYDAEKMTKLHMYDPVPSVNCPLELDKAQIIKEHERITFTYEVEFVKSETRWPSRWDAYLKMEGARVHWFSILNSLMVIFFLAGIVFVIFLRTVRRDLTKYEELDKEAQAQMNEELSGWKLVVGDVFREPEMSKLLCIMVGDGVRITGMAVVTIVFAALGFMSPASRGMLLTGMIILYLFLGIVAGYAGVRLWRTVKGTSEGWRSLSWSIACFFPGIAFVILTVLNFLLWSSNSTGAIPISLYFELLALWFCISVPLTLFGGFLGTRAEAIQFPVRTNQIPREIPERKYPSWLLVLGAGTLPFGTLFIELFFIFSSIWLGRFYYVFGFLLIVLLLLVVVCAEVSVVLTYMHLCVEDWRWWWKAFYASGSVALYVFAYSINYLVFDLQSLSGPVSAMLYIGYSLLMAIAIMLATGTIGFLTSFYFVHYLFSSVKID

SEQ ID NO: 8336 - protein, 659 aa, Mimulus guttatus
MALPLMSKRKLHAALILLVQILQVCNGFYLPGSYMHTYSTGDEIYAKVNSLTSIETELPFSYYSLPYCQPMGGIKKSAENLGELLMGDQIDNSPYRFRMNVNETVFLCTTPPLNEEQVKLLKQRTRDMYQVNMVLDNLPAMRFTNQNGVKIQWTGYPIGYNPENSNDDYFINHLRFRVLIHEYEGVGVEIIGTGEEGMGVISEAENKKGLGYEIVGFEVVPCSVKYDPDKMAKIHMYDNITSVSCPHELDKSQVIKEQERVSFTYEVEFVKSDIRWPSRWDAYLKMEGDRVHWFSILNSLMVIFFLAGIVFVIFLRTVRRDLTRYEELDKEAQAQMNEELSGWKLVVGDVFREPSNSKLLCVMVGDGVQITGMAVVTIVFAALGFMSPASRGMLLTGMILLYLFLGIAAGYIGVRMWRTIKGSSEGWRSVSWSIACFFPGIVFVILTFLNFILWGSKSTGAIPISLYFILLSLWFCISVPLTLLGGHLGTRAEPIQFPVRTNQIPREIPSRKYPSWLLVLGAGTLPFGTLFIELFFILSSIWLGRFYYVFGFLLIVLTLLVVVCAEVSVVLTYMHLCVEDWMWWWKAFFASGSVSLYVFLYSINYLVFDLQSLSGPISATLYIGYSLIMAIAIMLSTGTIGLLTSFYFVHYLFSSVKID

SEQ ID NO: 8337 - protein, 661 aa, Triphysaria pusilla
MTLPSSSRRKLCTAFTYLALIFQACNGFYLPGSLLLSITYSTGDEIYAKVNSLTSIETELPFSYYSLPYCKPIGGIKKSAENLGELLMGDQIDNSPYRFRMNVNESVYICTTPPLSDNDVKLLKQRTRDLYQVNMILDNLPAMRFTNQNGVKIQWTGYPVGYTPPGSNDDYIINHLKFRVLIHEYEGAGVEIIGTGEEGMGVISEADKTKAAGYEIVGFEVVPCSVKYDSDKMTKLHIYDNVTSVNCPLELDKSQIIREKERVSFTYEVEFVKSDVRWPSRWDAYLKMEGARVHWFSILNSLMVIFFLAGIVFVIFLRTVRRDLTRYEELDKEAQAQMNEELSGWKLVVGDVFREPSHSTLLCVMVGDGVQITGMAVVTIVFAAFGFMSPASRGMLLTGMILLYLFLGIASGYVSVRMWTTIKGSSEGWRSISWKTACFFPGIIFVILTFLNFILWGSNSTGAIPISLYFILFSLWFCISVPLTLLGGHFGTRAEPITYPVRTNQIPREIPARKYPSWLLVLGAGTLPFGTLFIELFFILSSIWLGRFYYVFGFLLIVLTLLVVVCAEVSVVLTYMHLCVEDWMWWWKAFYASGSVALYVFLYSINYLVFDLQSLSGPVSATLYLGYSLIMAVAIMLSTGTIGFLTSFYFVHYLFSSVKID

SEQ ID NO: 8338 - protein, 659 aa, Solanum lycopersicum
MASPLISTRRYWAVFIYVVLVSHASNGFYLPGSYMHTYSPNEEILVKVNSLTSIETELPFSYYSLPYCKPPGGVKNSAENLGELLMGDQIDNSPYRFRMNVNESIYLCTTPPLNEHEVKLLKQRTRDLYQVNMILDNLPALRYANQNGLKIQWTGFPVGYSPQNSNDDYIINHLKFRVLIHEYEGAGIQIIGTGEEGMGVISETDKSKTSGFEIVGFEVVPCSVKYEPEKMTKLHMYDNTSSISCPLELDRSQIIREQERVSFTYEVEFVKSDTRWPSRWDAYLKMDGARVHWFSILNSLMVIFFLAGIVFVIFLRTVRRDLTKYEELDKEAQAQMNEELSGWKLVVGDVFREPNHSKLLCVMIGDGVQITGMAVVTIVFAAFGFMSPASRGMLLTGMILLYLFLGIAAGYVSVRAWRTIKGTSESWRSVAWSTACFFPGIVFVILTVLNFILWGSKSTGALPISLYFILISLWFCISVPLTLVGGYLGTRAEPIQYPVRTNQIPREIPARKYPSWLLVLGAGTLPFGTLFIELFFILSSIWLGRFYYVFGFLLIVLLLLVTVCAEVSVVLTYMHLCVEDWMWWWKAFYASGSVSLYVFLYSINYLVFDLQSLSGPVSAILYLGYSLIMAVAIMLSTGTIGFLTSFYFVHYLFASVKID

SEQ ID NO: 8339 - protein, 657 aa, Petroselinum crispum
MPLILEKTCWAAFIYVLLISHSCNGFYLPGSYMHTYSTGQEIFAKVNSLTSIETELPFSYYSLPYCKPQGGVKKSAENLGELLMGDQIDNSPYHFRMNINESVYLCTTSPLSENEVKLLKQRTRDLYQVNMILDNLPAMRFATQNGVKIQWTGFPVGYTPPSSEDDYIINHLKFKVFVHEYEGTGVEIIGTGEEGMGVISEADTKKASGYEIVGFEVLPCSVKYDPETMAKLHIYDNVTSLNCPLDLDKSQIISEQERVSFTYEVEFVKSDIKWPSRWDAYLKMEGARVHWFSILNSLMVIFFLAGIVFVIFLRTVRRDLTKYEELDKEAQAQMNEELSGWKLVVGDVFREPNFSKLLCVMIGDGVQITGMAIVTIVFAAFGFMSPASRGMLLTGMIILYLFLGTGAGYAGVRLWCIIKGTSEGWRSVSWSVACFFPGIAFVILTALNFILWGSKSTGAIPIYLYFILLSLWFCISVPLTLLGGYLGTRAEPIKYPVRTNQIPREIPASKYPSWLLVLGAGTLPFGTLFIELFFILSSIWLGRFYYVFGFLLVVLLLLVTVCAEVSVVLTYMHLCIEDWQWWWKSFYASGSVALYVFLYSINYLVFDLQSLSGPVSAILYLGYSLLIAIAIMLSTGTIGFLTSFYFVHYLFSSVKID

SEQ ID NO: 8340 - protein, 649 aa, Brassica napus
MYRVIVLLVFVAQLCNGFYLPGSYMHTYSNGDSIFAKVNSLTSIETELPFSFYSLPYCKPLEGIKKSAENLGELLMGDQIDNSAYRFRMNTNESLYLCTTSPLNEHEVKLLKQRTRELYQVNMILDNLPALRFAKQNGVTIQWTGYPVGYSPPNSNDDYIINHLKFKVLVHQYEGNVMEVIGTGEEGMGVISEADKKKALGYEIVGFEVVPCSVKYDPEKMTKLHMYDPAPSVNCPLELDKAQIIKEHERITFTYEVEFVRSETRWPSRWDAYLKMEGARVHWFSILNSLMVIVFLAGIVFVIFLRTVRRDLTKYEELDKEAQAQMNEELSGWKLVVGDVFREPELSKLLCIMVGDGVQITGMAVVTIVFAALGFMSPASRGMLLTGMIILYLFLGIAAGYAGVRLWRTVKGTSEGWRSLSWSIACFFPGIAFVILTVLNFLLWSSNSTGAIPISLYFELLALWFCISVPLTLFGGFLGTRAEAIQFPVRTNQIPREIPERKYPSWLLVLGAGTLPFGTLFIELFFIFSSIWLGRFYYVFGFLLIVLLLLVVVCAEVSVVLTYMHLCVEDWRWWWKAFFASGSVALYVFAYSINYLVFDLQSLSGPVSAMLYIGYSLLMAIAIMLSTGTIGFLTSFYFVHYLFSSVKID

SEQ ID NO: 8341 - protein, 652 aa, Euonymus alatus
MPNIFQALLFLVFFAHACFGFYLPGSYMHTYAPRQHIFAKVNSLTSIETELPFSYYSLPYCEPQGGIKKSAENLGELLMGDQIDNSPYRFRMNVNETVYLCTTNPLSEHEVKLLKQRARDLYQVNMILDNLPVMRYATENGVKIQWTGFPIGYTPSNSNEDYIINHLKFTVFVHEYEGSGVEIIGTGEEGMGVISEADKNKASGFEIVGFEVQPCSIKYDPVVMTKLHMYDNISAVSCPSEIGKSQIIRDQERVSFTYEVEFVKSDIRWPSRWDAYLKMEGARVHWFSILNSLMVIFFLAGIVFVIFLRTVRRDLTRYEELDKEAQAQMNEELSGWKLVVGDVFREPEYSKLLCVMVADGVQIMGMAVVTIVFAALGFMSPASRGMLLTGMIILYLFLGIIAGYVGVRMWRTIKGTSEGWKAVSWSVACFFPGIVFIILTALNFLLWGSNSTGAIPISTYFILLALWFCISVPLTLLGGVFGTRAEAIQYPVRTNQIPREIPVRKYPSWLLVLGAGTLPFGTLFIELFFILSSIWLGRFYYVFGFLLIVLSLLVVVCAEVSVVLTYMHLCVEDWRWWWKSFFASGSVSLYVFLYSINYLVFDLQSLSGPVSAMLYLGYSLLMAVAIMLSTGAIGFLMSFYFVHYLFSSVKID

SEQ ID NO: 8342 - protein, 659 aa, Orobanche aegyptiaca
MAVPLMSRRKFSTAFTYLLFILQACSGFYLPGSYMHTYSTGDEIYAKVNSLTSIETELPFSYYSLPYCKPRGGIKKSAENLGELLMGDQIDNSPYRFRMNVNESIYICTTPPLRENEVKLLKQRTRDLYQVNMILDNLPAMRFTNQNGIKIQWTGYPVGYTPPGSNDDYIINHLKFRVLIHEYEGAGVEIIGTGEEGMGVISEADKKKAAGYEIVGFEVVPCSVKYDPEKMTKLHIYDSVTSVNCPLELDKSQIIREQERVSFTYEVEFVKSDIRWPSRWDAYLKMEGARVHWFSILNSLMVIFFLAGIVFVIFLRTVRRDLTRYEELDKEAQAQMNEELSGWKLVVGDVFREPSHTKLLCVMVGDGIQITGMAVVTIVFAAFGFMSPASRGMLLTGMILLYLFLGIAAGYTSVRMWTTIKGSSEGWKSVSWSTSCFFPGIVFVILTFLNFILWGNNSTGAIPISLYFILFSLWFCISVPLTLLGGHFGTRAELIKYPVRTNQIPREIPSRKYPSWLLVLGAGVLPFGTLFIELFFILSSIWLGRFYYVFGFLLIVLLLLVVVCAEVSVVLTYMHLCVEDWMWWWKAFYASGSVALYVFLYSINYLVFDLQSLSGPVSATVYLGYSLIMAVAIMLSTGTIGFLTSFYFVHYLFSSVKID

SEQ ID NO: 8343 - protein, 654 aa, Populus trichocarpa
MRAPMICWAFLLLALFGNACNGFYLPGSYMHTYSPGDAIFAKVNSLTSIETELPFSYYSLPYCQPKEGVKKSAENLGELLMGDQIDNSPYRFRMNVNESVYLCTTKPLSEHEVKLLKQRTHDLYQVNMILDNLPVMRYAKQNEIDIQWTGFPVGYTPQNSNDDYIINHLKFTVLVHEYEGSGVEIIGTGEEGLGVISEADEKKASGFEIVGFVVVPCSVKYDPDAMIKHQIYDNVSSVSCPLDLDKSQIIREQERISFTYEVEFVKSEIRWPSRWDAYLKMEGARVHWFSILNSLMVIFFLAGIVFIIFLRTVRRDLTRYEELDKEAQAQMNEELSGWKLVVGDVFREPDCSKLLCIMVGDGVQITGMAVVTIIFAAFGFMSPASRGMLLTGMILLYLFLGIVAGYVAVRLWRTIKGTSEGWRSVSWSVACFFPGIVFVILTILNFILWGSQSTGAIPISLYFVLLALWFCISVPLTLLGGFMGTRAEAIQYPVRTNQIPREIPARKLPSWVLVLGAGTLPFGTLFIELFFILSSIWLGRFYYVFGFLLIVLLLLVIVCAEVSVVLTYMHLCVEDWRWWWKAFFASGSVSIFVFLYSINYLVFDLQSLSGPVSAILYLGYSLIIAVAIMLSTGTIGFLTSFYFVHYLFSSVKID

SEQ ID NO: 8344 - protein, 649 aa, Brassica oleracea
MYRVIVLLVFVAQLCNGFYLPGSYMHTYSNGDSIFAKVNSLTSIETELPFSFYSLPYCKPLEGIKKSAENLGELLMGDQIDNSAYRFRMNTNESLYLCTTSPLNEHEVKLLKQRTRELYQVNMILDNLPALRFAKQNGVTIQWTGYPVGYSPPNSNDDYIINHLKFKVLVHQYEGNVMEVIGTGEEGMGVISEADKKKALGYEIVGFEVVPCSVKYDPEKMTKLHMYDPAPSVNCPLELDKAQIIKEHERITFTYEVEFVRSETRWPSRWDAYLKMEGARVHWFSILNSLMVIVFLAGIVFVIFLRTVRRDLTKYEELDKEAQAQMNEELSGWKLVVGDVFREPQLSKLLCIMVGDGVRITGMAVVTIVFAALGFMSPASRGMLLTGMIILYLFLGIAAGYAGVRLWRTVKGTSEGWRSLSWSIACFFPGIAFVILTVLNFLLWSSNSTGAIPISLYFELLALWFCISVPLTLFGGFLGTRAEAIQFPVRTNQIPREIPERKYPSWLLVLGAGTLPFGTLFIELFFIFSSIWLGRFYYVFGFLLIVLLLLVVVCAEVSVVLTYMHLCVEDWRWWWKAFFASGSVALYVFAYSINYLVFDLQSLSGPVSAMLYIGYSLLMAIAIMLSTGTIGFLTSFYFVHYLFSSVKID

SEQ ID NO: 8345 - protein, 659 aa, Cocos nucifera
MAPLMISKRHFSLLPLFFLLITCPSNGFYLPGSYMHTYSQREPISVKVNSLTSIETELPFSYYSLPYCQPKGGIKKSAENLGELLMGDQIDNSPYTFHMNVNESLYLCTTKPLNEHEVKLLKQRTRDLYQVNMILDNLPVMRFTQQNDVTIQWTGFPVGYTPTGSNDDYIINHLKFKVLVHEYEGSGVEIIGTGEEGMGMPSETDKKKMSGYEIVGFEVIPCSVKRDAERMSKHNMYDQIEPVNCPLELDKCQVIKEQERITFTYDVEFVKSDIRWPSRWDAYLKMDGAKVHWFSIMNSLMVIFFLAGIVFVIFLRTVRRDLTRYEELDKEAQAQMNEELSGWKLVVGDVFREPTCSKLLCVMVGDGVQITCMAVVTIVFAALGFMSPASRGMLLTGMILLYLFLGIFAGYTGVRLWSTIKGGSEGWRSVAWSIACFFPGMVFVILTFLNLLLWWNNSTGALPISLYFTLLSLWFCISVPLILLGGFLGTRAEPIQFPVRTNQIPREIPARKYPSWLLVLGAGTLPFGTLFIELFFILSSIWLGRFYYVFGFLLIVLLLLVIVCAEVSVVLTYMHLCVEDWRWWWKAFFASGSVALYVLLYSINYLVFDLKSLSGPVSAMLYLGYSLIMAVAIMLSTGTIGFLMSFYFVHYLFSSVKID

SEQ ID NO: 8346 - protein, 659 aa, Cyclamen graecum
MAGSMASKRTYWVTFIFVFLVSRICNAFYLPGSYMHTYSNGEEIVAKVNSLTSIETELPFSYYSLPYCKPLKGIKKSAENLGELLMGDQIDNSPYRFRMNVNESVFLCTTSPLSENEVKLLKQRTRDLYQVNMILDNLPAMRYAQQNGVKIQWTGFPVGYTPQNSNEDYIINHLKFRVLVHEYEGTGVEIIGTGEEGMGIISEADKKKASGYEIVGFEVVPCSVKYEPAVMEKLHMYDSITPVNCPLELEKSQIIKEQERVSFTYEVEFVKSDIRWPSRWDAYLKMEGARVHWFSILNSLMVIFFLAGIVFVIFLRTVRRDLTRYEELDKEAQAQMNEELSGWKLVVGDVFREPNHSKLLCVMIGDGVQITGMAVVTIVFAALGFMSPASRGMLLTGMIILYLFLGIGAGYAGVRLWTTIKGNPDGWRSVSWAIACFFPGIVFVILTGLNFLLWGSQSTGAIPISLYFILLALWFCISVPLTLLGGYFGTRAEPISFPVRTNQIPREIPARKYPSWLLVLGAGTLPFGTLFIELFFILSSIWLGRFYYVFGFLFVVLLLLVVVCAEVSLVLTYMHLCVEDWQWWWKAFYASGSVALYVFLYSINYLVFDLQSLSGPVSAMLYLGYSLIMAVAIMLATGTIGFITSFYFVHYLFSSVKID

SEQ ID NO: 8347 - protein, 659 aa, Mimulus guttatus
MALPLISGRNLCISFSYLVLIFQACNGFYLPGSYMHTYSTGDEIYAKVNSLTSIETELPFSYYSLPYCQPPGGIKKSAENLGELIMGDQIDNSPYRFRMNVNESVYICTSPPLSEHDVKLLKQRTRDLYQVNMILDNLPAMRYTNQNGVKIQWTGYPVGYSPLNSNDDYFINHLKFRVLIHEYEGAGVEIIGTGEEGMGVISEADKKKASGYEIVGFEVVPCSVKYDPDKMEKLHIYDNVTSVNCPLDAERSQIIRDKERVSFTYEVEFVKSNIRWPSRWDAYLKMEGARVHWFSILNSLMVILFLAGIVFVIFLRTVRRDLTRYEELDKEAQAQMNEELSGWKLVVGDVFREPSHSKLLCVMVGDGVQITGMAVVTIVFAALGFMSPASRGMLLTGMILLYLFLGIAAGYVGARMWTTIKGSPEGWRSVAWSTACFFPGIVFVILTILNFILWGSNSTGAIPISLYFILLSLWFCISVPLTLVGGHLGTKAEPIQFPVRTNQIPREIPARKYPSWLLVLGAGTLPFGTLFIELFFILSSIWLGRFYYVFGFLLIVLSLLVVVCAEVSVVLTYMHLCVEDWMWWWKAFYASGSVALYVFLYSINYLVFDLQSLSGPVSATLYLGYSLIMAVAIMLSTGTIGFLTSFYFVHYLFSSVKID

SEQ ID NO: 8348 - protein, 654 aa, Tropaeolum majus
MKMGPIFRSFLFVVFFAHVSNGFYLPGSYMHTYSPSEEIYAKVNSLTSIETELPFSYYSLPYCKPSGGIKKSAENLGELLMGDQIDNSPYRFRMNVNESIYLCTTDPLTENEVKLLKQRTRDLYQVNMILDNLPAMRYAKQNGMNIQWTGYPVGYTPPGSKDDYIINHLKFKVLVHEYEGSGVEIIGTGEEGMGVISEADKKKASGFEIVGFEVIPCSVKYDAGKMKKLNMYDTVTPVNCPLELEKSQIIKEKERVSFTYEVEFAKSDTRWPSRWDAYLKMEGARVHWFSILNSLMVIFFLAGIVFVIFLRTVRRDLTRYEELDKEAQAQMNEELSGWKLVVGDIFREPDFPKLLCVMVGDGVQITGMAVVTIVFAALGFMSPASRGMLLTGMIILYLFLGIISGYVGVRMWRTIKGTTEGWRSLSWSVACFFPGIVFVILTALNFLLWANKSTGAIPISLYFILLSLWFCISVPLTLFGGFLGTRAEEITFPVRTNQIPREIPARKYPSWLLVLGAGTLPFGTLFIELFFILSSIWLGRFYYVFGFLLIVLILLVIVCAEVSVVLTYMHLCVEDWRWWWKAFFASGSVALYVFLYSINYLVFDLQSLSGPVSAMVYLGYSLIMAIAIMLSTGTIGFLMSFYFVHYLFSSVKID

SEQ ID NO: 8349 - protein, 659 aa, Prunus persica
MAISNPRVTYIKWTMLVLALFAHSCNGFYLPGSYMHTYSKAQEIVTKVNSLTSIETELPFSYYSLPYCKPPEGIKKSAENLGELLMGDEIENSAYRFKMNVNKTLYLCTTHPLTEHDVKLLKQRTRDLYQVNMILDNLPAMRYAYQNGVKIQWTGFPVGYTPPNSKDDYIINHLKFRVLIHEYEGSGVQIIGTGEEGPGVISEADKKKASGFEIVGFEVYPCSIKYDPDTMKKKSMYQSIPDVNCPSELEKSQIIREQERVSFTYQVEFVKSDIRWPSRWDAYLKMEGARVHWFSILNSLMVIFFLAGIVFVIFLRTVRRDLTRYEELDKESQAQMNEELSGWKLVVGDVFREPDSSKLLCVMVGDGVQITGMAVVTIIFAAFGFMSPASRGMLLTGMIILYLFLGIIAGYVAVRMWRTIKGTSEGWRSVSWFVACFFPGIVFLILTVLNFILWGSNSTGALPISLFFVLLSLWFCISVPLTLLGGFLGTRAEAIQYPVRTNQIPREIPARKYPSWLLVLGSGTLPFGTLFIELFFILSSIWLGRFYYVFGFLLIVLLLLVIVCAEVSVVLTYMHLCVEDWRWWWKAFFASGSVSLYVFLYSINYLVFDLQSLSGPVSAILYLGYSLIMATAIMLSTGTIGFLMSFYFVHYLFSSVKID

SEQ ID NO: 8350 - protein, 654 aa, Valeriana officinalis
MALSMILRALILYFCISQTCNGFYLPGSYMHTYSEGEEIFAKVNSLTSIETELPFGYYTLPYCKPIGGIKKSAENLGELLMGDQIDNSPYRFRMNKNESIYLCTTSPLNEHEVKLLKQRTRDLYQVNMILDNLPAMRFANQNGIKIQWTGFPVGYTPPNSNDDYIINHLKFKVLVHEYEGTGVEIIGTGEEGMGIISQSDKKASGYEIVGFEVYPCSVKYDPVKMEKLHIYDNATSVNCPLDLEKSQIIREQERISFTYEVEFVKSDTRWPSRWDAYLKMEGARVHWFSILNSLMVIFFLAGIVFVIFLRTVRRDLTRYEELDKESQAQMNEELSGWKLVVGDVFREPNCAKLLCVMVGDGVQITGMTAVTIVFAAFGFMSPASRGMLLTGMIILYLFLGTFAGYSSVRLWQTLKGGNSDEWRSVSWLTACFFPGIVFVILTFLNFILWGSKSTGAIPISLYFILLSLWFCISVPLTLLGGYMGKRAEIITFPVRTNQIPREIPARKYPSWILVLGAGTLPFGTLFIELFFILSSIWLGRFYYVFGFLLVVLLLLVTVCAEVSVVLTYMHLCVEDWRWWWKAFYASGSVSLYVFLYSINYLVFDLQSLSGPVSAILYLGYSLIIAVAIMLSTGTIGFLTSFYFVHYLFSSVKID

SEQ ID NO: 8351 - protein, 625 aa, Cocos nucifera
MHTYSEGEPISVKVNSLTSIETELPFSYYGLPYCQPKDGIKKSAENLGELLMGDQIDNSPYRFRVNVNESLYLCTTKPLTELEVKLLKQRSRDLYQVNMILDNLPVMRYTQQNGVTIQWTGFPVGYTPIGSNDDYIINHLKFKVLVHEYEGSGVEIIGTGEEGMGVISETDKKKMSGYEIVGFEVTPCSAKRDPESMLKHNMYDTIEPVNCPLELDKCQMIKEQERITFTYEVEFVKSDIRWPSRWDAYLKMDGAKVHWFSIMNSLMVIFFLAGIVFVIFLRTVRRDLTRYEELDKEAQAQMNEELSGWKLVVGDVFREPTCSKLLCVMVGDGVQITCMAVVTIVFAALGFMSPASRGMLLTGMILLYLFLGIFAGYVGVRLWSTIKGGSEGWRSVAWLIACFFPGIVFMVLTFLNFLLWWNKSTGALPISLYFTLLSLWFCISVPLTLLGGFFGTRAEPIQFPVRTNQIPREIPARKYPSWLLVLGAGTLPFGTLFIELFFILSSIWLGRFYYVFGFLLIVLLLLVIVCAEVSVVLTYMHLCVEDWRWWWKAFFASGSVALYVFLYSINYLVFDLKSLSGPVSAMLYLGYSLIMAVAIMLSTGTIGFLMSFYFVHYLFSSVKID

SEQ ID NO: 8352 - protein, 649 aa, Brassica napus
  Sequence also found in Organisms: Brassica rapa
MYGVFVLLVFVAQVCDGFYLPGSYMHTYSNGDSILAKVNSLTSIETELPFSFYSLPYCKPLEGIKKSAENLGELLMGDQIDNSAYRFRMNTNESLYLCTTSPLNEHEVKLLKQRTRELYQVNMILDNLPALRFAKQNGVTIQWTGYPVGYSPPNSNDDYIINHLKFKVLVHQYEGNVMEVIGTGEEGMGVISEADKKKALGYEIVGFEVVPCSVKYDPEKMTKLHMYDPVPSVNCPLELDKAQIIKEHERITFTYEVEFVRSETRWPSRWDAYLKMEGARVHWFSILNSLMVIVFLAGIVFVIFLRTVRRDLTKYEELDKEAQAQMNEELSGWKLVVGDVFREPQLSKLLCIMVGDGVRITGMAVVTIVFAALGFMSPASRGMLLTGMIILYLFLGIAAGYAGVRLWRTVKGTSEGWRSLSWSIACFFPGIAFVILTVLNFLLWSSNSTGAIPISLYFELLALWFCISVPLTLFGGFLGTRAEAIQFPVRTNQIPREIPERKYPSWLLVLGAGTLPFGTLFIELFFIFSSIWLGRFYYVFGFLLIVLLLLVVVCAEVSVVLTYMHLCVEDWRWWWKAFFASGSVALYVFAYSINYLVFDLQSLSGPVSAMLYIGYSLLMAIAIMLSTGTIGFLTSFYFVHYLFSSVKID

SEQ ID NO: 8353 - protein, 659 aa, Prunus mume
MAISNPRVTYIKWTLLVLALFAHTCNGFYLPGSYMHTYSKAQEIITKVNSLTSIETELPFSYYSLPYCKPPKGIKKSAENLGELLMGDEIENSAYRFKMNVNETVYLCTTHPLTEHDVKLLKQRTRDLYQVNMILDNLPAMRYAYQNGVKIQWTGFPVGYTPPNSKDDYIINHLKFRVLIHEYEGSGVQIIGTGEEGPGVISEAEKKKASGFEIVGFEVYPCSIKYDPDTMKKKSIYQSIPAVNCPSELEKYQIIREQERVSFTYEVEFVKSDIRWPSRWDAYLKMEGARVHWFSILNSLMVIFFLAGIVFVIFLRTVRRDLTRYEELDKESQAQMNEELSGWKLVVGDVFREPDSSKLLCVMVGDGVQITGMAVVTIIFAAFGFMSPASRGMLLTGMIILYLFLGIIAGYVAVRMWRTIKGTSEGWRSVSWFVACFFPGIVFLILTVLNFILWGSNSTGALPISLFFVLLSLWFCISVPLTLLGGFLGTRAEAIQYPVRTNQIPREIPARKYPSWLLVLGAGTLPFGTLFIELFFILSSIWLGRFYYVFGFLLIVLLLLVIVCAEVSVVLTYMHLCVEDWRWWWKAFFASGSVSLYVFLYSINYLVFDLQSLSGPVSAILYLGYSLIMATAIMLSTGTIGFLMSFYFVHYLFSSVKID

SEQ ID NO: 8354 - protein, 652 aa, Eutrema halophilum
MFALYRVFVLLVFVCQLCNGFYLPGSYMHTYSNGDSILAKVNSLTSIETELPFSFYSLPYCKPLEGIKKSAENLGELLMGDQIDNSAYRFRMNTNESLYLCTTSPLNEHEVKLLKQRTRELYQVNMILDNLPALRFAKQNGVTIQWTGYPVGYSPPNSNDDYIINHLKFKVLVHEYEGNVMEVIGTGEEGMGVISEADKKKALGYEVVGFEVVPCSVKYDPAKMTKLHMYDPVTSVNCPLELEKAQIIKEHERITFTYEVEFVRSETRWPSRWDAYLKMEGARVHWFSILNSLMVIFFLAGIVFVIFLRTVRRDLTKYEELDKEAQAQMNEELSGWKLVVGDVFREPELSKLLCIMVGDGVRITGMAVVTIVFAALGFMSPASRGMLLTGMIILYLFLGIAAGYAGIRLWRTVKGTSEGWRSLSWSIACFFPGIAFVILTVLNFLLWSSNSTGAIPISLYFELLALWFCISVPLTLFGGFLGTRAETIQFPVRTNQIPREIPERKYPSWLLVLGAGTLPFGTLFIELFFIFSSIWLGRFYYVFGFLLIVLLLLVVVCAEVSVVLTYMHLCVEDWRWWWKAFYASGSVALYVFAYSINYLVFDLQSLSGPVSAMLYIGYSLLMAIAIMLATGTIGFLTSFYFVHYLFSSVKID

SEQ ID NO: 8355 - protein, 659 aa, Vinca minor
MALSSICKRKYWAALIYLSLASHLCHGFYLPGTYMHTYTPAEEITVKVNSLTSIETELPFSYYSLPYCQPQGGIKKSAENLGELLMGDQIDNSPYRFKMNVNQSLYLCTTPPLSENEVKLLKQRTHDMYQVNLILDNLPAMRYANQNGVKVQWTGFPVGYRPPGGTEDYIINHLQFKVLIHEYEGAGVEIIGTGEEGMGVISEADKKKASGYEIVGFEVIPCSVKYDPEKMTKLHMYDTVPSVSCPLELSQSQVIRQQERVSFTYEVEFVKSNIRWPSRWDAYLKMEGSRVHWFSILNSLMVIFFLAGIVFVIFLRTVRRDLTRYEELDKEAQAQMNEELSGWKLVVGDVFREPNHSKLLSVMVGNGVQILGMAAVSIVFAALGFMSPASRGMLLTGMILVYLFLGISAGYAGVRMWRTIKGTSEGWRSVSWSISCFFPGIVFVILTVLNFILWGSKSTGAIPISLYFILLSLWFCISVPLTLLGGFLGTKAEPIQYPVRTNQIPREIPARKYPSWLLVLGAGTLPFGTLFIELFFILSSIWLGRFYYVFGFLLIVLLLLVIVCAEVSLVLTYMHLCVEDWMWWWKAYYASGSVALYVFLYSINYLVFDLQSLSGPVSAALYIGYSLIMAIAIMLATGAIGFLTSFYFVHYLFSSVKID

SEQ ID NO: 8356 - protein, 652 aa, Eutrema parvulum
MFALYRVFVLLVFVCQLCNGFYLPGSYMHTYSNGDSILAKVNSLTSIETELPFSFYSLPYCKPLEGIKKSAENLGELLMGDQIDNSAYRFRMNTNESLYLCTTSPLNEHEVKLLKQRTRELYQVNMILDNLPALRFAKQNGVTIQWTGYPVGYSPPNSNDDYIINHLKFKVLVHQYEGNVMEVIGTGEEGMGVISEADKKKALGYEIVGFEVVPCSVKYDPKKMMKLHMYDPVTSVNCPLELDKAQIIKEHERITFTYEVEFVRSETRWPSRWDAYLKMEGARVHWFSILNSLMVIFFLAGIVFVIFLRTVRRDLTKYEELDKEAQAQMNEELSGWKLVVGDVFREPELSKLLCIMVGDGVRITGMAVVTIVFAALGFMSPASRGMLLTGMIILYLFLGIAAGYAGVRLWRTVKGTSEGWRSLSWSIACFFPGIAFVILTVLNFLLWSSNSTGAIPISLYFELLALWFCISVPLTLFGGFLGTRAEAIQFPVRTNQIPREIPERKYPSWLLVLGAGTLPFGTLFIELFFIFSSIWLGRFYYVFGFLLIVLLLLVVVCAEVSVVLTYMHLCVEDWRWWWKSFFASGSVALYVFAYSINYLVFDLQSLSGPVSAMLYIGYSLLMAIAIMLATGTIGFLTSFYFVHYLFSSVKID

SEQ ID NO: 8357 - protein, 626 aa, Tripterygium wilfordii
YMHTYAPGQPILAKVNSLTSIETELPFSYYSLPYCKPPGGIKKSAENLGELLMGDQIDNSPYRFRMNINETVYLCTTNPLSEHEVKLLKQRTRDLYQVNMILDNLPVMRYATENGIKIQWTGFPVGYTPGNSNDDYIINHLKFTVLVHEYEGSGVEIIGTGEEGMGVISEADKKKASGFEIVGFEVQPCSIKYDPEVMTKHHTYDNISSVSCPSELDKSQIIRDQERVSFTYEVEFVKSDIRWPSRWDAYLKMEGARVHWFSILNSLMVIFFLAGIVFVIFLRTVRRDLTRYEELDKESQAQMNEELSGWKLVVGDVFREPECSKLLCVMVADGVQIMGMAVVTIVFAALGFMSPASRGMLLTGMIILYLFLGIIAGYVGVRMWRTIKGTSEGWKSVSWSVACFFPGIVFIILTALNFLLWGSNSTGAIPISMYFVLLALWFCISVPLTLLGGLFGTRAEAIQYPVRTNQIPREIPARKYPSWLLVLGAGTLPFGTLFIELFFILSSIWLGRFYYVFGFLLIVLSLLVVVCAEVSVVLTYMHLCVEDWRWWWKSFFASGSVSLYVFLYSINYLVFDLQSLSGPVSAMLYLGYSLLMAVAIMLSTGAIGFLMSFYFVHYLFSSVKID

SEQ ID NO: 8358 - protein, 658 aa, Musa acuminata
MAPFSISLRSSCFILVALLILGPSYAFYLPGSYMHTYSQGETITVKVNSLTSFETELPFSYYSLPYCQPQDGIKKSAENLGELLMGDQIDNSPYQFHVNVNESFYLCTTNPLNEREVKLLKQRTRDLYQVNMILDNLPVRRFTEQNGATFQWTGFPVGYTPSGSSEDYIINHLKFKVLVHEYEGSRVEIIGTGEEGMGVISETEKQKMSGYEIVGFEVVPCSVKRDPEAMSKLNIYSKVGPVDCPLELEKSQAIREQEKISFTYEVVFVKSDVRWPSRWDAYLKMEGARVHWFSIMNSLMVIFFLAGIVFVIFLRTVRRDLTRYEELDKESQAQMNEELSGWKLVVGDVFREPTNSKLLCVMVGDGVQITGMAVVTIVFAALGFMSPASRGMLLTGMIILYLFLGIAAGYVGVRLWRTIKGGSEGWRPVSWSIACFFPGIAFVILCILNFMLWGSSSTGALPISLFFVLLSLWFCISVPLTLLGGFLGTRAEHIQFPVRTNQIPREIPARKYPSWLLVLGAGTLPFGTLFIELFFILSSIWLGRFYYVFGFLLIVLLLLVTVCAEVSVILTYMHLCVEDWQWWWKAFFASGSVAIYVFLYSINYLVFQLRSLSGPVSAMLYLGYSLIMAVAIMLSTGTIGFLTSFYFVHYLFSSVKID

SEQ ID NO: 8359 - protein, 657 aa, Petroselinum crispum
MSLSSGRTCWAAFIYFLLVSRFCNGFYLPGSYMHTYSTGQEIFAKVNSLTSIETELPFSYYSLPYCKPHGGVKKSAENLGELLMGDQIDNSPYRFRMNVNESVYLCTTKPLSENEVKLLKQRTRDLYQVNMILDNLPAMRFATQNGVKIQWTGFPVGYTPPNSKDDYIINHLKFKVLVHEYEGTGVEIIGTGEEGMAVISEAEKKKASGFEIVGFEVFPCSVKYDPEKMAKLHLYDNVTSVLCPLDLENSQIIREQERVSFSYEVEFVKSDIRWPSRWDAYLKMEGARVHWFSILNSLMVIVFLAGIVFVIFLRTVRRDLTRYEDLDKESQAQINEELSGWKLVVGDVFREPNFSKLLCVMIGDGVQITGMAVVTIVFAAFGFMSPASRGMLLTGMIILYLFLGTGAGYAGVRLWCTVKGTSEGWRSVSWSVACFFPGIVFVILTFLNFVLWGSKSTGAIPLYLYFILLSLWFCISVPLTLLGGYLGTRAEPIKYPVRTNQIPREIPARKYPTWLLVLGAGTLPFGTLFIELFFILSSIWLGRFYYVFGFLLVVLLLLVTVCAEVSVVLTYMHLCIEDWQWWWKAFYASGSVSLYVFLYSINYLIFDLQSLSGPVSAILYLGYSLIMAIAIMLSTGTIGFLTSFYFVHYLFSSVKID

SEQ ID NO: 8360 - protein, 662 aa, Ananas comosus
MARSRISDGSYSLILSALLYLLLIVSPGNAFYLPGSYMHTYAQGETIWVKVNSLTSIETELPFSYYSLPYCRPQGGIKKSAENLGELLMGDQIDNSPYRFRVNVSESLYLCTTNPLNENEVKLLKQRTRDLYQVNMILDNLPVLRFAEQNGLTVQWTGFPVGYTPVGSSEDYIINHLKFKVLVHEYEGSNVEIISTGEEGFGVISDTDKKKMSGYEIVGFEVVPCSVKRDPESMLKKNMYDKIDSVNCPLEIEKSQMIRERERISFTYEVEFVKSDIRWPSRWDAYLKMEGSKVHWFSIMNSLMVILFLAGIVFVIFLRTVRRDLTKYEELDKEAQAQMNEELSGWKLVVGDVFREPACSKLLCVMVGDGVQILGMGIVAIIFAALGFMSPASRGMLLTGMIILYLFLGIAAGYVGVRLYRTIKGSSEGWRSLSWSIACFFPGIIFVILTTLNFILWKNKSTGALPISLFFTLLALWFCISVPLTLFGGFLGTRAEHIEFPVRTNQIPREIPEGKYPSWLLVLGAGTLPFGTLFIELFFILSSIWLGRFYYVFGFLLIVFLLLVIVCAEVSVVLTYMHLCVEDWKWWWKAFFASGSVALYVLLYSINYLVFDLRSLSGPVSAILYLGYSLIMAFAIMLSTGTIGFLMSFSFVYYLFSSVKID

SEQ ID NO: 8361 - protein, 654 aa, Ananas comosus
MSSSWIIPVFVSLLLFASPTNAFYLPGSYMHTYVPGEEIWVKVNSLTSIETELPFSYYSLPYCRPQGGIKKSAENLGELLMGDQIDNSPYRFRINTNESLYLCTTTPLNEHEVKLLKQRSQDLYQVNMILDNLPVLRFTEQNGMTIQWTGFPVGYSPSGGSEVYIINHLKFKVLVHEYEGSKVQIIGTGEEGLGVITENDKTKMSGYEIVGFEVVPCSVKRDPDAMSKLNIYDKIEPVNCPLELEKSQMIREKERISFTYEVEFVKSDIRWPSRWDAYLKMEGAKVHWFSIMNSLMVIFFLAGIVFVIFLRTVRRDLTRYEELDKEAQAQMNEELSGWKLVVGDVFREPTCPKLLCVMIGDGIQILGMAVVTIVFAALGFMSPASRGMLLTGMIILYLFLGIAAGYVGVRLWRTIKGTSEGWRSVSWSIACFFPGIVFVILTILNFILWGNNSTGALPISLFFTLLSLWFCISVPLTLLGGFLGTRAEPIEFPVRTNQIPREIPARKYPSWLLVLGAGTLPFGTLFIELFFILSSIWLGRFYYVFGFLLIVLLLLVVVCAEVSVVLTYMHLCVEDWRWWWKAFFASGSVALYVFLYSMNYLVFDLRSLSGPVSAVVYLGYSLIMCLAIMLSTGTIGFLTSLSFVHYLFSSVKID

SEQ ID NO: 8362 - protein, 658 aa, Musa acuminata
MAPFSISLRSSCFVLVALLILGPSYAFYLPGSYMHTYSQGETITVKVNSLTSFETELPFSYYSLPYCQPQDGIKKSAENLGELLMGDQIDNSPYQFHVNVNESFYLCTTNPLNEREVKLLKQRTRDLYQVNMILDNLPVRRFTEQNGATFQWTGFPVGYTPSGSSEDYIINHLKFKVLVHEYEGSRVEIIGTGEEGMGVISETEKQKMSGYEIVGFEVVPCSVKRDPEAMSKLNVYSKVGPVDCPLELEKSQAIREQEKISFTYEVVFVKSDVRWPSRWDAYLKMEGARVHWFSIMNSLMVIFFLAGIVFVIFLRTVRRDLTRYEELDKESQAQMNEELSGWKLVVGDVFREPTNSKLLCVMVGDGVQITGMAVVTIVFAALGFMSPASRGMLLTGMIILYLFLGIAAGYVGVRLWRTIKGGSEGWRPVSWSIACFFPGIAFVILCILNFMLWGSSSTGALPISLFFVLLSLWFCISVPLTLLGGFLGTRAEHIQFPVRTNQIPREIPARKYPSWLLVLGAGTLPFGTLFIELFFILSSIWLGRFYYVFGFLLIVLLLLVTVCAEVSVILTYMHLCVEDWQWWWKAFFASGSVAIYVFLYSINYLVFQLRSLSGPVSAMLYLGYSLIMAVAIMLSTGTIGFLTSFYFVHYLFSSVKID

SEQ ID NO: 8363 - protein, 649 aa, Raphanus sativus
MYRVLVLLVFVGQLCNGFYLPGSYMHTYSNGDSILAKANSLTSIETELPFSFYSLPYCKPLEGIKKSAENLGELLMGDQIDNSAYRFRMNTNESLYLCTTSPLNEHEVKLLKQRTRELYQVNMILDNLPALRFAKQNGVTIQWTGYPVGYSPPNSNDDYIINHLKFKVLVHQYEGNVMEVIGTGEEGMGVISEADKKKPLGYEIVGFEVVPCSVKYDAEKMTKLHMYDPVPSVNCPLELDKAQIIKELERITFTYEVEFVRSETRWPSRWDAYLKMEGARVHWFSILNSLMVIVFLAGIVFVIFLRTVRSDLTKYEELDKEAHAQMNDELSGWKLVVGDVFREPELSKLLCIMVGDGVRITGMAVVTIVFAALGFMSPASRGMLLTGMIILYLFLGIAAGYAGVRLWRTVKGTSEGWRSLSWSIACFFPGIAFVILTVLNFLLWSSNSTGAIPISLYFELLALWFCISVPLTLFGGFLGTRAEAIQFPVRTNQIPREIPERKYPSWLLVLGAGTLPFGTLFIELFFIFSSIWLGRFYYVFGFLLIVLLLLVVVCAEVSVVLTYMHLCVEDWRWWWKAFFASGSVALYVFAYSINYLVFDLQSLSGPVSAMLYIGYSLLMAIAIMLSTGTIGFLTSFYFVHYLFSSVKID

SEQ ID NO: 8364 - protein, 515 aa, Chelidonium majus
MPSKSGINIQWTGYPVGYAPPQSNDDYVINHLKFKILIHEYEGTGVELLGTGDETMAVVTEPDKKKGSEIVGFEVVPCSVKRDPEAMLKLKMYDPIDPVNCPVDLDKSQIIREQERITFTYEVEFERSDIRWPSRWDAYLKMEGARVHWFSILNSLMVIFFLAGIVFVIFLRTVRRDLTRYEELDKEAQAQMNEELSGWKLVVGDVFREPNCPKLLCVMVGDGTQILGMSVVTIVFAALGFMSPASRGMLLTGMIILYLFLGIIAGYVGVRLWITIKGTSEGWRSISWSVSCFFPGIVFVILTALNFILWGSKSTGAIPISLYFILLSLWFCISVPLTLFGGYFGTKAEPIQFPVRTNQIPREIPARKYPSWLLVLGAGTLPFGTLFIELFFILSSIWLGRFYYVFGFLLVVFVLLVIVCAEVSVVLTYMHLCVEDWQWWWKAFFASGSVALYVFLYSINYLIFDLRSLSGPVSAMLYLGYSLIMAIAVMLSTGTIGFLVSLYFVHYLFSSVKID

SEQ ID NO: 8365 - protein, 660 aa, Phalaenopsis aphrodite
MSLVTVLTSMKSFSFVFFFLPLICHCNGFYLPGSYMRTYSEGETIWVKVNSLTSIETELPFNYYSLPYCKPQDGIKKSAENLGELLMGDQIDNSPYKFNVNVNESIYLCTTKSLSEHEVKLLKQRTRDLYQVNMILDNLPVMRLTQQNGITIQWTGFPVGYSPTGTNDDYIINHLKFKVMVHEYEGKRVEIIGTGEEGMGVISETDKNKMSGYEIVGFEVIPCSVKRDPQSMSKLNMYDKIDPIICPLELDKSQVIREQERITFTYEVEFVKSNIRWPSRWDAYLKMDGARVHWFSIMNSVMVIFFLAGIVFVIFLRTVRRDLTRYEELDKESQAQMNEELSGWKLVVGDVFREPNCSKLLCIMVGDGIQITGMAVVTIVFAALGFMSPASRGMLLTGMILLYLFLGIAAGYVGVRLWRTIKGGSEGWRPLAWLIACFFPGIVFVILTILNFILWGSNSTGAIPISLFFTLLALWFCISVPLTLLGGFLGTRAEHIQYPVRTNQIPREIPARKYPSWLLILGAGTLPFGTLFIELFFILSSIWLGRFYYVFGFLLVVFILLVVVCAEVSVVLTYMHLCVEDWRWWWKAFYASGSVALYVFLYSINYLIFDLRSLSGPVSAILYLGYSLIMAFAVMLVTGTIGFLTSLYFVHYLFSSVKID

SEQ ID NO: 8366 - protein, 659 aa, Citrullus lanatus
MASSSSRKPSICRVFLVFVVLAYRCDAFYLPGSYMNVYSSEDPIFAKVNSLTSIETELPFNYYSLPYCKPPGGVKKSAENLGELLMGDQIDNSPYRFRMNVNETVYLCTTEPLSEVQVKLLKQRTRDLYQVNMILDNLPAMRFTEQNGVKIQWTGFPVGYTPSNSEDDYIINHLKFTVLVHEYEGSGVEIIGTGEEGMGVISQTEQKKSSGFEIVGFQVAPCSIKHDPEVMKKYKMLENITHVDCPKELEKSQIIREKEQVSFSYEVQFVKSDIRWPSRWDAYLRMEGSKVHWFSILNSLMVIFFLAGIVFVIFLRTVRRDLTRYEELDKESQAQMNEELSGWKLVVGDVFREPDCSKLLCVMVGDGVQILGMAVVTVVCTAFGFMSPASRGMLLTGMIILYLFLGIIAGYVGVRAWRTIKGTSEGWRSVSWSVACFFPGIVFVILTILNFILWSSKSTGAIPISLYFELLALWFCISVPLTLLGGFFGTRAEEIQFPVRTNQIPREIPARKYPSWLLILGAGTLPFGTLFIELFFILSSIWLGRFYYVFGFLLIVLSLLVIVCAEVSVVLTYMHLCVEDWRWWWKAFFASGSVALYVFLYSIHYLVFELQSLSGPVSAILYLGYSLIMATAIMLSTGTIGFLTSFYFVHYLFSSVKID

SEQ ID NO: 8367 - protein, 658 aa, Allium cepa
MGRAISLISSAYFLLLLLFTLPSNAFYLPGSYMHTYSKDDKISAKVNSLTSIETELPFDYYSLPYCQPQGGVKKSAENLGELLMGDQIDNSPYRFRMNVNESVYLCTTHPLNENEVKLLKQRTRDLYQVNLILDNLPAMRFTTQNGVTIQWTGFPVGYTPNTESNDDYIINHLKFKVLIHEYEGSGMQILGTGEEGLAVVSEVDKTKKSGYEIVGFEVVPCSVKRDPEAMSKLNMYDNIDPINCPLELDKCQLIREHARVTFTYEVEFVKSDIKWPSRWDAYLKMEGARVHWFSIMNSLMVIFFLAGIVFVIFLRTVRRDLTRYEELDKEAQAQMNEELSGWKLVVGDVFREPEHSKLLCVMIGDGVQILGMALVTIVFAALGFMSPASRGMLLTGMIILYLFLGIFAGYFGVRAWITIKQSSEGWRGVAWSTACFFPGIVFVILTILNFILWGSKSTGAIPISLYFILISLWFCISVPLTLLGGFIGTQAEPIKFPVRTNQIPREIPARKYPSWLLVLGSGTLPFGTLFIELFFILSSIWLGRFYYVFGFLFVVLMLLITVCAEVSVVLTYMHLCVEDWRWWWKAFFASGSVALYVFLYSINYLVFDLRSLSGPVSAILYIGYSLIMSLAVMLSTGTVGFLVSFYFVHYLFSSVKID

SEQ ID NO: 8368 - protein, 657 aa, Petroselinum crispum
MPLILEKTCWAAFIYVLLISHSCNGFYLPGSYMHTYSTGQEIFAKVNSLTSIETELPFSYYSLPYCKPQGGVKKSAENLGELLMGDQIDNSPYHFRMNINESVYLCTTSPLSENEVKLLKQRTRDLYQVNMILDNLPAMRFATQNGVRIQWTGFPVGYTPPNSKDDYIINHLKFKVLVHEYEGTGVEIIGTGEEGMAVISEAEKKKASGFEIVGFEVFPCSVKYDPEKMAKLHLYDNVTSVLCPLDLENSQIIREQERVSFSYEVEFVKSDIRWPSRWDAYLKMEGARVHWFSILNSLMVIVFLAGIVFVIFLRTVRRDLTRYEDLDKESQAQINEELSGWKLVVGDVFREPNFSKLLCVMIGDGVQITGMAVVTIVFAAFGFMSPASRGMLLTGMIILYLFLGTGAGYAGVRLWCTVKGTSEGWRSVSWSVACFFPGIVFVILTFLNFVLWGSKSTGAIPLYLYFILLSLWFCISVPLTLLGGYLGTRAEPIKYPVRTNQIPREIPARKYPTWLLVLGAGTLPFGTLFIELFFILSSIWLGRFYYVFGFLLVVLLLLVTVCAEVSVVLTYMHLCIEDWQWWWKAFYASGSVSLYVFLYSINYLIFDLQSLSGPVSAILYLGYSLIMAIAIMLSTGTIGFLTSFYFVHYLFSSVKID

SEQ ID NO: 8369 - protein, 652 aa, Eschscholzia californica
MASSIYLSCLLVLLFGCVCNGFYLPGSYMHTYTPGEQIFAKVNSLTSIETELPFSYYSLPYCKPPGGIKKSAENLGELLMGDQIDNSPYRFRMNVNESIYLCTTSPLNENEVKLLKQRTRDLYQVNMILDNLPALRYADQNGINIQWTGYPVGYAPALSKDDYIINHLKFKVLVHEYEGTGLEVIGTGDESMAVVAEPSEKKNGYEIVGFEVVPCSIKRDTEEMLKLHMYDTIDPINCPVDLDKSQIIKELERVTFTYEVEFVKSDIRWPSRWDAYLKMEGARVHWFSILNSLMVIFFLAGIVFVIFLRTVRRDLTRYEELDKEAQAQMNEELSGWKLVVGDVFREPNCPKLLCVMVGDGTQILGMAVVTIVFAALGFMSPASRGMLLTGMIILYLFLGIIAGYVGVRVWVTIKGTSEGWRSIAWSVSCFFPGIVFVILTALNFILWGSKSTGAIPISLYFILLSLWFCISVPLTLLGGLFGTRAEPIKYPVRTNQIPREIPARKYPSWLLVLGAGTLPFGTLFIELFFILSSIWLGRFYYVFGFLLVVFVLLVIVCAEVSVVLTYMHLCVEDWQWWWKSFFASGSVALYVFMYSINYLIFDLRSLSGPVSAMLYLGYSLIMAIAIMLSTGTIGFLVSFYFVHYLFSSVKID

SEQ ID NO: 8370 - protein, 661 aa, Musa acuminata
MGPTSNPERSSSLCFLTFSIVLLLCGSGNAFYLPGSYMHTYSEGENIWVKVNSLTSIETELPFGYYTLPYCQPQSGIKKSAENLGELLMGDQIDNSPYRFRVNVNESLYLCTTKPLNEHEVKLLKQRTHDLYQVNMILDNLPVRRFTEPNGVVIQWTGFPVGYIPAGSSEAYIINHLKFKVLVHEYEGRGMQIMTTGEEGMGMIAETDAKNSGYEIVGFEVIPCSVKRDPEAMLKLNIYDKVDSVNCPLELEKSQTIREQEKISFTYEVVFVKSDIRWPSRWDAYLTMGGARVHWFSIMNSLMVIFFLAGIVFVIFLRTVRRDLTRYEELDKESQAQMNEELSGWKLVVGDVFREPTCSKLLCVMVGDGIQITGMAVVTIVFAALGFMSPASRGMLLTGMIILYLFLGIVAGYVGVILWRTIKGGSDGWRSVCWSTACFFPGIVFIVLTILNFILWGSKSTGAIPISLFFTLLSLWFCISVPLTLIGGFIGTRAEEIRFPVRTNQIPREIPARKYPSWFLVLGAGTLPFGTLFIELFFILSSIWLGRFYYVFGFLLVVFLLLVIVCAEVSVVLTYMHLCVEDWRWWWKAFFASGSVALYVFLYSINYLVFDLRSLSGPVSAILYLGYSLIMATAIMLSTGTIGFLMSFYFVHYLFSSVKID

SEQ ID NO: 8371 - protein, 658 aa, Castanea mollissima
MALSKPFLKWVFVCLVILFAHTTCNAFYLPGSYMHTYSPREPIFAKVNSLTSIETELPFSYYSLPYCEPQEGVKKSAENLGELLMGDQIDNSPYRFRMNVNETVYLCTTPPLKENEVKLLKQRTRDLYQVNMILDNLPAMRYSRQNDVSIQWTGYPVGFTQNNNDDYIINHLKFKVLVHEYEGSGVEIIGTGEEGMGVISTDADKKKASGFEIVGFEVVPCSVKHDPEALSKRKMYDNIGPVTCPSELDKSQIIREQEKVSFTYDVEFVKSDIRWPSRWDAYLKMEGARVHWFSILNSVMVIFFLAGIVFVIFLRTVRRDLTRYEELDKESQAQMNEELSGWKLVVGDVFREPNCPKLLCVMVGDGVQILGMAIVTIVFAAFGFLSPASRGMLLTGMIVLYLFLGIAAGYVGVRLWRTLKGTSEGWKSVSWSVACFFSGIVFAILTALNFILWGSKSTGAIPISLYFLLLFLWFCVSVPLTLLGGLLGTRAEAIQYPVRTNQIPREIPARKYPSWLLVLGAGTLPFGTLFIELFFILTSIWLGRFYYVFGFLLIVLLLLVIVCAEVSVVLTYMHLCVEDWQWWWKAFFASGSVALYVFLYSINYLVFDLKSLSGPVSAILYLGYSLIMAFAIMLATGTIGFLMSFYFVHYLFSSVKID

SEQ ID NO: 8372 - protein, 658 aa, Quercus alba
MALSKPFLKWVFLFLVILSAHTTCNAFYLPGSYMHTYSPRDSIFAKVNSLTSIETELPFSYYSLPYCQSPEGIKKSAENLGELLMGDQIDNSPYRFRMNVNETVYLCTTHPLKENEVKLLKQRTRDLYQVNMILDNLPAMRYSRQNDVSIQWTGYPVGFTQNNKEDYIINHLKFKVLVHEYEGSGVEIIGTGEEGMGVISTDADKRKASGFEIVGFEVVPCSVKHDPEAMLKHKMYDNVNPVTCPSELDRSQIIREQERVSFTYDVEFVKSDIRWPSRWDAYLKMEGARVHWFSILNSVMVIFFLAGIVFVIFLRTVRRDLTRYEELDKESQAQMNEELSGWKLVVGDVFREPNCPKLLCVMVGDGVQILGMAIVTIVFAAFGFLSPASRGMLLTGMIVLYLFLGIAAGYVGVRLWRTLKGTSEGWKSVSWSVACFFSGIVFAILTALNFILWGSKSTGAIPISLYFLLLFLWFCVSVPLTLLGGLLGTRAEAIQYPVRTNQIPREIPARKYPSWLLVLGAGTLPFGTLFIELFFILTSIWLGRFYYVFGFLLIVLLLLVIVCAEVSVVLTYMHLCVEDWQWWWKAFFASGSVALYVFLYSINYLVFDLKSLSGPVSAILYLGYSLIMAFAIMLATGTIGFLMSFYFVHYLFSSVKID

SEQ ID NO: 8373 - protein, 229 aa, Cucumis melo
MASSSSRKPSICRVFLVFLVLAYHCDAFYLPGSYMNVYSSEDPIFAKVNSLTSIETELPFNYYSLPYCKPRGGVKKSAENLGELLMGDQIDNSPYRFRMNVNETVYLCTTEPLSKDQVKLLKHRTRDLYQVNMILDNLPAMRFTEQNGVKIQWTGFPVGYTPSNSEDDYIINHLKFTVLVHEYEGSGVEIIGTGEEGMGVITQTERKKSSGLRLLDFRCNLVVLNMILK

SEQ ID NO: 8374 - protein, 693 aa, Elaeis guineensis
SHILSSARLFAKSEGTQVKSHEKGYWNRFKTCGLHGTVDDLKKVLFFTSFIFLLITCPSNGFYLPGSYMHTYSQDEPISVKVNSLTSIETELPFSYYSLPYCQPKGGIKKSAENLGELLMGDQIDNSPYTFHMNVNESLYLCTTKPLNEHEVKLLKQRTRDLYQVNMILDNLPVMRFTQQNGVTIQWTGFPVGYTPIASNDDYIINHLKFKVLVHKYEGSGVEIIGTGEEAMGMPSETDKKKMSGYEIVGFEVIPCSVKHDAETMSKHNIYDRIEPVNCPLELDKCQMIKEQERITFTYDVEFVKSDIRWPSRWDAYLKMDGAKVHWFSIMNSLMVIFFLAGIVFVIFLRTVRRDLTRYEELDKEAQAQMNEELSGWKLVVGDVFREPTCSKLLCVMVGDGVQITCMAVVTIVFAALGFMSPASRGMLLTGMVLLYLFLGIFAGYTGVRLWSTIKGGSEGWRSVAWSIACFFPGVVFVILTFLNFLLWWNNSTGALPISLYFTLLSLWFCISVPLILLGGFLGTRADPIQFPVRTNQIPREIPARKYPSWLLVLGAGTLPFGTLFIELFFILSSIWLGRFYYVFGFLLIVLLLLVIVCAEVSVVLTYMHLCVEDWRWWWKAFFASGSVSLYVLLYSINYLVFDLKSLSGAVSAMLYMGYSLIMALAIMLSTGTIGFLMSFYFVHYLFSSVKID

SEQ ID NO: 8375 - protein, 472 aa, Allium cepa
MQILGTGEEGLAVVSEVDKTKKSGYEIVGFEVVPCSVKRDPEAMSKLNMYDNIDPINCPLELDKCQLIREHARVTFTYEVEFVKSDIKWPSRWDAYLKMEGARVHWFSIMNSLMVIFFLAGIVFVIFLRTVRRDLTRYEELDKEAQAQMNEELSGWKLVVGDVFREPEHSKLLCVMIGDGIQILGMALVTIVFAALGFMSPASRGMLLTGMIILYLFLGIFAGYFGVRAWITIKQSSEGWRGVAWSTACFFPGIVFVILTILNFILWGSKSTGAIPISLYFILISLWFCISVPLTLLGGFIGTQAEPIKFPVRTNQIPREIPARKYPSWLLVLGSGTLPFGTLFIELFFILSSIWLGRFYYVFGFLFVVLMLLITVCAEVSVVLTYMHLCVEDWRWWWKAFFASGSVALYVFLYSINYLVFDLRSLSGPVSAILYIGYSLIMSLAVMLSTGTVGFLVSFYFVHYLFSSVKID

SEQ ID NO: 8376 - protein, 643 aa, Cocos nucifera
FLLLITCPSNGFYLPGSYMHTYSEGEPISVKVNSLTSIETELPFSYYGLPYCQPKDGIKKSAENLGELLMGDQIDNSPYRFRVNVNESLYLCTTKPLTELEVKLLKQRSRDLYQVNMILDNLPVMRYTQQNGVTIQWTGFPVGYTPIGSNDDYIINHLKFKVLVHEYEGSGVEIIGTGEEGMGMPSETDKKKMSGYEIVGFEVIPCSVKRDAERMSKHNMYDQIEPVNCPLELDKCQVIKEQERITFTYEVEFVKSDIRWPSRWDAYLKMDGAKVHWFSIMNSLMVIFFLAGIVFVIFLRTVRRDLTRDEELDKEAQAQMNEELSGWKLVVGDVFREPTCSELLCVMVGDGVQITCMAVVTIVFAALGFMSPASRGMLLTGMILLYLFLGIFAGYVGVRLWSTIKGGSEGWRSVAWLIACFFPGIVFMVLTFLNFLLWWNKSTGALPISLYFTLLSLWFCISVPLTLLGGFFGTRAEPIQFPVRTNQIPREIPARKYPSWLLVLGAGTLPFGTLFIELFFILSSIWLGRFYYVFGFLLIVLLLLVIVCAEVSVVLTYMHLCVEDWRWWWKAFFASGSVALYVFLYSINYLVFDLKSLSGPVSAMLYLGYSLIMAVAIMLSTGTIGFLMSFYFVHYLFSSVKID

SEQ ID NO: 8377 - protein, 658 aa, Allium cepa
MGRAISLISSAYFLLLLLFTLPSNAFYLPGSYMHTYSKDDKISAKVNSLTSIETELPFDYYSLPYCQPQGGVKKSAENLGELLMGDQIDNSPYRFRMNVNESVYLCTTHPLNENEVKLLKQRTRDLYQVNLILDNLPAMRFTTQNGVTIQWTGFPVGYTPNTESNDDYIINHLKFKVLIHEYEGSGMQILGTGEEGLAVVSEVDKTKKSGYEIVGFEVVPCSVKRDPEAMSKLNMYDNIDPINCPLELDKCQLIREHARVTFTYEVEFVKSDIKWPSRWDAYLKMEGARVHWFSIMNSLMVIFFLAGIVFVIFLRTVRRDLTRYEELDKEAQAQMNEELSGWKLVVGDVFREPEHSKLLCVMIGDGIQILGMALVTIVFAALGFMSPASRGMLLTGMIILYLFLGIFAGYFGVRAWITIKQSSEGWRGVAWSTACFFPGIVFVILTILNFILWGSKSTGAIPISLYFILISLWFCISVPLTLLGGFIGTQAEPIKFPVRTNQIPREIPARKYPSWLLVLGSGTLPFGTLFIELFFILSSIWLGRFYYVFGFLFVVLMLLITVCAEVSVVLTYMHLCVEDWRWWWKAFFASGSVALYVFLYSINYLVFDLRSLSGPVSAILYIGYSLIMSLAVMLSTGTVGFLVSFYFVHYLFSSVKID

SEQ ID NO: 8378 - protein, 659 aa, Malus domestica
MAILNPGMLSIKWALLVLVVFVHTCNGFYLPGSYMHTYAKGQEITTKVNSLTSIETELPFSYYSLPYCKPPEGIKKSAENLGELLMGDEIENSAYRFNMNVNETRYLCTTDPLTEHDVKLLKQRTRDLYQVNMILDNLPAMRYAYQNGVKIQWTGFPVGYTSPNSKEDYIINHLKFRVMIHEYEGSGVQIIGTGEEGMGVISEADKKKASGFEIVGFEVYPCSIKYDPEAMKKKAMYENIKPVSCPAELEKAQIIRQQEKVSFTYEVEFVKSDTRWPSRWDAYLKMEGARVHWFSILNSLMVIFFLAGIVFVIFLRTVRRDLTRYEELDKESQAQMNEELSGWKLVVGDVFREPDSPKLLCVMVGDGVQITGMAVVTIIFAAFGFMSPASRGMLLTGMIILYLFLGIIAGYVAVRMWRTIKGTSEGWRSVSWFVACFFPGIVFVILTILNFILWGSKSTGALPISLYFILISLWFCISVPLTLLGGFLGARAEPISYPVRTNQIPREIPARKYPSWLLVLGAGTLPFGTLFIELFFILSSIWLGRFYYVFGFLFIVLTLLVIVCAEVSVVLTYMHLCVEDWRWWWKAFFASGSVSFYVFLYSINYLVFDLQSLSGPVSAILYLGYSLIMATAIMLSTGTIGFLMSFYFVHYLFSSVKID

SEQ ID NO: 8379 - protein, 264 aa, Chelidonium majus
MLKLKMYDPIDPVNCPVDLDKSQIIREQVRITFTYEVEFERSDIRWPSRWDAYLRMEGARVHWFSILNSLMVIFFLAGIVFVIFLRTVRRDLTRYEELDKEAQAQMNEELSGWKLVVGDVFREPNCPKLLCVMVGDGTQILGMAVVTIVFAALGFMSPASRGMLLTGMIILYLFLGIIAGYVGVRLWITIKGTSEGGGQFLVRFVFLSRNSIRNSHCLELHTLGQQEHWCYPYLTVFYTLVPLVLHFCSSNPLRRLFWDKGRAH

SEQ ID NO: 8380 - protein, 659 aa, Amaranthus tuberculatus
MAFSMKRTLQIDRVFVCLFLFSYVCNGFYLPGTYMHSYSVQDEIYAKVNSLTSIETELPFSYYSLPYCKPHDGVKKSAENLGELLMGDQIDNSPYRFRMNVNESIFLCITSPLSEQEVKLLKQRTRDLYQVNMMLDNLPAMRYATQNGVKIQWTGFPIGYSPPNSNDDYIINHLKFRVLIHEYEGNTVEIIGTGEEGMGVISEADKKKTSGYEIVGFEVIPCSVKRDPDEMSKLHMYDNINLINCPMELDKSQIIRERERVAFTYEVEFVKSNTRWPSRWDAYLKMEGARVHWFSILNSLMVIFFLAGIVFVIFLRTVRRDLTRYEELDKEAQAQMNEELSGWKLVVGDVFREPEHSKLLCVMVGDGVQITGMAVVTIVFAALGFMSPASRGMLLTGMVIIYLLLGTVAGYAGVYLWKTIKGTPDGWRSVAWWNACFFPGIVFVILTFLNFLLWGSKSTGAIPISLYFILLSLWFCISVPLTLFGGFLATRAEPIQYPVRTNQIPREIPARKYPSWLLVLGAGTLPFGTLFIELFFILSSIWLGRFYYVFGFLFVVLVLLVIVCAEVSVVLTYMHLCVEDWRWWWKAFFASGSVAVYVFLYSINYLVFDLQSLSGPVSAILYLGYSLIMAVAIMLSTGTIGFLMSFYFVHYLFSSVKID

SEQ ID NO: 8381 - protein, 659 aa, Cucumis sativus
MASSSSRKPSICRVLLVFLVLAYHCDAFYLPGSYMNVYSSEDPIFAKVNSLTSIETELPFNYYSLPYCKPPGGVKKSAENLGELLMGDQIDNSPYRFRMNVNETVYLCTTEPLNEDQVKLLKHRTRDLYQVNMILDNLPAMRFTEQNGVKIQWTGFPVGYTPSNSEDDYIINHLKFTVLVHEYEGSGVEIIGTGEEGMGVITQTERKKSSGFEIVGFQVQPCSIKHDPEVMKKYQMLENITGVDCPKELDKSQIIREKEQVSFTYEVQFIKSDIRWPSRWDAYLRMEGSKVHWFSILNSLMVIFFLAGIVFVIFLRTVRRDLTRYEELDKESQAQMNEELSGWKLVVGDVFREPDCSKLLCVMVGDGVQILGMAVVTVVCTAFGFMSPASRGMLLTGMIILYLFLGIIAGYVGVRAWRTIKGTSEGWRSVSWSVACFFPGIVFVILTILNFILWSSKSTGAIPISLYFELLALWFCISVPLTLLGGFFGTRAEEIQFPVRTNQIPREIPARKYPSWLLILGAGTLPFGTLFIELFFILSSIWLGRFYYVFGFLLIVLSLLVIVCAEVSVVLTYMHLCVEDWRWWWKAFFASGSVALYVFLYSIHYLVFELQSLSGPISAILYLGYSLIMATAIMLSTGTIGFLMSFYFVHYLFSSVKID

SEQ ID NO: 8382 - protein, 243 aa, Centaurea maculosa
MALSLISRGTCWLLFVYAIFVSHPCNGFYLPGSYMHTYSTRDEIYAKVNSLTSIETELPFSYYSLPYCKPSGGIKKSAENLGELLMGDQIDNSPYRFRMNVNESAFLCTTHPLNEHEVKLLKQRTRDLYQVNMILDNLPAMRFANQNGLKVQWTGFPVGYTPPNSDDDYIINHLKFKVFVHEYEGTGVQIFGTGEEGMGVISAAEDEKKASGYEIVGFEVSHAVLSTNLKRWLNSINTMKCHP

SEQ ID NO: 8383 - protein, 624 aa, Papaver somniferum
MHTYTPGESIFGKVNSLTSIETELPFSYYSLPYCKPEGGIKKSAENLGELLMGDQIDNSPYRFNMNRNESLYLCTTNPLNENEVKLLKQRTRDLYQVNMILDNLPAMRYAKQNGINIQWTGYPVGYAPPQSSEDYIVNHLKFKVLVHEYEGTGVQVLGTGDETMAVVQESEKKLNGYEIVGFEVVPCSVKRDPEAMSKLKMYDTVDPVNCPVDLEKSQIIREQERVSFTYEVEFVKSDIRWPSRWDAYLKMEGARVHWFSIMNSLMVIFFLAGIVFVIFLRTVRRDLTRYEELDKEAQAQMNEELSGWKLVVGDVFREPNCSKLLCVMVGDGTQILGMAVVTIVFAALGFMSPASRGMLLTGMIILYLFLGLVAGYVGVRLWITIKGTTEGWRSVSWSVSCFFPGIVFIILTALNFILWGSKSTGAIPISLYFILISLWFCISVPLTLLGGYFGTKAEPIQYPVRTNQIPREIPVRKYPSWLLVLGAGTLPFGTLFIELFFILSSIWLGRFYYVFGFLLVVFVLLVVVCAEVSVVLTYMHLCVEDWQWWWKAFYASGSVSLYVFMYSINYLIFDLRSLSGPVSAMLYLGYSLIMAIAIMLSTGTIGFLISFYFVHYLFSSVKID

SEQ ID NO: 8384 - protein, 660 aa, Eucalyptus grandis
MSRSGMHSICKWRLPLLLALLAHVCSGFYLPGSYMHTYSTHDKIFAKVNSLTSIETELPFSYYSLPYCQPPEGVKKSAENLGELLMGDQIDNSPYRFQMNINETVYLCTTVALKDHQVKLLKQRTRDLYQVNMILDNLPALRYAKQNNVNIQWTGFPVGYTPQGSNEDYIINHLKFRVLVHEYEGSGVEIIGTGEEGLGVISEADDKKKASGFEIVKFEVIPCSVKFDPDKMSKHKMYDRIDPVTCPAEYDKSQIIREQERVSFTYEVEFVKSDIRWPSRWDAYLQMEGAKVHWFSILNSLMVIFFLAGIVFVIFLRTVRRDLTRYEELDKEAQAQMNEELSGWKLVVGDVFREPECAKLLCVMIGDGVQITGMAVVTIVFAAFGFMSPASRGMLLTGMIILYLFLGIFAGYVGVRLWRTLKGTSEGWRSVSWSVACFFPGIVFIILTVLNFLLWGSNSTSAIPISLYFILFALWFCISVPLTLLGGFLGTRAEAIQYPVRTNQIPREIPARRYPSWLLVLGAGTLPFGTLFIELFFILSSIWLGRFYYVFGFLLIVLLLLIVVCAEVSVVLTYMHLCVEDWRWWWKAFYASGTVALYVFLYSINYLIFDLQSLSGPVSAMLYLGYSLIMATAIMLSTGTIGFLTSFYFVHYLFSSVKID

SEQ ID NO: 8385 - protein, 527 aa, Castanea mollissima
MILDNLPAMRYSRQNDVSIQWTGYPVGFTQNNNDDYIINHLKFKVLVHEYEGSGVEIIGTGEEGMGVISTDADKKKASGFEIVGFEVVPCSVKHDPEALSKRKMYDNIGAVTCPSELDKSQIIREQEKVSFTYDVEFVKSDIRWPSRWDAYLKMEGARVHWFSILNSVMVIFFLAGIVFVIFLRTVRRDLTRYEELDKESQAQMNEELSGWKLVVGDVFREPNCPKLLCVMVGDGVQILGMAIVTIVFAAFGFLSPASRGMLLTGMIVLYLFLGIAAGYVGVRLWRTLKGTSEGWKSVSWSVACFFSGIVFAILTALNFILWGSKSTGAIPISLYFLLLFLWFCVSVPLTLLGGLLGTRAEAIQYPVRTNQIPREIPARKYPSWLLVLGAGTLPFGTLFIELFFILTSIWLGRFYYVFGFLLIVLLLLVIVCAEVSVVLTYMHLCVEDWQWWWKAFFASGSVALYVFLYSINYLVFDLKSLSGPVSAILYLGYSLIMAFAIMLATGTIGFLMSFYFVHYLFSSVKID

SEQ ID NO: 8386 - protein, 574 aa, Avena sativa
MAGALHSSRGLALLLLVGLLLTAPGNAFYLPGSYMHTYSQGEDIWAKVNSLTSIETEMPFSYYSLPYCRPPGGIKKSAENLGELLMGDQIDNSPYRFSVNVNESLFLCTTKGLNENDAKLLKQRARDLYQVNMMLDNLPVMRFAEQNGVTVQWTGFPVGYTPAGSSDDYIINHLKFKVLVHEYEGSNVEIIGTGEEGSSVIPETDKKGMYGYQIVGFEVVPCSVKHDAEAFSKLNMHDKIDPVSCPMELRKSQVIRQQERITFTYDVEFVKSDIRWPSRWDAYLKMEAGANVHWFSIMNSLMVILFLAGIVFIIFLRTVRRDLTRYEELDKEAQAQMNEELSGWKLVVGDVFREPTCPKLLCIMIGDGVQILGMAIVTIVFSTLGFMSPASRGMLLTGMIILYLFLGIAAGYVSVRLWRTIKGTSEGWRSLSWLTACFFPGIMFIVLTILNFILWGSNSTGALPISLFFTLLALWFCISVPLTLAGGFLGTRAEQIEFPVRTNQIPREIPARKYPSWLLVLGAGTLPFGTLFIELFFILSSIWLGRFYYVFGFLLIVLLMLVVVAPRYLLSLHT

SEQ ID NO: 8387 - protein, 661 aa, Amorphophallus konjac
MATPSIPKPCSLIRSALLICVLLCSLCNAFYLPGSYMHTYSQGEEINVKVNSLTSIETELPFSYYSLPYCKPPDGIKKSAENLGELLMGDQIDNSPYRFHVNVNESIYLCTTNPLNDQEVKLLKQRTRDLYQVNMILDNLPAMRVTQQNGITIQWTGFPVGYTLGATNDDYIINHLKFKVLVHEYEARGVEIITTGEEGPGVVATTDDKKLSGYQIVGFVVVPCSIKRDPDAFSKHNMFDKIEPGVCPSEPEKSQIIREQERISFTYDVEFVKSDTRWPSRWDAYLKMEGARVHWFSIMNSLMVIFFLAGIVFVIFLRTVRRDLTRYEELDKEAQAQMNEELSGWKLVVGDVFREPTNPKLLCVMIGDGVQIAGMAVVTIVFAAFGFMSPASRGMLLTGMIVLYLFLGIVAGYASVRLWRTIKGTSEGWRSVSWSVACFFPGIAFVVLTVLNFLLWSSKSTGAIPISLYFVLLSLWFCISVPLTLLGGFFGTRAEPIGYPVRTNQIPREIPARKYPSWLLVLGAGTLPFGTLFIELFFILSSIWLGRFYYVFGFLLVVLLLLVIVCAEVSVVLTYMHLCVEDWRWWWKAFFASGSVALYVFLYSINYLVFDLRSLSGPVSAMLYLGYSFLMAFAIMLSTGTIGFLTSFYFVHYLFSSVKID

SEQ ID NO: 8388 - protein, 659 aa, Aristolochia fimbriata
MAVWKSSKFYFILFLVVLFSNICRGFYLPGSYMHTYSEGEEISVKVNSLTSIETELPFSYYSLPYCPPPGGVKKSAENLGELLMGDQIDNSPYRFRMLKNESVYLCTTKPLTELEVKLLKQRTRDLYQVNMILDNLPAMRYAKQKGINIQWTGFPVGYTPSSQSNDDYIINHLKFKVLVHEYEGSGVQIIGTGEEGMGVITEESDKKKANGYEIVGFEVVPCSIKWNPNEMAKHKMYDNLDKVNCPSELEKSQIIREQEKVSFTYEVEFEKSDTRWPSRWDAYLKMEGARVHWFSILNSLMVIFFLAGIVFVIFLRTVRRDLTRYEELDKEAQAQMNEELSGWKLVVGDVFREPECSKLLCVMVGDGVQIAGMAVVTIVFAALGFMSPASRGMLLTGMIVLYLFLGMPAGYVAVRLWSTIKGTTEGWRSLSWSVACFFSGIVFTVLTILNFMLWSSKSTGAIPISLFFLLLFLWFCILVPLTLFGGFMGTRAEPIQYPVRTNQIPREIPSRKYPSWLLVLGAGTLPFGTLFIELFFILSSIWLGRFYYVFGFLLVVLLLLVIVCAEVSVVLTYMHLCVEDWRWWWKAFFASGSVALYVFLYSINYLIFDLRSLSGPVSAMLYLGYSLVMALAIMLATGTIGFIMSFYFVHYLFSSVKID

SEQ ID NO: 8389 - protein, 660 aa, Avena sativa
MAGALHSSRGLALLLLVVLLLIAPGNAFYLPGSYMHTYSQGEDIWAKVNSLTSIETEMPFSYYSLPYCRPPGGIKKSAENLGELLMGDQIDNSPYRFSVNVNESLFLCTTKGLNENDAKLLKQRARDLYQVNMMLDNLPVMRFAEQNGVTVQWTGFPVGYTPAGSSDDYIINHLKFKVLVHEYEGASAEIIGTGEEGSAVVSETDKKGMSGYQIVGFEVVPCSVKHDAEAFSKLNMHDKIDPVSCPMELRKSQAIRQQERITFTYDVEFVKSDIRWPSRWDAYLKMEAGANVHWFSIMNSLMVILFLAGIVFIIFLRTVRRDLTRYEELDKEAQAQMNEELSGWKLVVGDVFREPTCPKLLCIMIGDGVQILGMAIVTIVFSTLGFMSPASRGMLLTGMIILYLFLGIAAGYVSVRLWRTIKGTSEGWRSLSWLTACFFPGIMFIVLTILNFILWGSNSTGALPISLFFTLLALWFCISVPLTLAGGFLGTRAVQIEFPVRTNQIPREIPARKYPSWLLVLGAGTLPFGTLFIELFFILSSIWLGRFYYVFGFLLIVLLMLVVVCAEVSVVLTYMNLCVEDWRWWWKAFFASGSVALYVFLYSINYLVFDLRSLSGPVSAMLYIGYSFLMAFAIMLATGTIGFLTSISFVHYLFASVKID

SEQ ID NO: 8390 - protein, 660 aa, Ambrosia trifida
MALSFDRKRTCLVLFTYVVFLGHLCNGFYLPGSYMHTYSNGEKIFAKVNSLTSIETELPFSYYSLPYCKPSGGVKKSAENLGELLMGDQIDNSPYRFQMNVNESVFLCTTHPLSEHEVKLLKQRTHDLYQVNMILDNLPAMRFANQNGVKIQWTGFPVGFTPPGSKDDYIINHVKFRVFVHEYEGTGVQIIGTGEEGMGVISTSDDKKKAAGYEIVGFEVFPCSVKYDPEKMAKLHQYDQVDSVNCPLELEKSQIIREQERVSFTYEVEFVKSNVRWPSRWDAYLKMEGARVHWFSILNSLMVIFFLAGIVFVIFLRTVRRDLTRYEELDKESQAQMNEELSGWKLVVGDVFREPNHSKLLCVMIGDGVQITGMTVVTILFAAFGFMSPASRGMLLTGMIILYLFLGTGAGYAGVYLWRTVKGTSEGWRSVSWSIAFFFPGIVFVILTVLNFILWGSNSTGAIPISLYFILLSLLFCISVPLTLLGGYLGTRADPIQFPVRTNQIAREIPAQKYPSWLLVIGAGTLPFGTLFIELFFILSSIWLGRFYYVFGFLLVVLMLLVVVCAEVSVVLTYMHLCVEDWQWWWKAFYASGSVSLYVFLYSMKYLVFDLQSLSGPVSAILYLGYSLIVAIAIMLSTGTIGFITSFYFVHYLFSSVKID

SEQ ID NO: 8391 - protein, 654 aa, Papaver somniferum
MEKTSLAGFCCLFVILFATVCDGFYLPGTYMHTYSNGESILAKVNSLTSIETELPFSYYSLPYCKPPGGIKKSAENLGELLMGDQIDNSPYRFKMNQNESLYLCTTSPLNENEVKLLKQRTRDLYQVNMILDNLPAMRYATQNGIKIQWTGYPVGYAPPQSNEDYIINHLKFKVLVHEYEGSGVVLLGTGDETMAVVQEPEKKLNGYEIVGFEVIPCSIKRDPEAMKKLKMYDSVDPVNCPVDLEKSQIIREQEQVSFTYEVEFVKSDIRWPSRWDAYLKMEGARVHWFSIMNSLMVIFFLAGIVFVIFLRTVRRDLTRYEELDKEAQAQMNEELSGWKLVVSDVFREPTCSKLLCVMVGDGTQILGMAVVTIIFAALGFMSPASRGMLLTGMIILYLFLGIVAGYVGVRLWITVKGTTEGWRSVSWSCSVFFPGIVFVILTALNFVLWGSKSTGAIPISLYFILLSLWFCISVPLTLLGGYLGTKAEPITYPVRTNQIPREIPARKYPSWLLVLGAGTLPFGTLFIELFFILSSIWLGRFYYVFGFLLVVFILLVVVCAEVSVVLTYMHLCVEDWQWWWKAFFASGSVSLYVFMYSINYLIFDLRSLSGPVSAMLYLGYSLIMAIAIMLSTGTIGFLVSFYFVHYLFSSVKID

SEQ ID NO: 8392 - protein, 660 aa, Fragaria vesca
MAVSKSRTLPEFLWALLVLVMFAHVCNGFYLPGSYMHTYSKGQEIFTKVNSLTSIETELPFSYYSLPYCKPQGGIKKMAENLGELLMGDEIESSPYRFRMNMNETVYLCTTNPLKEHEVKLLKQRTRDMYQVNMILDNLPAMRYAYQNRATIQWTGYPVGFTPDGSKDDYIINHLKFRVLIHEYEGSGVQIIGTGEEGMGVISEADKKKASGYEIVGFEVYPCSVKYDADTMSKNEMYKSIAPVNCPKDASESQIIREQERVSFTYEVEFVKSDIRWPSRWDAYLKMEGARVHWFSILNSLMVIFFLAGIVFVIFLRTVRRDLTRYEELDKEAQAQMNEELSGWKLVVGDVFREPDHSKLLCVMVGDGVQITGMSVVTIIFAAFGFMSPASRGMLLTGMIILYLFLGIIAGYVAVRMWRTIKGTSEGWRSVSWFVACFFPGIVFVILTILNFILWGSNSTGAIPISLYFVLFSLWFCISVPLTLLGGFLGTRSEAIQYPVRTNQIPREIPARKYPSWLLVLGAGTLPFGTLFIELFFILSSIWLGRFYYVFGFLLIVLLLLVVVCAEVSVVLTYMHLCVEDWRWWWKAFFASGSVALYVFLYSINYLVFDLQSLSGPVSATLYLGYSLIMATAIMLSTGTIGFLMSFYFVHYLFASVKID

SEQ ID NO: 8393 - protein, 759 aa, Trifolium pratense
MAVAEETGGGTTIIDETYEFSAPRFFDFMKGESDDEIRRAELWFHTALSYAPSPFMPKIKAGRSITVDTLCDFSEADNHMPKMSANVEDNVSKSNTQSESMTSKIKEHDEAKEEKLTTVSQVISTNKKDDAPSCEAKEENNSTSLEDIVGKEMSDHKGGQCLKVVASTEASVEVAKDVCTPNPALRKNVNTTSTNSKKQQNSKKVSTNTKTRLQSAATKSTLGTPHFAQENQAIKRQKLEGGKTRQILNPKPQTLPHDKSKLGYCSSTSKIHKEDRKVYVRETPKTPASAPFVSMAEMMKRFQSSTRDLPLPNTLSHTKPKLTLTRPKEPEFETNQRVRPARVKSAAELEEEMMAKMPKFKARPLNKKILQTSTLPPMPRSTPQPPEFKEFHLETLARAHQNTDSASKASSEVSHKENSSKPHLTEPKPPLLQTSLRARPPTVKSSLEIEQEELEKIPKFKARPLNKKIFESKGDIGIFCHMKKHVTEPQEFHFATNERFPPPPTSVADLFDKLSLKSEPACNRNTIPKVTTPNPFHLHTEERGAEKEKKLIMELFQKELEEEATRVPKANPYPYTTDYPVIPPKPEPKQCTKPEPFQLESLVRHEEEIQKEQEERLRMQREERKMRKFKAQPILKEDPIPVPEKVRKPLTEVKEFDLHLNHRAVDRAQFDERIKEKEVMYKRYREESEAARMMEEEKALKQMRKTMVPHARPVPNFDNPFCPQKTSKTTKPKSPNLRVLQRRRKIFNGSAVSSPANIR

SEQ ID NO: 8394 - protein, 752 aa, Trifolium pratense
MAVAEETGGGTTIIDETYEFSAPRFFDFMKGESDDEIRRAELWFHTALSYAPSPFMPKIKAGRSITVDTLCDFSEADNHMPKMSANVEDNVSKSNTQSESMTSKIKEHDEAKEEKLTTVSQVISTNKKDDAPSCEAKEENNSTSLEDIVGKEMSDHKGGQCLKVVASTEASVEVAKDVCTPNPALRKNVNTTSTNSKKQQNSKKVSTNTKTRLQSAATKSTLGTPHFAQENQAIKRQKLEGGKTRQILNPKPQTLPHDKSKLGYCSSTSKIHKEDRKVYVRETPKTPASAPFVSMAEMMKRFQSSTRDLPLPNTLSHTKPKLTLTRPKEPEFETNQRVRPARVKSAAELEEEMMAKMPKFKARPLNKKILQTSTLPPMPRSTPQPPEFKEFHLETLARAHQNTDSASKASLEVSHKETSWKPHLTEPKHPLLQTSLRARPPTVKSSLEIEQEELEKIPKFKARPLNKKIFESKGDIGIFCHMKKHVTEPQEFHFATNERFPPPPTSVADLFDKLSLKSEPACNRNTIPKVTTPNPFHLHTEERGAEKEKKLIMELFQKELEEEATRVPKANPYPYTTDYPVIPPKPEPKQCTKPEPFQLESLVRHEEEMQKEQEERLRMEREQRKMRKFKAQPVLKEDPIPVPEKVRKPLTEVKEFDLHMNHRAVDRAQFDERIKEKEMMYKRYREESEAARMMEEEKALKQMRKTMVPHARPVPNFDNPFCPQKTSKTTKPKSPNLRVLQRRRKIFNGSAV

SEQ ID NO: 8395 - protein, 760 aa, Trifolium pratense
MAVASEATGGATTIIDETYEFSAPRFFDFMKGESDEEIRRAELWFHTALSYAPSPFMPKIKAGRSITIGTLCDFSEADNVPKMSANVEDSVLESNQQPQSMTSKIKEEGVAKEENLTNVSRVISTNKEDDVPCCKAKDENNSTYLEDVVGKEVSDHKGESLKVQTSTDASVEVGKDVCTPNPALRKNVNTTSTNSKKQQNSKTVSTNAKTRLQSAAKKSTSGTPHLAQENQAIKRQKLEGGKTRQILNPKPQTLPHDKSKLGYCSSTTSKIHKEDRKVYVRETPKTPASAPFVSMAEMMKRFQTSARDLPLHNTVSHTKPKLTLTRPKEPEFETNQRVRPARVKSAAELEEEMMAKMPKFKARPLNKKILQTSTLPPMPRSTPQPPEFKEFHLETLARAHQNTDSASKASLEVSHKETSWKPHLTEPKHPLLQTSLRARPPTVKSSLEIEQEELEKIPKFKARPLNKKIFESKGDIGIFCHMKKHVTEPQEFHFATNERFPPPTAVADLFDKLSLKSEPACNRNTIPKVTTPNPFHLHTEERGAKKEKKLIMELFQKELEEEATRVPKANPYPYTTDYPVIPPKPEPKKCTKPEPFQLESLVRHEEEMQKEQEERLRMEREQRKMRKFKAQPVLKEDPIPVPEKVRKPLTEVKEFDLHLNHRVVERAQFDERIKEKEMMYKRYREESEAARMMEEEKALKQMRKTMVPHARPVPNFDNPFCPQKISKTTKPKSPNLRVLQRRRKIFNGSTVSSSPTTNMR

SEQ ID NO: 8396 - protein, 706 aa, Trifolium pratense
PSPFMPKIKAGRSITIGTLCDFSEADNVPKMSANVEDSVLESNQQPQSMTSKIKEEGVAKEENLTNVSRVISTNKEDDVPCCKAKDENNSTYLEDVVGKEVSDHKGESLKVQTSTDASVEVGKDVCTPNPALRKNVNTTSTNSKKQQNSKKVSTNTKTRLQSAATKSTLGTPHFAQENQAIKRQKLEGGKTRQILNPKPQTLPHDKSKLGYCSSTSKIHKEDRKVYVRETPKTPASAPFVSMAEMMKRFQSSTRDLPLPNTLSHTKPKLTLTRPKEPEFETNQRVRPARVKSAAELEEEMMAKMPKFKARPLNKKILQTSTLPPMPRSTPQPPEFKEFHLETLARAHQNTDSASKASSEVSHKENSSKPHLTEPKPPLLQTSLRARPPTVKSSLEIEQEELEKIPKFKARPLNKKIFESKGDIGIFCHMKKHVTEPQEFHFATNERFPPPPTSVADLFDKLSLKSEPACNRNTIPKVTTPNPFHLHTEERGAEKEKKLIMELFQKELEEEATRVPKANPYPYTTDYPVIPPKPEPKQCTKPEPFQLESLVRHEEEIQKEQEERLRMQREERKMRKFKAQPILKEDPIPVPEKVRKPLTEVKEFDLHLNHRAVDRAQFDERIKEKEVMYKRYREESEAARMMEEEKALKQMRKTMVPHARPVPNFDNPFCPQKTSKTTKPKSPNLRVLQRRRKIFNGSAVSSPANIR

SEQ ID NO: 8397 - protein, 317 aa, Glycine max
MGVKGFVEGGIASIIAGCSTHPLDLIKVRMQLQGENNLPKPVQNLRPALAFQTGSTVHVAAAIPQTRVGPIAVGVRLVQQEGLAALFSGVSATVLRQTLYSTTRMGLYDVLKTKWTDSVTGTMPLSRKIEAGLIAGGIGAAVGNPADVAMVRMQADGRLPPAQRRNYKSVVDAITRMAKQEGVTSLWRGSSLTVNRAMLVTASQLASYDQFKETILENGMMRDGLGTHVTASFAAGFVAAVASNPVDVIKTRVMNMRVEPGATPPYAGALDCALKTVRAEGPMALYKGFIPTISRQGPFTVVLFVTLEQVRKLLKDF

SEQ ID NO: 8398 - protein, 316 aa, Phaseolus vulgaris
MGVKGFVEGGIASIIAGCSTHPLDLIKVRMQLQGESNAPKPVHNLRPALAFQTGSNLHVSAIPQARVGPIAVGVRLVQQEGLAALFSGVSATVLRQTLYSTTRMGLYDILKTKWTDPAAGTMPLGRKIEAGLIAGGIGAAVGNPADVAMVRMQADGRLPLAERRNYKSVVDAILRMARQEGVTSLWRGSSLTVNRAMLVTASQLASYDQFKETILEKGLMRDGLGTHVTASFAAGFVAAVASNPVDVIKTRVMNMKVEPGAAPPYAGALDCALKTVRAEGPMALYKGFIPTISRQGPFTVVLFVTLEQVRKLLKDF

SEQ ID NO: 8399 - protein, 318 aa, Lupinus angustifolius
MGLKGFAEGGIASIIAGCSTHPLDLIKVRMQLQGEPSPNPVHNLRPALAFQNGSSIHVSPAPQTPQIKPRMGPIAVGVRLVQQEGVAALFSGVSATVLRQTLYSTTRMGLYDVLKQKWSTGGNMPLSRKIEAGLIAGGIGAAVGNPADVAMVRMQADGRLPPAQRRNYKSVVDALSTMVKREGVTSLWRGSSLTVNRAMLVTASQLASYDQFKEMILEKGLMRDGLGTHVTASFAAGFVAAVATNPVDVIKTRVMNMRVEPGAEAPYSGAVDCALKTVRAEGPMALYKGFIPTISRQGPFTVVLFVTLEQVRKLFKDF

SEQ ID NO: 8400 - protein, 315 aa, Lupinus angustifolius
MGIKGFVEGGIASIIAGCSTHPLDLIKVRMQLQGESNPAPVRNIRSELAFHNGSSIHVAQAPQIKPRVGPISVGIRLVQQEGVAALFSGISATVLRQTLYSTTRMGLYDILKQKWSIGGNMPLSRKIEAGLIAGAVGAAVGNPADVAMVRMQADGRLPPAQRRNYKSVVDAISTMVKQEGVTSLWRGSSLTVNRAMLVTASQLASYDQFKEMILEKGVMRDGLGTHVTASFAAGFVASVASNPVDVIKTRVMNMRVEPGAEPPYSGALDCALKTVRAEGPMALYKGFIPTISRQGPFTVVLFVTLEQVRKLFKDY

SEQ ID NO: 8401 - protein, 317 aa, Glycine max
MGVKGFVEGGIASIIAGCSTHPLDLIKVRMQLQGENNLPKPVQNLRPALAFQTGSTLHVAAAVPPPRVGPISVGVRLVQQEGLAALFSGVSATVLRQTLYSTTRMGLYDVLKTKWTDSVTGTMPLGKKIEAGLIAGGIGAAVGNPADVAMVRMQADGRLPPAQRRNYKSVVDAITRMAKQEGVTSLWRGSSLTVNRAMLVTASQLASYDQFKEMILENGVMRDGLGTHVTASFAAGFVAAVASNPIDVIKTRVMNMRVEPGEAPPYAGALDCALKTVRAEGPMALYKGFIPTISRQGPFTVVLFVTLEQVRKLLKDF

SEQ ID NO: 8402 - protein, 320 aa, Cicer arietinum
MGVKGFVEGGIASIIAGCSTHPLDLIKVRMQLQGENAPKPNPVHNLRPALAFQTGTTSIHVGPTPLPQPRVGPISVGVRLVQQEGVRALFSGVSATVLRQTLYSTTRMGLYDILKTKWSDQASGNMPLARKIEAGLIAGGVGAAIGNPADVAMVRMQADGRLPSAQRRNYKSVVDAITRMAKQEGVTSLWRGSSLTVNRAMLVTASQLASYDQFKEMILEKGVMRDGLGTHVTASFAAGFVAAVASNPVDVIKTRVMNMKVEAGKEAPYAGALDCALKTVRAEGPMALYKGFIPTISRQGPFTVVLFVTLEQVRKLFKDF

SEQ ID NO: 8403 - protein, 316 aa, Cajanus cajan
MGVKGFAEGGIASIIAGCSTHPLDLIKVRMQLQGETNVPKPLHNLRPALAFQTGSTVHVAALPQPRVGPIAVGVRLVQQEGVAALFSGVSATVLRQMLYSTTRMGLYDVLKTKWTDPAAGTMPLTRKIEAGLIAGGVGAAVGNPADVAMVRMQADGRLPAAERRNYKSVVDAITRMARSEGVASLWRGSSLTVNRAMLVTASQLASYDQFKEMILEKGLMRDGLGTHVTASFAAGFVAAVASNPVDVIKTRVMNMKVEPGAAPPYAGALDCALKTVRAEGPMALYKGFVPTISRQGPFTVVLFVTLEQVRKLLKDF

SEQ ID NO: 8404 - protein, 324 aa, Lotus japonicus
MGLKGFAEGGIASIIAGCSTHPLDLIKVRMQLQGEANAAPKPVQQLRPALAFQNGSTIHVAAHPHSPPPPPMPQPRVGPISVGVRLVQQEGLRALFSGVSATVLRQMLYSTTRMGLYDILKQKWSNGGNMPLSRKIEAGLIAGGIGAAVGNPADVAMVRMQADGRLPAAQRRNYSSVVDAITRMAKQEGVTSLWRGSSLTVNRAMLVTASQLASYDQFKEMILEKGLMRDGLGTHVTASFAAGFVAAVASNPVDVIKTRVMNMKVEPGAEPPYAGALDCALKTVRAEGPMALYKGFIPTISRQGPFTVVLFVTLEQVRKMFKDY

SEQ ID NO: 8405 - protein, 322 aa, Medicago truncatula
MGVKGFVEGGIASIIAGCSTHPLDLIKVRMQLQGENAPKPNPVQILRPALAFGQTGTTTIHVGSTPVPQPRVGLVSVGVRLVQQEGVTALFSGISATVLRQTLYSTTRMGLYEVLKNKWTDREAGGTMPLVRKIEAGLIAGGVGAAIGNPADVAMVRMQADGRLPPAQQRNYKSVVDAITRMAKQEGVTSLWRGSSLTVNRAMLVTASQLASYDQFKEMILEKGVMRDGLGTHVTASFAAGFVAAVASNPVDVIKTRVMNMKVEAGKEPPYAGALDCALKTVRAEGPMALYKGFIPTISRQGPFTVVLFVTLEQVRKLLKDF

SEQ ID NO: 8406 - protein, 324 aa, Trifolium pratense
MGVKGFVEGGIASIIAGCSTHPLDLIKVRMQLQGENAPKPNPVQVLRPALAFGQTGSATSIHVAGQTAVPQARVGLVSVGVRLVQQEGVKALFSGVSATVLRQTLYSTTRMGLYDILKNKWTDREAGGTMPLARKIEAGLIAGGVGAAIGNPADVAMVRMQADGRLPAAQRRNYKSVVDAITRMAKQEGVTSLWRGSSLTVNRAMLVTASQLASYDQFKEMILEKGVMKDGLGTHVTASFAAGFVAAVASNPVDVIKTRVMNMKVEAGKEPPYAGALDCAMKTIRAEGPMALYKGFIPTISRQGPFTVVLFVTLEQVRKVLKDF

SEQ ID NO: 8407 - protein, 324 aa, Trifolium pratense
MGVKGFVEGGIASIIAGCSTHPLDLIKVRMQLQGENAPKPNPVQVLRPALAFGQTGSATSIHVAGQTAVPQARVGLVSVGVRLVQQEGVKALFSGVSATVLRQTLYSTTRMGLYDILKNKWTDREAGGTMPLARKIEAGLIAGGVGAAIGNPADVAMVRMQADGRLPAPQRRNYKSVVDAITRMAKQEGVTSLWRGSSLTVNRAMLVTASQLASYDQFKEMILEKGVMKDGLGTHVTASFAAGFVAAVASNPVDVIKTRVMNMKVEAGKEPPYAGALDCAMKTIRAEGPMALYKGFIPTISRQGPFTVVLFVTLEQVRKVLKDF

SEQ ID NO: 8408 - protein, 322 aa, Trigonella foenum-graecum
MGVKGFVEGGIASIIAGCSTHPLDLIKVRMQLQGENAPKPNPVQILRPALAFGQTGTTTMHVGPTPVPQPRVGLISVGVRLVQQEGVTALFSGISATVLRQTLYSTTRMGLYEVLKNKWTDREAGGTMPLARKIEAGLIAGGVGAAIGNPADVAMVRMQADGRLPPAQRRNYKSVVDAITRMAKQEGVTSLWCGSTLTVNRAMLVTASQLASYDQFKEMILEKGVMSDGLGTHVTASFAAGFVASVASNPVDVIKTRVMNMKVEVGKEPPYAGALDCALKTVRAEGPMALYKGFIPTISRQGPFTVVLFVTLEQVRKLLKDF

SEQ ID NO: 8409 - protein, 316 aa, Vigna unguiculata
MGVKGFVEGGIASIIAGCSTHPLDLIKVRMQLQGENNAPKPVHNLRPALAFQSGSNVHVATIPQARVGPIGVGVRLVQQEGLAALFSGVSATVLRQTLYSTTRMGLYDILKTKWTDPASGTMHLGRKIEAGLIAGAIGAAVGNPADVAMVRMQADGRLPPAERRNYKSVVDAILRMARQEGVTSLWRGSSLTVNRAMLVTASQLASYDQFKEMILQRGVMRDGLGTHVTASFAAGFVAAVASNPVDVIKTRVMNMKVEPGSPPPYAGALDCALKTVRAEGPMALYKGFVPTISRQGPFTVVLFVTLEQVRKLLKDF

SEQ ID NO: 8410 - protein, 324 aa, Cucumis melo
MGVKGFVEGGIASIVAGCSTHPLDLIKVRMQLQGETPAPTAAVNNLRPALAFQTTSVTAPRSINIPPPPPPTARVGPIAVGVRIVQQEGVAALFSGVSATVLRQTLYSTTRMGLYDILKQKWTDQDTGKMPLIRKISAGLIAGAVGAAVGNPADVAMVRMQADGRLPLAQRRNYKSVVDAITQMARGEGVTSLWRGSSLTVNRAMLVTASQLASYDQIKETILQKGLMKDGLGTHVTASFAAGFVAAVASNPVDVIKTRVMNMKVEAGAAPPYSGALDCALKTVRAEGPMALYKGFIPTISRQGPFTVVLFVTLEQVRKVFKDF

SEQ ID NO: 8411 - protein, 325 aa, Trifolium pratense
MGVKGFVEGGIASIIAGCSTHPLDLIKVRMQLQGENAAPKPNPVQVLRPALAFGQTGTATSIHVAAQTAVPQARVGLVSVGVRLVQQEGVKALFSGVSATMLRQTLYSTTRMGLYDILKNKWTDSEAGGTMPLARKIEAGLIAGGVGAAIGNPADVAMVRMQADGRLPAAQRRNYKSVVDAITRMAKQEGVTSLWRGSSLTVNRAMLVTASQLASYDQFKEMILEKGVMKDGLGTHVTASFAAGFVAAVASNPVDVIKTRVMNMKVEAGKEPPYAGALDCAMKTIRAEGPMALYKGFIPTISRQGPFTVVLFVTLEQVRKVLKDF

SEQ ID NO: 8412 - protein, 321 aa, Eucalyptus grandis
MGVKGFVEGGIASIVAGCSTHPLDLLKVRMQLQGEGHAPPNPSVQNLRPALAFQSPAAAAAPLPRPLPPPRVGLVTVGVRLVRQEGVAALYSGVSATVLRQTLYSTTRMGLYDVLKQKWTDPATGNMPLTRKIVAGLIAGGIGAAVGNPADVAMVRMQADGRLPPEQRRNYRSVVDAIQRMARQEGVASLWRGSSLTVNRAMLVTASQLASYDQIKETILAKGLMKDGLGTHVTASFAAGFVAAVASNPVDVIKTRVMNMKVEEGREPPYRGAVDCALKTVRAEGPMALYKGFIPTISRQGPFTVVLFVTLEQVRKLLKDF

SEQ ID NO: 8413 - protein, 311 aa, Citrus clementina
  Sequence also found in Organisms: Citrus sinensis
MGVKGFVEGGIASIVAGCSTHPLDLIKVRMQLQGENQVPSMRPALAFHANSSAVHVSAPPRLGPVGVGVRIIQQEGVSALFSGVSATVLRQTLYSTTRMGLYDVLKQKWTDPETRNMPLVRKIAAGLIAGGIGAAVGNPADVAMVRMQADGRLPPAQRRNYKSVVDAITSMAKQEGVTSLWRGSSLTVNRAMLVTASQLASYDQIKENILSKGWMRDGLGTHVTASFSAGFVAAVASNPVDVIKTRVMNMKVEAGKEPPYKGALDCALKTVRSEGPMALYKGFIPTISRQGPFTVVLFVTLEQVRKLMKDF

SEQ ID NO: 8414 - protein, 326 aa, Trifolium pratense
MGVKGFVEGGIASIIAGCSTHPLDLIKVRMQLQGENAAPKPNPVQVLRPALAFGQTGTATSIHVAAAQTAVPQARVGLVSVGVRLVQQEGVKALFSGVSATMLRQTLYSTTRMGLYDILKNKWTDSEAGGTMPLIRKIEAGLIAGGVGAAIGNPADVAMVRMQADGRLPAAQRRNYKSVVDAITRMAKQEGVTSLWRGSSLTVNRAMLVTASQLASYDQFKEMILEKGVMKDGLGTHVTASFAAGFVAAVASNPVDVIKTRVMNMKVEAGKEPPYAGALDCAMKTVRAEGPLALYKGFIPTISRQGPFTVVLFVTLEQVRKVMKDF

SEQ ID NO: 8415 - protein, 326 aa, Trifolium pratense
MGVKGFVEGGIASIIAGCSTHPLDLIKVRMQLQGENAAPKPNPVQVLRPALAFGQTGTATSIHVAAAQTAVPQARVGLVSVGVRLVQQEGVKALFSGVSATMLRQTLYSTTRMGLYDILKNKWTDREAGGTMPLIRKIEAGLIAGGVGAAIGNPADVAMVRMQADGRLPAAQRRNYKSVVDAITRMAKQEGVTSLWRGSSLTVNRAMLVTASQLASYDQFKEMILEKGVMKDGLGTHVTASFAAGFVAAVASNPVDVIKTRVMNMKVEAGKEPPYAGALDCAMKTVRAEGPLALYKGFIPTISRQGPFTVVLFVTLEQVRKVMKDF

SEQ ID NO: 8416 - protein, 324 aa, Vicia sativa
MGVKGFVEGGVASIIAGCSTHPLDLIKVRMQLQGENAPKPNPVQNLRPALAFGPTGTTSINVAHTPVAPAIQPRVGPISVGVRLVQQEGVRALFSGVSATVLRQTLYSTTRMGLYDILKNKWSDREAGTMPLLRKIEAGLIAGGVGAAIGNPADVAMVRMQADGRLPVSQRRNYKSVIDAITRMAKQEGVTSLWRGSSLTVNRAMLVTASQLASYDQFKEIILEKGLMKDGLGTHVTASFAAGFVAAVVTNPVDVIKTRVMNMRVEPGKEPPYAGALDCAVKTVRAEGPMALYKGFIPTISRQGPFTVVLFVTLEQVRKLLKDF

SEQ ID NO: 8417 - protein, 319 aa, Ricinus communis
MGVKGFVEGGIASIIAGCSTHPLDLIKVRMQLQGETHAPTAVQTLRPALAFHPPGTTTPASAIHVHPPRVGPISVGVRIVQQEGVAALFSGVSATVLRQTLYSTTRMGLYDILKQKWTDPNTKTMPLSSKIVAGLIAGGIGAAVGNPADVAMVRMQADGRLPPAQRRNYKSVVDAITRMTKQEGITSLWRGSSLTVNRAMLVTASQLASYDQFKEMILEKGWMRDGLGTHVTASFAAGFVAAVASNPVDVIKTRVMNMKVEPGKAPPYSGALDCALKTVKAEGPMALYKGFIPTISRQGPFTIVLFVTLEQVRKLLKDF

SEQ ID NO: 8418 - protein, 324 aa, Cucumis sativus
MGVKGFVEGGIASIVAGCSTHPLDLIKVRMQLQGETPAPTAAVHNLRPALAFQTTSVTAPKSINIPPPPPPPARVGPIAVGVRIVQQEGVAALFSGVSATVLRQTLYSTTRMGLYDILKQKWTDQDTGKMPLIRKISAGLIAGAVGAAVGNPADVAMVRMQADGRLPLAQRRNYKSVVDAITQMARGEGVTSLWRGSSLTVNRAMLVTASQLASYDQIKETILQKGLMKDGLGTHVTASFAAGFVASVASNPVDVIKTRVMNMKVEAGAAPPYSGALDCALKTVRAEGPMALYKGFIPTISRQGPFTVVLFVTLEQVRKVLKDF

SEQ ID NO: 8419 - protein, 321 aa, Euphorbia esula
MGFKGFLEGGIASIIAGCSTHPLDLLKVRMQLQGESHAPPVQTLRPALAFHRGGTTTIHVPQQPPLPPPPRVGLVTLGVKLVQKEGPAALFSGVSATVLRQTLYSTTRMGLYDILKQKWTDPKTKTMPLASKIGAGLIAGGIGAAVGNPADVAMVRMQADGRLPPGERRNYKSVVDAITRMSKQEGIASLWRGSSLTVNRAMLVTASQLASYDQFKEMILEKGLMKDGLGTHVTASFAAGFVAAVVSNPVDVIKTRVMNMKVEAGGVPPYAGALDCALKTVKAEGPLALYKGFIPTISRQGPFTVVLFVTLEQVRKLFNDF

SEQ ID NO: 8420 - protein, 314 aa, Euphorbia peplus
MGFKGFVEGGIASIIAGCSTHPLDLLKVRMQLQGESQSHAPLRPALAFQRGGPTTTIHVPPPPRVGLVTLGVKLVQKEGPAALFSGVSATVLRQTLYSTTRMGLYDIFKQKWTDPNTKTMPLSSKIAAGLIAGGIGAAVGNPADVAMVRMQADGRLPPGERRNYKSVVDAITRMSKQEGVASLWRGSSLTVNRAMLVTASQLSSYDQFKEMILEKKLMKDGLGTHVMASFAAGFVAAVVSNPVDVIKTRVMNMKVEAGGAPPYAGALDCALKTVKAEGPLALYKGFIPTISRQGPFTVVLFVTLEQVRKVFKDW

SEQ ID NO: 8421 - protein, 318 aa, Vitis vinifera
MGLKGFVEGGIASIIAGCSTHPLDLIKVRMQLQGETQVPNPAVQTLRPALAFQTGAAPTAVHVTRPPRVGPITVGVRIVQQEGVVALFSGVSATVLRQTLYSTTRMGLYDILKKKWTDPATGNMPLVSKIGAGLIAGGIGAVVGNPADVAMVRMQADGRLPLAQRRNYKSVLDAITRMSKQEGVTSLWRGSSLTVNRAMLVTASQLASYDQIKETILQKGLMKDGLGTHVTASFAAGFVAAVASNPVDVIKTRVMNMKVEPGAAPPYTGALDCALKTVRAEGPMALYKGFIPTISRQGPFTIVLFVTLEQVRKLLKDF

SEQ ID NO: 8422 - protein, 322 aa, Nicotiana benthamiana
MGVKGFVEGGIASIIAGCSTHPLDLIKVRMQLQGETPAPAAAVQNLRPALAFHSGTHATTHIHVPAPPPPPRVGPVAVGVKIIQQEGVAALFSGVSATVLRQTLYSTTRMGLYDMLKQKWTDPDTNNMPLSRKIVAGLIAGGIGAAVGNPADVAMVRMQADGRLPLAQRRNYKSVVDAITQMSKSEGITSLWRGSSLTVNRAMLVTASQLASYDQFKETILEKGLMKDGLGTHVTASFAAGFVAAVASNPVDVIKTRVMNMRVEPGMTPPYSGALDCAMKTIKAEGPMALYKGFIPTISRQGPFTIVLFVTLEQVRKLLKDY

SEQ ID NO: 8423 - protein, 322 aa, Nicotiana tabacum
MGVKGFVEGGIASIIAGCSTHPLDLIKVRMQLQGETPAPAAAVQNLRPALAFHSGTHATTHIHVPAPPPPPRVGPVAVGVKIIQQEGVAALFSGVSATVLRQTLYSTTRMGLYDMLKQKWTDPDTNNMPLSRKIVAGLIAGGIGAAVGNPADVAMVRMQADGRLPLAQRRNYKSVVDAITQMSKSEGITSLWRGSSLTVNRAMLVTASQLASYDQFKETILEKGLMKDGLGTHVTASFAAGFVAAVASNPVDVIKTRVMNMRVEPGMAPPYSGALDCAMKTIKAEGPMALYKGFIPTISRQGPFTIVLFVTLEQVRKLLKDY

SEQ ID NO: 8424 - protein, 323 aa, Citrullus lanatus
MGFKGFLEGGIASIVAGCSTHPLDLIKVRMQLQGETPAPTAAVHNLRPALAFQTTSVTAPRSLNIPPPPPAARVGPIAVGVRIVQQEGVAALFSGVSATVLRQTLYSTTRMGLYDILKQKWTDQDTGKMPLIRKISAGLIAGAVGAAVGNPADVAMVRMQADGRLPLAQRRNYKSVVDAITQMARGEGVTSLWRGSSLTVNRAMLVTASQLASYDQIKETILQKGLMKDGLGTHVTASFAAGFVAAVASNPVDVIKTRVMNMKVEAGAAPPYSGALDCALKTVRAEGPMALYKGFIPTISRQGPFTVVLFVTLEQVRKVFKDF

SEQ ID NO: 8425 - protein, 321 aa, Fragaria vesca
MGVKGFVEGGIASIVAGCSTHPMDLIKVRMQLQGETQVPKPDQALRPAMASAARGAASSIHVPVPPTPPPRVGLVTVGVKLIQQEGVAALFSGVSATMLRQCLYSTTRMGLYDILKKKWTDPETGNMPLQRKIGAGLIAGAIGATVGNPADVAMVRMQADGRLPAAERRNYKSVVDAITRMAKQEGVTSLWRGSSMTVNRAMLVTASQLASYDQFKETILEKELMRDGLGTHITASFAAGFVAAVASNPVDVIKTRVMNMKVEPGAAPPYKGALDCAVQTVRSEGPMALYKGFIPTISRQGPFTVVLFVTLEQVRKLLKDF

SEQ ID NO: 8426 - protein, 322 aa, Nicotiana tabacum
MGVKGFVEGGIASIIAGCSTHPLDLIKVRMQLQGETPAPAPAVQNLRPALAFHSGTHATTHIHVPAPPPPPRVGPVAVGVKIIQQEGVAALFSGVSATVLRQTLYSTTRMGLYDMLKQKWTDPDTNNMPLSRKIVAGLIAGGIGAAVGNPADVAMVRMQADGRLPLAQRRNYKSVVDAITQMSKSEGITSLWRGSSLTVNRAMLVTASQLASYDQFKETILEKGLMNDGLGTHVTASFAAGFVAAVASNPVDVIKTRVMNMKVEPGTVPPYSGALDCAMKTIKAEGPMALYKGFIPTISRQGPFTIVLFVTLEQVRKLLKDY

SEQ ID NO: 8427 - protein, 325 aa, Manihot esculenta
MGLKGFVEGGIASIIAGCSTHPLDLIKVRMQLQGETHAPNPAAAQSLRPALAFHTTTPGTTLHVPQQPFPTPVPRVGPITVGVRIVQQEGVAALFSGVSATVLRQTLYSTTRMGLYDILKQKWTDPNTKTMPLTSKIVAGLIAGGIGAAVGNPADVAMVRMQADGRLPPAQRRNYKSVVDAITRMAKQEGITSLWRGSSLTVNRAMLVTASQLASYDQFKETILEKRLMSDGLGTHVTASFAAGFVAAVASNPVDVIKTRVMNMKVEAGEAPPYAGALDCAIKTVKAEGPMALYKGFIPTISRQGPFTIVLFVTLEQVRKLLKDF

SEQ ID NO: 8428 - protein, 320 aa, Panax ginseng
MGVKGFVEGGIASIIAGCSTHPLDLIKVRMQLQGESAAPAPAVQTLRPALAFQTGSTARIHVPTPPPPPRVGPIAVGVRIVQQDGARALFSGVSATVLRQTLYSTTRMGLYDILKQKWTDPNTGNMPLARKIGAGLIAGGIGAAVGNPADVAMVRMQADGRLPFAQRRNYKSVVDAISQMTKNEGITSLWRGSSLTVNRAMLVTASQLASYDQIKETILDNGLMKDGLGTHVTASFAAGFVASVVTNPVDVIKTRVMNMKVEPGKAPPYAGALDCALKTVRSEGPMALYKGFIPTISRQGPFTVVLFVTLEQVRKLLKDF

SEQ ID NO: 8429 - protein, 171 aa, Vaccinium corymbosum
MGLKGFVEGGIASIVAGVSTHPLDLLKVRMQLQGEAQATHSLRPALAFQTGSHGAFHAPPHPHAPPRVGLVSVGMRIVQQEGVAALFSGVSATVLRQTLYSTTRMGLYDMLKKKWSDPTTGNMPLVQKIAAGLIAGGIGAAVGNPADVAMVRMQADGRLPLAQRRNYKKRN

SEQ ID NO: 8430 - protein, 324 aa, Vinca minor
MGFKGFVEGGIASIVAGCSTHPMDLIKVRMQLQGEGPGPTPAVQTLRPALAFHTTVGHSSRIHVPSPPPPPLPRVGPIAVGVKIVQQEGMAALFSGVSATVLRQTLYSTTRMGLYDVLKQKWTDPHTNNMPLTRKIAAGLVAGAIGAAVGNPADVAMVRMQADGRLPVAQRRNYKSVVDAITQMSKNEGVTSLWRGSSLTVNRAMLVTASQLASYDQFKETILEKGLMKDGLGTHVTASFAAGFVASVASNPVDVIKTRVMNMKVEPGMDAPYSGALDCAMKTIKAEGPMALYKGFIPTISRQGPFTIVLFVTLEQVRKLFKEF

SEQ ID NO: 8431 - protein, 325 aa, Catharanthus roseus
MGLKGFAEGGIASIVAGCSTHPLDLIKVRMQLQGEAPAPTRSVQALRPALAFHTTVGHASHIHVPSPPLPPPPPRVGLIGVGVKIVQQEGMAALFSGVSATVLRQTLYSTTRMGIYDILKQKWTDPHTKNMPLTRKIAAGLVAGAIGAAVGNPADVAMVRMQADGRLPVAQRRNYKSVVDAITQMSKNEGITSLWRGSSLTVNRAMLVTASQLASYDQFKEMILEKGLMKDGLGTHVVASFSAGFVAAVASNPVDVIKTRVMNMKVEAGAAPPYSGALDCAMKTIKAEGPMALYKGFIPTISRQGPFTIVLFVTLEQVRKIFKDF

SEQ ID NO: 8432 - protein, 311 aa, Cicer arietinum
MGVKGFVEGGIASIIAGCSTHPLDLIKVRMQLQGEIQTPNIRPAMAIQPGSVHSLPPPPRVGPISVGVKLVQQEGVAALFSGVSATVLRQVLYSTTRMGLYDMLKKKWTDPNAGGTMPLTSKIAAGLIAGGIGAAVGNPADVAMVRMQADGRLPPTQRRNYKSVVDAITRMAKDEGVTSLWRGSSLTVNRAMLVTASQLASYDEFKETILEKGWMRDGLGTHVTASFAAGFVAAVVTNPVDVIKTRVMNMKVEVGSPPPYSGAVDCVLKTVRGEGPMALYKGFIPTITRQGPFTVVLFVTLEQVRKLLKDF

SEQ ID NO: 8433 - protein, 320 aa, Panax ginseng
MGVKGFVEGGIASIIAGCSTHPLDLIKVRMQLQGESAAPAPAIQTLRPALAFQTGSTARIHVPTPPPPPRVGPIAVGVRIVQQDGVRALFSGVSATVLRQTLYSTTRMGLYDILKQKWTDPNTGNMPLVRKIGAGLIAGGIGAAVGNPADVAMVRMQADGRLPFAQRRNYKSVVDAISQMTKNEGITSLWRGSSLTVNRAMLVTASQLASYDQIKETILDNGLMKDGLGTHVTASFAAGFVAAVVTNPVDVIKTRVMNMKVEPGKAPPYAGALNCALKTVRSEGPMALYKGFIPTISRQGPFTVVLFVTLEQVRKLLKDF

SEQ ID NO: 8434 - protein, 320 aa, Panax ginseng
MGVKGFVEGGIASIIAGCSTHPLDLIKVRMQLQGESAAPAPAIQTLRPALAFQTGSTARIHVPTPPPPPRVGPIAVGVRIVQQDGVRALFSGVSATVLRQTLYSTTRMGLYDILKQKWTDPNTGNMPLVRKIGAGLIAGGIGAAVGNPADVAMVRMQADGRLPFAQRRNYKSVVDAISQMTKNEGITSLWRGSSLTVNRAMLVTASQLASYDQIKETILDNGLMKDGLGTHVTASFAAGFVASVVTNPVDVIKTRVMNMKVEPGKAPPYAGALDCALKTVRSEGPMALYKGFIPTISRQGPFTVVLFVTLEQVRKLLKDF

SEQ ID NO: 8435 - protein, 310 aa, Lotus japonicus
MGIKGFVEGGIASMIAGCSTHPLDLIKVRMQLQGEAQSQNLRPSLAFNPTSTHPPPPAAARPGPIAVGVKLVQQEGFAALFSGVSATVLRQLLYSSTRMGLYDMMKKKWSNPNGTMPLTNKIAAGLIAGGIGAAVGNPADVAMVRMQADGRLPPAQRRNYKSVVDAITRMVKDEGVTSLWRGSSLTVNRAMLVTASQLASYDQFKEMILEMGLMGDGLGTHVTASFSAGFVAAVASNPVDVIKTRVMNMKVEPGAAPPYSGAIDCALKTVRAEGPMALYKGFIPTISRQGPFTVVLFVTLEQVRKLLKDF

SEQ ID NO: 8436 - protein, 324 aa, Solanum tuberosum
MGVKGFVEGGIASIIAGCSTHPLDLIKVRMQLQGETPISAPATVHNLRPALAFHTGAANHTISIPAPSVVAPPRVGPVSVGVKIIQQEGVAALFSGVSATVLRQTLYSTTRMGLYDMLKQKWTDPDTNIMPLSKKIVAGLIAGGIGAAVGNPADVAMVRMQADGRLPISQRRNYKSVIDAITQMSKSEGVTSLWRGSSLTVNRAMLVTASQLASYDQFKETILEKGLMKDGLGTHVTSSFAAGFVAAVASNPVDVIKTRVMNMKVEPGMAPPYNGAIDCAMKTIKAEGPMALYKGFIPTISRQGPFTVVLFVTLEQVRKMLKDF

SEQ ID NO: 8437 - protein, 315 aa, Vinca minor
MGFKGFAEGGIASIVAGCSTHPLDLIKVRMQLQGEAPSVRVQTLRPALAFHTTVGHASHIHVPSPPPRVGPVAVGVKIVQQEGMAALFSGVSATVLRQTLYSTTRMGLYDVLKQKWTDPHSKNMPLTRKIAAGLVAGAVGAAVGNPADVAMVRMQADGRLPAAQRRNYKSVVDAITKSEGITSLWRGSSLTVNRAMLVTASQLASYDQFKETILEKGLMKDGLGTHVTASFAAGFVAAVASNPVDVIKTRVMNMKVEPGMDAPYSGALDCAMKTIKAEGPMALYKGFIPTISRQGPFTIVLFVTLEQVRKIFKEY

SEQ ID NO: 8438 - protein, 317 aa, Trifolium pratense
MGVKGFVEGGIASVIAGCSTHPLDLIKVRMQLQGENSQKPNIRPALAFQHGYVRSSQLSAATATPRVGPIAVGVKLVQQEGVTALFSGVSATVLRQVLYSTTRMGLYDMLKKKWSDPNSGGTLPLTRKIAAGLLAGGIGAMVGNPADVSMVRMQADGRLPLAQRRNYKSVVDAITRMVKDEGVTSLWRGSSLTVNRAMLVTASQLASYDEFKEMILEKGWMKDGLGTHVTASFAAGFVAAVASNPVDVIKTRVMNMKVEAGSPPPYSGAIDCALKTVRAEGPMALYKGFIPTITRQGPFTVVLFVTLEQVRKLLKDF

SEQ ID NO: 8439 - protein, 315 aa, Medicago truncatula
MGVKGFVEGGIASIIAGCSTHPLDLIKVRMQLQGENAPTTNIRPALAFQPGSVHRSPAVTAQPPRVGPIAVGVKLVQQEGVAALFSGVSATVLRQCLYSTTRMGLYDMMKKKWSDPISGTLPLTSKIGAGLLAGGIGAAVGNPADVAMVRMQADGRLPSAQRRNYKSVVDAISRMAKDEGVTSLWRGSSLTVNRAMLVTASQLASYDEFKEKILKNGWMKDGLGTHVVASFSAGFVAAVASNPVDVIKTRVMNMKVEAGSPPPYSGAIDCALKTIRAEGPMALYKGFIPTITRQGPFTVVLFVTLEQVRKLLKDF

SEQ ID NO: 8440 - protein, 320 aa, Mimulus guttatus
MGVKGFVEGGIASIVAGCSTHPLDLIKVRMQLQGEAAAAAPPPALRPALAFQTPSSSVAQNVRLTPPPPRVGPVAVGLRIVQQDGFAGLFSGVSATVLRQTLYSTTRMGLYDILKTKWSDPNTNNMPLTRKIVAGLIAGGIGAAVGNPADVAMVRMQADGRLPAAQRRNYKSVVDAISQMSKGEGVASLWRGSSLTVNRAMVVTASQLASYDQIKETILDKGLMKDGLGTHVTASFAAGFVASVASNPVDVIKTRVMNMKVEPGVAPPYAGAIDCAMKTIRAEGPMALYKGFIPTISRQGPFTVVLFVTLEQVRKLLKDF

SEQ ID NO: 8441 - protein, 314 aa, Cajanus cajan
MGVKGFVEGGIASVIAGCSTHPLDLIKVRMQLQGETQHSNLRPALAFHPTSVHAPPHRPAKAGPIAVGVKLVQQEGVAALFSGVSATILRQLLYSTTRMGLYEVLKEKWSEPNSAGGTTMPLTRKIAAGLMAGGIGAAVGNPADVSMVRMQADGRLPPAQRRNYKSVVDAITRMVKDEGVTSLWRGSSLTINRAMLVTASQLASYDQFKEMILERGVMGDGLGTHVTASFAAGFVAAVTSNPVDVIKTRVMNMKVEPGAAPPYSGALDCAMKTVRAEGPMALYKGFVPTISRQGPFTVVLFVTLEQVRKLLKDF

SEQ ID NO: 8442 - protein, 321 aa, Gossypium hirsutum
MGVKGFVEGGIASIVAGCSTHPLDLIKVRMQLQGESHVPNPAVQALRPALAFQTTTTTTSSAIHMPPPPARVGPVATGIKIFRTEGVAALFSGVSATVLRQTLYSTTRMGLYDILKQKWTDKETKTMPLSRKITAGLIAGGIGAAVGNPADVAMVRMQADGRLPVSQRRNYTSVVDAITRMTKQEGVTSLWRGSSLTVNRAMLVTASQLASYDQIKEMILENGLMKDGLGTHVAASFSAGFVAAVASNPVDVIKTRVMNMKVEAGQKPPYAGALDCAIKTVKAEGPMALYKGFIPTISRQGPFTVVLFVTLEQVRKLLKDF

SEQ ID NO: 8443 - protein, 321 aa, Gossypium raimondii
MGVKGFVEGGIASIVAGCSTHPLDLIKVRMQLQGESHVPNPAVQTLRPALAFQTTTTTTSSAIHMPPPPARVGPVATGIKIFRTEGVAALFSGVSATVLRQTLYSTTRMGLYDILKQKWTDKETKTMPLSRKITAGLIAGGIGAAVGNPADVAMVRMQADGRLPVSQRRNYTSVVDAITRMTKQEGVTSLWRGSSLTVNRAMLVTASQLASYDQIKEMILENGLMKDGLGTHVAASFSAGFVAAVASNPVDVIKTRVMNMKVEAGQKPPYAGALDCAIKTVKAEGPMALYKGFIPTISRQGPFTVVLFVTLEQVRKLLKDF

SEQ ID NO: 8444 - protein, 322 aa, Platanus occidentalis
MGLKGFIEGGIASIIAGCSTHPLDLIKVRMQLQGESQVPNPAIQTLRPALAFNNTSAAAPGTIRAPPPPPPRVGPITVGVRIVQTEGVAALFSGVSATVLRQTLYSTTRMGLYDILKQKWTDPRSGNMPLVRKITAGLIAGGIGAAVGNPADVAMVRMQADGRLPLAQRRNYKSVVDAITQMSKQEGITSLWRGSSLTVNRAMIVTASQLASYDQIKESILAKGLMRDGLGTHVTASFAAGFVASVASNPVDVIKTRVMNMKVEAGAAPPYSGALDCAMKTVRAEGPMALYKGFIPTITRQGPFTVVLFVTLEQVRKLLKDF

SEQ ID NO: 8445 - protein, 325 aa, Amsonia hubrichtii
MGFKGFLEGGIASIVAGCSTHPLDLIKVRMQLQGEAAAPTPAVQSLRPALAFHTTVANASHIHVPSPPLPPPPPRAGLISVGVKIVRQEGMAALFSGVSATVLRQTLYSTTRMGLYDVLKQKWTDPHTKNMPLTSKITAGLIAGAVGAAVGNPADVAMVRMQADGRLPVAQRRNYKSVVDAITQMSKNEGITSLWRGSSLTVNRAMLVTASQLASYDQIKETILEKGVMKDGLGTHVTASFAAGFVAAVASNPVDVIKTRVMNMKVEPGMAPPYNGALDCAMKTIKAEGPMALYKGFIPTISRQGPFTIVLFVTLEQVRKVFKEF

SEQ ID NO: 8446 - protein, 77 aa, Panax ginseng
MGVKGFVEGGIASIIAGCSTHHLTSSRSECNSKVNPPPLHLPFRRSDPLWPSKQAQRLASTFPHRHLHRVLAQSPWE

SEQ ID NO: 8447 - protein, 317 aa, Ricinus communis
MGAKSFVEGGVASIVAGCSTHPLDLIKVRMQLQGENLPKSQVHNLRPAFAFNSTASAAIHVASPPPRVGPVSVGIRIFQTEGVAALFSGVSATVLRQTLYSTTRMGLYDILKQKWTRPDTGNMPLVSKITAGLIAGGIGAAVGNPADVAMVRMQADGRLPPAQRRNYNGVLDAITRMSKQEGITSLWRGSSLTVNRAMIVTASQLASYDQIKEAILEKGVMRDGLGTHVTASFAAGFVAAVASNPVDVIKTRVMNMNVEAGKAAPYNGAIDCALKTVRAEGLMALYKGFIPTISRQGPFTVVLFVTLEQVRKLLKDF

SEQ ID NO: 8448 - protein, 317 aa, Actinidia deliciosa
MGVKGFVEGGIASIVAGCATHPLDLIKVRMQLQGENHAPNPVQTVRPALAFQTTQSGTIHAPPPPPRVGPIAVGIRIVQHDGAAALFSGVSATVLRQTLYSTTRMGLYDIMKKKWSDPNTGNMPLLRKIGAGLLAGGIGAAVGNPADVAMVRMQADGRLPPAQRRNYKSVIDAISQMSKSEGITSLWRGSSLTVNRAMLVTASQLASYDQIKETILEKGVMKDGLGTHVTSSFAAGFVAAVASNPVDVIKTRVMNMKVEPGMAPPYAGAIDCAMKTVRSEGPMALYKGFIPTISRQGPFTVVLFVTLEQVRKLLKDF

SEQ ID NO: 8449 - protein, 326 aa, Quercus alba
MGLKGFVEGGIASIVAGCATHPLDLIKVRMQLQGETHVPNPNLQSLRPALAFHTTSLSAPGSIHVPPPPLPTVAAKVGPIAVGVRIVQQEGVSALFTGVSATMLRQTLYSTTRMGLYDILKKKWSDPKSGNITLLQKIAAGLIAGAVGAAVGNPADVAMVRMQADGRLPQAQRRNYKSVLDAISRMASQEGVPSLWRGSGLTINRAMLVTASQLASYDQIKEMILEKRVMRDGLGTHVTASFAAGFVAAVASNPVDVIKTRVMNMKVEPGAEPPYSGALDCALKTVRAEGPLALYKGFIPTISRQGPFTVVLFVTLEQVRKLLKDF

SEQ ID NO: 8450 - protein, 329 aa, Carica papaya
MGVKGFVEGGIASIVAGCSTHPLDLIKVRMQLQGEKLTASNANPAPTLRPALAFHSANTTATLLPHDSIRVSPPPQPPRVGPISVGVRIVQAEGVAALFSGVSATVLRQTLYSTTRMGLYDVLKQKWSDPASGNMPLTRKIVAGLVAGGIGAAVGNPADVAMVRMQADGRLPPAQRRNYSGVVDAITRMSKQEGVTSLWRGSALTVNRAMIVTASQLASYDQIKEAILEKGIMKDGLGTHVTASFAAGFVAAVASNPVDVIKTRVMNMKVEPGQAPPYSGAIDCALKTVKAEGPMALYKGFIPTISRQGPFTVVLFVTLEQVRKLLKEL

SEQ ID NO: 8451 - protein, 325 aa, Rosa hybrid cultivar
MGVKGFVEGGIASIVAGCSTHPLDLIKVRMQLQGETQVPKPDPAAAQALRPAMAAAARGGSSSIHVPVPPAPAPRVGPIAVGVRIIQQEGVAAMFSGVSATMLRQCLYSTTRMGLYDILKKKWTDPESGNMPLQRKIGAGLIAGAIGASVGNPADVAMVRMQADGRLPAAQRRNYKSVVDAITCMAKQEGVTSLWRGSSLTVNRAMLVTASQLASYDQIKETILDKGLMRDGLGTHITASFAAGFVAAVASNPVDVIKTRVMNMKVEPGAEPPYKGALDCAVKTVRSEGPMALYKGFIPTISRQGPFTVVLFVTLEQVRKLLKDF

SEQ ID NO: 8452 - protein, 288 aa, Fagus grandifolia
MPRNPNPGTVQSLRPALAFQTTSLSGPGSSIHVPPPPRVGPIAVGVRIIQLEGVSALFSGVSATVLRQTLYSTTRMGLYDILKQKWSDPKSGNMPLVRKIGAGLVAGAVGAAVGNPADVAMVRMQADGRLPESQRRNYKSVVDAISRMARQEGITSLWRGSSLTINRAMLVTASQLASYDQIKETILEKGVMRDGLGTHVTASFAAGFVAAVASNPVDVIKTRVMNMKVEPGAEPPYSGALDCALKTVRAEGPLALYKGFVPTISRQGPFTVVLFVTLEQVRKLLKDF

SEQ ID NO: 8453 - protein, 324 aa, Solanum lycopersicum
MGVKGFVEGGIASIIAGCSTHPLDLIKVRMQLQGETPISAPATVHNLRPALAFHTANHTIHIPAPSVVAHAPPRVGPVAVGVKIIQQEGVAALFSGVSATVLRQTLYSTTRMGLYDMLKQKWTDPDTNIMPLSKKIVAGLIAGGIGAAVGNPADVAMVRMQADGRLPISQRRNYKSVIDAITQMSKSEGVTSLWRGSSLTVNRAMLVTASQLASYDQFKETILEKGLMKDGLGTHVVSSFAAGFVAAIASNPVDVIKTRVMNMKVEPGMAPPYSGAIDCAMKTIKAEGPMALYKGFIPTISRQGPFTVVLFVTLEQVRKMLKDF

SEQ ID NO: 8454 - protein, 980 aa, Ricinus communis
MTTNKSVNTELSQGDGGGGGGGAPRPPPSGPPPPGHPDNAASRAGNSVFKSGPLFISSKGIGWTSWKKRWFILTRTSLVFFRSDPSAVPQKGSEVNLTLGGIDLNNSGSVVVKSDKKLLTVLFPDGRDGRAFTLKAETMEDLYDWKTALENALAQAPSAALVMGQNGIFKNDPTDCVEGSFDQCVLPVKDKVPGKAMVIGRPVLLALEDVDGTPSFLEKALRYIEEHGVKVEGILRQAAAVDDVEHRIREYEQGRTEFSAGEDAHVIADCVKYFLRELPSSPVPASCCKALLEAFRKSIGGKDHNNRVNAMREAILETFPEPNRRLLQRILLMMQNVASHKAENRMSTSAVAACMAPLLLRPLLAGDCEIENDFDVGGDGSMQLLQAAAAANHAQAIVITLLEEYDKIFNEGVMSPGLYSDSEECDSEDEEVTDDDESYEDDEQDDASQETDAYTDDDLNDTSSRNESGDSGEEDLSDNKGCDDLSSISNSPEVDNGSEAAELSNSVQTSLPSYREVDRGENSLGESNKNLTTLTAESDELLGDLSSKTTLENKQTGDPSVCIKRSSSMSNGRAPDINFPSSCGRTSGRKNLSMESLDYHFDDEIEIQKLEATKIDLQHRISLSDSSLYFSMQVKGNAVLQANLEQRKKALNERRLALEQDVARLQEELQKERDKRMVLEAGLNNSQANQSVPVIIDEKIKEDLEEISQAEADVNNLKQKVDNLSMQLNQQRDQNYGSPHDSNNQGRCLIAGKIKREILKPVLVHILENLQIRQVLPLVINSDNVHRNNMGILKCQDNLIDESTILPNKTQQADASRSSNSRSSSNSKKTSYRSEGTNSTTSALTKLTTRLNFLKERRSQLTSEILDKGRGSSQATATNKVRQSPQIPDKSQGSEVHSVPNPDKARRSESSQSVPNPDKGLGIEGQSHKNSEKSRKSDSHQDGGKSLESQNADKGKFDGSADKGKGSGGQPKGAQRTNSR

SEQ ID NO: 8455 - protein, 154 aa, Castanea mollissima
MGLKGFVEGGIASIVAGCATHPLDLIKVRMQLQGETHVPNPNLQSLRPALAFHTTSLSAPGSIHMPPPLPTAAAKVGPIAVGVRIVQQEGVSALFTGVSATILRQTLYSTTRMGLYDILKKKWSDPKSGNITLVQKDSGWAHRRRRRSRRGKPG

SEQ ID NO: 8456 - protein, 325 aa, Castanea mollissima
MGLKGFVEGGIASIVAGCATHPLDLIKVRMQLQGETHVPNPNLQSLRPALAFHTTSLSAPGSIHMPPPLPTAAAKVGPIAVGVRIVQQEGVSALFTGVSATILRQTLYSTTRMGLYDILKKKWSDPKSGNITLVQKIAAGLIAGAVGAAVGNPADVAMVRMQADGRLPQAQRRNYKSVVDAISRMASQEGVPSLWRGSGLTINRAMLVTASQLASYDQIKEMILEKGVMRDGLGTHVTASFAAGFVAAVASNPVDVIKTRVMNMKVEPGTEPPYSGALDCALKTVRAEGPLALYKGFVPTISRQGPFTVVLFVTLEQVRKLLKDF

SEQ ID NO: 8457 - protein, 321 aa, Gossypium hirsutum
MGVKSFVEGGIASIVAGCSTHPLDLIKVRMQLQGESHVPNPAVQTLRPALAFQTTTTTTSSAIHMPPPPARVGPVATGIKIFRTEGVAALFSGVSATVLRQTLYSTTRMGLYDILKQKWTDKETKTMPLSRKITAGLIAGGIGAAVGNPADVAMVRMQADGRLPVSQRRNYTSVVDAITRMTKQEGVTSLWRGSSLTVNRAMLVTASQLASYDQIKEMILENGLMKDGLGTHVAASFSAGFVAAVASNPVDVIKTRVMNMKVEAGQKPPYAGALDCAIKTVKSEGPMALYKGFIPTISRQGPFTVVLFVTLEQVRKLLKDF

SEQ ID NO: 8458 - protein, 329 aa, Capsicum annuum
MGVKGFVEGGIASIIAGCSTHPLDLIKVRMQLQGETLNKAPAPHTVHNLRPALAFHGGGGAAASHGNIHVSGPMVRPTSVGPVAVGVKIIQQEGVAALFSGVSATVLRQTLYSTTRMGLYDMLKQKWSDPNKSNMPLSRKIIAGLVAGGIGAAVGNPADVAMVRMQADGRLPLDQRRNYKSVVDAITQMSKSEGVTSLWRGSSLTVNRAMLVTASQLASYDQFKEMILEKGLMKDGLGTHVTASFAAGFVAAVASNPVDVIKTRVMNMKVEPGMAPPYSGALDCAVKTIKAEGPMALYKGFIPTISRQGPFTIVLFVTLEQVRKMLKDF

SEQ ID NO: 8459 - protein, 325 aa, Tabernaemontana elegans
MGIKGFVEGGIASIVAGCSTHPLDLIKVRMQLQGEAPAPNPAVQTMRPALAFHTTVGHASQVHVPSPPLPPPPTRVGPISVGVKLIQQEGVAALFSGVSATVLRQTLYSTTRMGLYDVLKQKWTDPHTNNMPLTSKIAAGLIAGAVGAAVGNPADVAMVRMQADGRLPAAQRRNYKSVVDAITQMSKNEGITSLWRGSSLTVNRAMLVTASQLASYDQIKEIILQKGVMKDGLGTHITASFAAGFVAAVASNPVDVIKTRVMNMKVEPGQAPPYNGALDCAMKTINAEGPMALYKGFIPTISRQGPFTIVLFVTLEQVRKIFKDF

SEQ ID NO: 8460 - protein, 314 aa, Orobanche aegyptiaca
MGLKGFVEGGIASIIAGCSTHPLDLIKVRMQLQGEASMPAAQNLRPALAFHPATTVHHHIPPPRVGPISVGLRIIQQDGAAALFSGVSATVLRQTLYSTTRMGLYDVLKKKWTDPNTNNMPLARKIVAGLIAGGIGAAVGNPADVAMVRMQADGRLPPAQRRNYKSVVDAITQMSRNEGVVSLWRGSSLTVNRAMLVTASQLASYDQFKEMILEKGLMKDGLGTHVTASFAAGFVAAVASNPVDVIKTRVMNMKVEPGVAPPYSGAVDCAMKTIRAEGPMALYKGFIPTISRQGPFTVVLFVTLEQVRKLLKDF

SEQ ID NO: 8461 - protein, 646 aa, Physcomitrella patens
MLLLFSPAHAFYLPGTYLHPYHKGDKLEVKVNSITSIETELPYSYYSLPFCRPPEGIHKVAENIGEMLMGDQIENSPYKFQMKIDQNDLLACVAPAMTENDVKHITQRIDDLYLVNLILDNLPASRLIRQKDPSNPLRLTGSPIGFKIEADSQHYIYNHLIFKVLVHPYDKDSGSGAVLGTGEGLDTMPVATTQNLTGTYMVVGFEVVPCSVVRDSKAASKLNYQDALPPSDCDPKKPYQPIKVGQEIVYSYSVQFEDSSIRWPSRWDAYLKMDGARVHWFSILNSLMVISFLAGIVFVIFLRTVRRDLTKYEELDKEAQVQMNEELSGWKLVVGDVFRAPENPQLLCVVIGDGVQILGMAVVTILFAALGFMSPASRGMLLTGMVMLYLFLGIIAGYVASRMWYTLKGLKDGWRPIAWKTACFFPGIAFTIMTSLNFLLWSRGSTGAIPISLYFTLLFLWFTISVPLTLLGGYLGVKAEPITFPVRTNQIPREIPPQRYPSWLLVLGAGTLPFGTLFIELFFIMSSIWLGRVYYVFGFLFVVLILLVIVCAEVSVVLTYMHLCVEDHRWWWKSFFASGSVALYVFLYSINYLVFDLHSLAGPASAMLYVGYSLLMAIAIMFATGTVGFLMSFYFVHYLFSSVKID

SEQ ID NO: 8462 - protein, 463 aa, Abies balsamea
MERQQQRQELSTEEIGKYAHSPVHLAVVGRDYVALRRILSTLPRLPKAGEVTTEEESVVAEERADIVSGSIDRRDVPGRETALHVAVRLGDCTAVEMLMAAGADWSLQNEQGWNALQEAVCAREDVIAMMITRHYQPLAWAKWCRRLPRIIATTGRMRDFYMEITFHFESSVIPFIGRIAPSDTYRIWKRGSSLRADMTLAGFDGFRIQRSDQSFLFLGEGTEDPKLPAGSLIVLTHKEKEITNALEGAGTPPSDAEVAQEVALMAQTNLYRPGIDVTEAELVPHLNWRRQDRTEMIGPWKAKIYDMLHVMLSVKSRRVPGAMTDEELFAAENGRFADEPGGYEEILTKEEKEQLDQALSMEHSEATEDEAATFFGPVDQDGCHQNGRLLSSAADPDASEASESNSDKDRRSWFGWSKKMLKTDGLKRTALNSHVSKPDKQLEKSLSDCNGNGTLVMRNLQGY

SEQ ID NO: 8463 - protein, 254 aa, Cedrus atlantica
MAQTNLYRPGIDVTQAELVPHLNWRRQDRTEMVGPWKAKIYDMLHVMLSVKSRRVPGAMTDEELFAAENDRFVDEPGSYEEILTKEEKEQLDHALSMENSEAIEDEGAAFCGPVDQDGCHQNGGSSASAGDPDVPEASEASEPNYDKDRRGWFGWSKKMLKTDGLKRTALNSPMSKPDKQLDKSLPDCNGNGTLVNEDSSRILKKFSKLAPESSHRSVDQQLSDTPKDDAVGSRKGKEKASKSSNKKDSSKRKG

SEQ ID NO: 8464 - protein, 586 aa, Picea glauca
MTITRYYQPLAWAKWCRRVPRIIATTGRMRDFYMEITFHFESSVIPFIGRIAPSDTYRIWKRGSTLRADMTLAGFDGFRIQRSDQSFLFLGEGTDDPRLPSGSLIVLTHKEKEISNALEGAGTPPSDAEVAQEVALMAQTNLYRPGIDVTQAELVPHLNWRRQDRTEMVGPWKAKIYDMQHVMLSVKSRRVPGAMTDEELFAAENDRFADEPGCYEEILTKEEKEQLDQALSMENSEAIEDEGAAFFGPVDQDGCHQNGRLSASAGDPDASESSEASEANCDKDNRRGWFGWSKKMLKTDGLKGTTSNSQINKPDKQLEKSPPECNGNGTLVNEDSSRILKKFSKLAPESSQKSVDHQPSDFQKDDAVGSRKGKEKASKSINKKDSSKKKRSSGTNDTKQESEYKKGLRPVLWLTPDFPLKIEEFLPLLDILANKVKAVRRLRELLTTKLPPGTFPVKVAIPLVPTIRVVITFTKFEELQPVEEFSTPLSSPAHFQDAKGKETQVSNSSVSWMSWMRGSHNRTSSEPTSLEDHLRDDLDPFYIPSNYTWVDMNEKKRRMKARKMKNKKGKAHSSRSGDGSLTDIDE

SEQ ID NO: 8465 - protein, 106 aa, Nicotiana benthamiana
MAIRKSSNKLSQTAVIKQILKRCSSLGKKHGYQDEEGLPLDVPKGHFVVYVGENRTRYIVPISILTRPEFQYLLHRAEEEFGFDHDMGLTIPCDEHVFESLTSMLR

SEQ ID NO: 8466 - protein, 249 aa, Populus trichocarpa
MARYDRAITVFSPDGHLFQVEYALEAVRKGNAAVGVRGTDIVVLGVEKKSTAKLQDSRSVKKIVSLDDHVALVCAGLKADARVLVNKARIECQSYRLTVEDPVTVEYITRYIAGLQQKYTQSGGVRPFGLSTLIVGFDPHLGVPALYQTDPSGAFSAWKANATGRNSNSMREFLEKNYKETSGQGTVKLAIRALLEVVESGGKNIEIAVMTKDQGLRQLEEAEIDAIVAEIEAEKAAAEAAKKAPLKDS

SEQ ID NO: 8467 - protein, 249 aa, Euphorbia peplus
MARYDRAITVFSPDGHLFQVEYALEAVRKGNAAVGVRGTDVVVLGVEKKSTAKLQDARSVRKIVSLDDHVALVCAGLKADARVLVNKARIECQSHKLTVEDPVTVEYITRYIAGLQQKYTQSGGVRPFGLSTLIVGFDPHTGVPSLYQTDPSGAFSAWKANATGRNSNSMREFLEKNFKDTSGQETVKLAIRALLEVVESGGKNIEIAVMTKEHGLRQLEEAEIDAIVAEIEAEKAAAEAAKKAPPKET

SEQ ID NO: 8468 - protein, 249 aa, Manihot esculenta
MARYDRAITVFSPDGHLFQVEYALEAVRKGNAAVGVRGTDVVVLGVEKKSTAKLQDSRTVRKIVSLDDHVALVCAGLKADARVLVNRARIECQSHRLTVEDPVTVEYITRYIAGLQQKYTQSGGVRPFGLSTLIVGFDPYTGVPSLYQTDPSGAFSAWKANATGRNSNSMREFLEKNYKETSGQETVKLAIRALLEVVESGGKNIEIAVMTKEHGLRQLEEAEIDAIVAEIEAEKAAAEAAKKAPSKET

SEQ ID NO: 8469 - protein, 249 aa, Ricinus communis
MARYDRAITVFSPDGHLFQVEYALEAVRKGNAAVGVRGTDVVVLGVEKKSTAKLQDARTVRKIVSLDNHVALVCAGLKADARVLINRARVECQSHRLTVEDPVTVEYITRYIAGLQQKYTQSGGVRPFGLSTLIVGFDPYTGIPSLYQTDPSGAFSAWKANATGRNSNSMREFLEKNYKETSGQETVKLAIRALLEVVESGGKNIEIAVMTKDHGLRQLEEAEIDAIVAEIEAEKAAAEAAKKAPPKEI

SEQ ID NO: 8470 - protein, 249 aa, Manihot esculenta
MARYDRAITVFSPDGHLFQVEYALEAVRKGNAAVGVRGTDVVVLGVEKKSTAKLQDARTVRKIVSLDDHIALVCAGLKADARVLVNRARIECQSHRLTVEDPVTVEYITRYIAGLQQKYTQSGGVRPFGLSTLIVGFDPYTGVPSLYQTDPSGAFSAWKANATGRNSNSMREFLEKNYKETSGQETVKLAIRALLEVVESGGKNIEIAVMTKEHGLRQLEEAEIDAIVAEIEAEKAAAEAAKKAPPKET

SEQ ID NO: 8471 - protein, 249 aa, Arnica chamissonis
MARYDRAITVFSPDGHLFQVEYALEAVRKGNAAVGVRGTDTVVLGVEKKSTVKLQDSRSVRKIVSLDDHIALACAGLKADARVLINKARIECQSHRLTVEDPVTVEYITRYIAGLQQKYTQSGGVRPFGLSTLIVGFDPYSGVPALYQTDPSGTFSAWKANATGRNSNSMREFLEKNYKETSGQETIKLAIRALLEVVESGGKNIEVAVMTKEGLRQLEEAEIDAIVAEIEAEKAAAEAAKKGPAAKET

SEQ ID NO: 8472 - protein, 249 aa, Ricinus communis
MARYDRAITVFSPDGHLFQVEYALEAVRKGNAAVGVRGTDVVVLGVEKKSTAKLQDARTVRKIVSLDNHVALVCAGLKADARVLINRARVECQSHRLTVEDPVTVEYITRYIAGLQQKYTQSGGVRPFGLSTLIVGFDPYTGIPSLYQTDPSGAFSAWKANATGRNSNSMREFLEKNYKETSGQETVKLAIRALLEVVESGGKNIEIAVMTKDHGLRQLEESEIDAIVAEIEAEKAAAEAAKKAPPKEI

SEQ ID NO: 8473 - protein, 249 aa, Platanus occidentalis
MARYDRAITVFSPDGHLFQVEYALEAVRKGNAAVGVRGTDCIVLGVEKKSTAKLQDSRSVRKIVNLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETVKLAIRALLEVVESGGKNIEIAVMTREQGLRQLDEAEIDAIVAEIEAEKAAAEAAKKGPPKET

SEQ ID NO: 8474 - protein, 249 aa, Musa acuminata
MARYDRAITVFSPDGHLFQVEYALEAVRKGNAAVGVRGTDTIVLGVEKKSTPKLQDSRSVRKIVSLDTHIALACAGLKADARVLINRARIECQSHRLTVEDPVTVEYITRYIAGLQQKYTQSGGVRPFGLSTLIVGFDPYSGVPALYQTDPSGTFSAWKANATGRNSNSMREFLEKNYKETSGQETVKLAIRALLEVVESGGKNIEIAVMTKEHGLRQLEEAEIDAIVAEIEAEKAAAEAAKKAPSRDT

SEQ ID NO: 8475 - protein, 249 aa, Theobroma cacao
MARYDRAITVFSPDGHLFQVEYALEAVRKGNAAVGVRGADIVVLGVEKKSTAKLQDSRTVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETVKLAIRALLEVVESGGKNIEVAMMTKEHGLRQLEEAEIDAIVAEIEAEKAAAEAAKKAPPKEP

SEQ ID NO: 8476 - protein, 248 aa, Centaurea maculosa
  Sequence also found in Organisms: Cirsium arvense
MARYDRAITVFSPDGHLFQVEYALEAVRKGNAAVGVRGTDTIVLGVEKKSTVKLQDSRSVRKIVSLDDHIALACAGLKADARVLINKARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAIRALLEVVESGGKNIEVAVMTKEGLRQLEEAEIDAIVAEIEAEKAAAEAAKKGPAKET

SEQ ID NO: 8477 - protein, 249 aa, Chelidonium majus
MARYDRAITVFSPDGHLFQVEYALEAVRKGNAAVGVRGTDTIVLGVEKKSTAKLQDSRSVRKIVNLDNHIALACAGLKADARVLINKARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETVKLAIRALLEVVESGGKNIEIAVMTKEGLRQLEETEIDAIVAEIEAEKAAAEAAKKGPAPKET

SEQ ID NO: 8478 - protein, 251 aa, Zingiber officinale
MARYDRAITVFSPDGHLFQVEYALEAVRKGNAAVGVRGTDAIVLGVEKKSTPKLQDSRSVRKIVSLDTHIALACAGLKADARVLINRARIECQSHRLTVEDPVTVEYITRYIAGLQQKYTQSGGVRPFGLSALIVGFDPDTGVPALYQTDPSGTFSAWKANATGRNSNSMREFLEKNYKETSGQETVKLAIRALLEVVESGGKNIEIAVMTKEQGLRQLEEAEIDAIVAEIEAEKAAAEAAKKPPSKDSQV

SEQ ID NO: 8479 - protein, 249 aa, Vitis vinifera
MARYDRAITVFSPDGHLFQVEYALEAVRKGNAAVGVRGTDTIVLGVEKKSTAKLQDSRTVRKIVNLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETVKLAIRALLEVVESGGKNIEIAVMTREHGLRQLDEAEIDAIVAEIEAEKAAAEAAKKGPPKDT

SEQ ID NO: 8480 - protein, 249 aa, Vitis vinifera
MARYDRAITVFSPDGHLFQVEYALEAVRKGNAAVGVRGTDTIVLGVEKKSTAKLQDSRTVRKIVNLDDHIALACAGLKADARVLINRARIECQSHRLTVEDPVTVEYITRYIAGLQQKYTQSGGVRPFGLSTLIIGFDPYTGVPSLYQTDPSGTFSAWKANATGRNSNSMREFLEKNYKETSGQETVKLAIRALLEVVESGGKNIEIAVMTKEHGLRQLEEAEIDAIVAEIEAEKAAAEAAKKGPPKET

SEQ ID NO: 8481 - protein, 249 aa, Musa acuminata
MARYDRAITVFSPDGHLFQVEYALEAVRKGNAAVGVRGTDTVVLGVEKKSTPKLQDSRSVRKIVSLDTHIALACAGLKADARVLINRARIECQSHRLTVEDPVTVEYITRYIAGLQQKYTQSGGVRPFGLSTLIVGFDPYTGVPALYQTDPSGTFSAWKANATGRNSNSMREFLEKNYKETSGQETVKLAIRTLLEVVESGGKNIEIAVLTKEHGLRQLDEAEIDAIVAEIEAEKAAAEAAKKAPSKDT

SEQ ID NO: 8482 - protein, 248 aa, Aristolochia fimbriata
MARYDRAITVFSPDGHLFQVEYALEAVRKGNAAVGVRGTDTIVLGVEKKSTAKLQDSRSVRKIVNLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETVKLAIRALLEVVESGGKNIEIAVMTKEQGLRQLDEAEIDAIVAEIEAEKAAAEAAKKAPRET

SEQ ID NO: 8483 - protein, 248 aa, Vaccinium corymbosum
MARYDRAITVFSPDGHLFQVEYALEAVRKGNAAVGVRGTDTVVLGVEKKSTAKLQDSRSVRKIVNLDDHIALACAGLKADARVLINRARIECQSHKLTVEDPVTVEYITRYIAGLQQKYTQSGGVRPFGLSTLIVGFDPYTNVPSLYQTDPSGTFSAWKANATGRNSNSMREFLEKNYKETSGQETVKLAIRALLEVVESGGKNIEVAVMTKEGLRQLDEAEIDAIVAEIEAEKAAAEAAKKGPPRDT

SEQ ID NO: 8484 - protein, 249 aa, Cicer arietinum
MARYDRAITVFSPDGHLFQVEYALEAVRKGNAAVGVRGTDNVVLGVEKKSTAKLQDTRSVRKIVNLDDHIALACAGLKADARVLINRARVECQSHRLTVEDPVTVEYITRYIAGLQQKYTQSGGVRPFGLSTLIVGFDPYTGSPSLYQTDPSGTFSAWKANATGRNSNSIREFLEKNFKETSGQETVKLAIRALLEVVESGGKNIEVAVMTKENGLRQLEEAEIDAIVAEIEAEKAAAEAAKKAPPKDT

SEQ ID NO: 8485 - protein, 249 aa, Gossypium hirsutum
MARYDRAITVFSPDGHLFQVEYALEAVRKGNAAVGVRGTDIVVLGVEKKSAAKLQDSRSVKKIVNLDDHIALACAGLKADARVLINRARIECQSHRLTVEDPVTVEYITRYIAGLQQKYTQSGGVRPFGLSTLIVGFDPYSGVPALYQTDPSGTFSAWKANATGRNSNSIREFLEKNYKETSGQETIKLAIRALLEVVESGGKNIEVAVMTKEHGLRQLEEAEIDAIAAEIEAEKEAAEAAKKAPPKEK

SEQ ID NO: 8486 - protein, 248 aa, Taraxacum officinale
MARYDRAITVFSPDGHLFQVEYALEAVRKGNAAVGVRGTDTIVLGVEKKSTVKLQDSRSVRKIVNLDDHIALACAGLKADARVLINKARIECQSHRLTVEDPVTVEYITRYIAGLQQKYTQSGGVRPFGLSTLIVGFDPYTGIPALYQTDPSGTFSAWKANATGRNSNSMREFLEKNYKETSGQETIKLAIRALLEVVESGGKNIEVAVMTKEGLRQLEEAEIDAIVAEIEAEKAAAEAAKKGPAKET

SEQ ID NO: 8487 - protein, 248 aa, Lactuca sativa
MARYDRAITVFSPDGHLFQVEYALEAVRKGNAAVGVRGTDTIVLGVEKKSTVKLQDSRSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAIRALLEVVESGGKNIEVAVMTKEGLRQLEEAEIDAIVAEIEAEKAAAEAAKKGPAKET

SEQ ID NO: 8488 - protein, 249 aa, Prunus persica
  Sequence also found in Organisms: Prunus mume
MARYDRAITVFSPDGHLFQVEYALEAVRKGNAAVGVRGTDTIVLGVEKKSTAKLQDSRSVRKIVNLDNHIALACAGLKADARVLINKARIECQSHRLTVEDPVTVEYITRYIAGLQQKYTQSGGVRPFGLSTLIVGFDPYTGSPSLYQTDPSGTFSAWKANATGRNSNSIREFLEKNFKETSGQETIKLAIRALLEVVESGGKNIEVAVMTKDHGLRQLEEAEIDAIVAEIEAEKAAAEAAKKGPPRET

SEQ ID NO: 8489 - protein, 248 aa, Silene vulgaris
MARYDRAITVFSPDGHLFQVEYALEAVRKGNAAVGVRGTDVVVLGVEKKSTAKLQDSRSVKKIVNLDNHIALACAGLKADARVLINKARVECQSHRLTLEDPVTVEYITRYIAGLQQKYTQSGGVRPFGLSTLIVGFDPHTKVPALYQTDPSGTFSAWKANATGRNSNSIREFLEKNYKETEGQETVKLAIRALLEVVESGGKNLEVAVMTKEGLRQLEEAEIDAIVAEIEAEKAAAEAAKKGPARDS

SEQ ID NO: 8490 - protein, 249 aa, Valeriana officinalis
MARYDRAITVFSPDGHLFQVEYALEAVRKGNAAVGVRGTDTVVLGVEKKSTVKLQDSRSVRKIVNLDNHIALACAGLKADARVLINKARIECQSHRLTVEDPVTVEYITRYIAGLQQKYTQSGGVRPFGLSTLIVGFDPYTDVPSLYQTDPSGTFSAWKANATGRNSNSMREFLEKNYKETSGQETIKLAIRALLEVVESGGKNIEVAVMTKDKGLRQLEEEEIDAIVAEIEAEKAAAEAAKKGPQRDS

SEQ ID NO: 8491 - protein, 249 aa, Trifolium pratense
MARYDRAITVFSPDGHLFQVEYALEAVRKGNAAVGVRGTDNVVLGVEKKSTAKLQDSRSVRKIVNLDNHIALACAGLKADARVLINRARVECQSHRLTVEDPCTVEYITRYIAGLQQKYTQSGGVRPFGLSTLIVGFDPYTGSPSLYQTDPSGTFSAWKANATGRNSNSIREFLEKNFKETSGQETVKLAIRALLEVVESGGKNIEVAVMTKEDGLRQLEEAEIDAIVAEIEAEKAAAEAAKKAPPKDT

SEQ ID NO: 8492 - protein, 249 aa, Vicia sativa
MARYDRAITVFSPDGHLFQVEYALEAVRKGNAAVGVRGTDNVVLGVEKKSTAKLQDSRSVRKIVNLDDHIALACAGLKADARVLINRARVECQSHRLTVEDPCTVEYITRHIAGLQQKYTQSGGVRPFGLSTLIVGFDPYTGSPSLYQTDPSGTFSAWKANATGRNSNSIREFLEKNFKETSGQETVKLAIRALLEVVESGGKNIEVAVMTKEHGLRQLEEAEIDAIVAEIEAEKAAAEAAKKAPPKDT

SEQ ID NO: 8493 - protein, 249 aa, Aquilegia formosa
MARYDRAITVFSPDGHLFQVEYALEAVRKGNAAVGVRGTDNVVLGVEKKSTAKLQDSRSVRKIVNLDNHIALACAGLKADARVLINKARIECQSHRLTVEDPVTVEYITRYIAGLQQKYTQSGGVRPFGLSTLIVGFDPYTGVPSLYQTDPSGTFSSWKANATGRNSNSMREYLEKNYKETSGQETVKLAIRALLEVVESGGKNIEVAVMTKEHGLHQLEEAEIDAIVAEIEAEKAAAEAAKKGPAKET

SEQ ID NO: 8494 - protein, 248 aa, Persea americana
MARYDRAITVFSPDGHLFQVEYALEAVRKGNAAVGVRGTDTIVLGVEKKSTAKLQDSRTVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREYLEKNYKETSGQETIKLAIRALLEVVESGGKNIEIAVMTKDGLRQLEESEIDAIVAEIEAEKAAAEAAKKGPARET

SEQ ID NO: 8495 - protein, 248 aa, Cynara scolymus
MARYDRAITVFSPDGHLFQVEYALEAVRKGNAAVGVRGTDTIVLGVEKKSTVKLQDSRSVRKIVSLDDHIALACAGLKADARVLINKARIECQSHRLTVEDPVTVEYITRYIAGLQQKYTQSGGVRPFGLSTLIVGFDPYTNVPSLYQTDPSGTFSAWKANATGRNSNSMREFLEKNYKETSGQETIKLAIRALLEVVESGGKNIEVAVMTKEGLRQLEEAEIDAIVAEIEAEKAAAESAKKGPAKET

SEQ ID NO: 8496 - protein, 250 aa, Epimedium sagittatum
MARYDRAITVFSPDGHLFQVEYALEAVRKGNAAVGVRGTDTIVLGVEKKSTAKLQDSRSVRKIVHLDDHIALVCAGLKADARVLINKARIECQSHRLTVEDPVTVEYITRYIAGLQQKYTQSGGVRPFGLSTLIVGFDPYTGVPALYQTDPSGTFSAWKANATGRNSNSMREFLEKNYKETSGQETVKLAIRALLEVVESGGKNIEIAAMTKEGGLRLLEEAEVDAIVAEIEAEKAAAEAAKKAPSTREA

SEQ ID NO: 8497 - protein, 248 aa, Fagopyrum esculentum
MARYDRAITVFSPDGHLFQVEYALEAVRKGNAAVGVRGLDNVVLGVEKKSTPKLQDSRTVKKIVNLDDHIALACAGLKADARVLINRARIECQSHRLTVEDPVTVEYITRYIAGLQQKYTQSGGVRPFGLSTLIVGFDPYSGVPSLYQTDPSGTFSAWKANATGRNSNSIREFLEKNYKETSGQETVKLAIRALLEVVESGGKNIEIAIMTKAGLRQLEEAEIDAIVAEIEAEKAAAEAAKKGPAKET

SEQ ID NO: 8498 - protein, 248 aa, Flaveria ramosissima
MARYDRAITVFSPDGHLFQVEYALEAVRKGNAAVGVRGTDTIVLGVEKKSTVKLQDSRSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAIRALLEVVESGGKNIEVAVMTKEGLRQLEEAEIDAIVAEIEAEKAAAEAAKKAPAKET

SEQ ID NO: 8499 - protein, 247 aa, Flaveria ramosissima
MARYDRAITVFSPDGHLFQVEYALEAVRKGNAAVGVRGTDTIVLGVEKKSTVKLQDSRSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAIRALLEVVESGGKNIEVAVMTKEGLRQLEEAEIDAIVAEIEAEKAAAEAAKKAPAKE

SEQ ID NO: 8500 - protein, 248 aa, Flaveria ramosissima
MARYDRAITVFSPDGHLFQVEYALEAVRKGNAAVGVRGTDTIVLGVEKKSTVKLQDSRSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAIRALLEVVESGGKNIEVAVMTKDGLRQLDEAEIDAIVAEIEAEKAAAEAAKKAPAKET

SEQ ID NO: 8501 - protein, 249 aa, Zingiber officinale
MARPDRAITVFSPDGHLFQVEYALEAVRKGNAAVGVRGTDTIVLGVEKKSTPKLQDSRSVRKIVNLDTHIALACAGLKADARVLINRARIECHSHRLTVEDPVTVEYITRYIAGLQQKYTQSGGVRPFGLSTLIVGFDPYTDVPALYQTDPSGTFSAWKANATGRNSNSMREFLEKNYTETSGQETVKLAIRALLEVVESGGKNIEIAVMTKKQGLRQLEEAEIDAIVAEIEAEKAAAEAAKKAPSKDS

SEQ ID NO: 8502 - protein, 249 aa, Gossypium raimondii
MARYDRAITVFSPDGHLFQVEYALEAVRKGNAAVGVRGTDIVVLGVEKKSAAKLQDSRSVKKIVNLDDHIALACAGLKADARVLINRARIECQSHRLTVEDPVTVEYITRYIAGLQQKYTQSGGVRPFGLSTLIVGFDPYSGTPALYQTDPSGTFSAWKANATGRNSNSIREFLEKNYKETSGQETIKLAIRALLEVVESGGKNIEVAVMTKEHGLRQLEEAEIDAIAAEIEAEKEAAEAAKKAPPKEK

SEQ ID NO: 8503 - protein, 249 aa, Actinidia deliciosa
MARYDRAITVFSPDGHLFQVEYALEAVRKGNAAVGVRGTDTIVLGVEKKSTAKLQDSRSVRKIVNLDNHIALACAGLKADARVLINRARIECQSHRLTVEDPVTVEYITRYIAGLQQKYTQSGGVRPFGLSTLIVGFDPYTGIPSLYQTDPSGTFSAWKANATGRNSNSMREFLEKNYKETSGQETVKLAIRALLEVVESGGKNIEVAVMTKDHGLRQLDEAEIDAVVAEIEAEKAAAEAAKKGPPKET

SEQ ID NO: 8504 - protein, 249 aa, Lotus japonicus
MARYDRAITVFSPDGHLFQVEYALEAVRKGNAAVGVRGTDNVVLGVEKKSTAKLQDSRSVRKIVNLDDHIALACAGLKADARVLINRARVECQSHRLTVEDPVTVEYITRYIAGLQQKYTQSGGVRPFGLSTLIVGFDPYTATPSLYQTDPSGTFSAWKANATGRNSNSIREFLEKNFKETSGQETVKLAIRALLEVVESGGKNIEVAVMTKEHGLRQLEEAEIDAIVAEIEAEKAAAEAAKKAPPKET

SEQ ID NO: 8505 - protein, 248 aa, Tropaeolum majus
MARYDRAITVFSPDGHLFQVEYALEAVRKGNAAVGVRGTDIVVLGVEKKSAAKLQDTRSVRKIVNLDTHVALACAGLKADARVLINKARIECQSHRLTVEDPVTVEYITRYIAGLQQKYTQSGGVRPFGLSTLIVGFDPYKGVPSLYQTDPSGTFSAWKANATGRNSNSVREFLEKNYKETSGQETIKLAIRALLEVVESGGKNIEIGVMTKDGLRQLEEAEIDAIVTEIEAEKAEAEAAKKGPQKET

SEQ ID NO: 8506 - protein, 249 aa, Papaver somniferum
MARYDRAITVFSPDGHLFQVEYALEAVRKGNAAVGVRGTDTVVLGVEKKSTAKLQDSRSVRKIVNLDNHIALACAGLKADARVLINKARIECQSHRLTVEDPVTVEYITRYIAGLQQKYTQSGGVRPFGLSTLIVGFDPHTDVPSLYQTDPSGTFSAWKANATGRNSNSMREFLEKNYKETSGQETVKLAIRALLEVVESGGKNIEIAVMGKDKVLRQLEESEIDIIVAEIEAEKAAAEAAKKPAPKNT

SEQ ID NO: 8507 - protein, 248 aa, Tragopogon dubius
MARYDRAITVFSPDGHLFQVEYALEAVRKGNAAVGVRGTDTIVLGVEKKSTVKLQDSRSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAIRALLEVVESGGKNIEVAVMTKEGLRQLEEAEIDAIVADIEAEKAAAEAAKKGPAKET

SEQ ID NO: 8508 - protein, 249 aa, Tripterygium wilfordii
MARYDRAITVFSPDGHLFQVEYALEAVRKGNAAVGVRGTDVVVLGVEKKSTAKLQDSRSVRKIVSLDDHIALACAGLKADARVLVNRARIECQSHRLTVEDPATVEYITRYIAGLQQKYTQSGGVRPFGLSTLIVGFDPYTAVPSLYQTDPSGTFSAWKANATGRNSNSMREFLEKNYKETSGQETVKLAIRALLEVVESGGKNIEVAVMTKEHGLRQLEEAEIDAIVAEIEAEKAAAEAAKKAPPRET

SEQ ID NO: 8509 - protein, 247 aa, Artemisia annua
  Sequence also found in Organisms: Chrysanthemum coronarium
MARYDRAITVFSPDGHLFQVEYALEAVRKGNAAVGVRGTDIVVLGVEKKSTVKLQDSRSVRKIVNLDDHIALACAGLKADARVLINKARIECQSHKLTVEDPVTVEYITRYIAGLQQKYTQSGGVRPFGLSTLIVGFDPYTNVPSLYQTDPSGTFSAWKANATGRNSNSMREFLEKNYKETSGQETIKLTIRALLEVVESGGKNIEVAVMTKEGLRQLEEAEIDTIVAEIEAEKAAAEAAKKGPAKE

SEQ ID NO: 8510 - protein, 248 aa, Cichorium intybus
MARYDRAITVFSPDGHLFQVEYALEAVRKGNAAVGVRGTDTIVLGVEKKSTVKLQDSRSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAIRALLEVVESGGKNIEVAVMTKEGLKQLEEAEIDAVVAEIEAEKAAAEAAKKGPAKET

SEQ ID NO: 8511 - protein, 249 aa, Trifolium pratense
MARYDRAITVFSPDGHLFQVEYALEAVRKGNAAVGVRGTDNVVLGVEKKSTAKLQDSRSVRKIVNLDNHIALACAGLKADARVLINRARVECQSHRLTVEDPCTVEYITRYIAGLQQKYTQSGGVRPFGLSTLIVGFDPYTGSPSLYQTDPSGTFSAWKANATGRNSNSIREFLEKNFKETAGQETVKLAIRALLEVVESGGKNIEVAVMTKEDGLRQLEEAEIDAIVAEIEAEKAAAEAAKKAPPKDT

SEQ ID NO: 8512 - protein, 249 aa, Trifolium pratense
MARYDRAITVFSPDGHLFQVEYALEAVRKGNAAVGVRGTDNVVLGVEKKSTAKLQDTRSVRKIVNLDNHIALACAGLKADARVLINRARVECQSHRLTVEDPCTVEYITRYIAGLQQKYTQSGGVRPFGLSTLIVGFDPYTGSPSLYQTDPSGTFSAWKANATGRNSNSIREFLEKNFKETSGQETVKLAIRALLEVVESGGKNIEVAVMTKDDGLRQLEEGEIDAIVAEIEAEKAAAEAAKKAPPKDT

SEQ ID NO: 8513 - protein, 249 aa, Trifolium pratense
MARYDRAITVFSPDGHLFQVEYALEAVRKGNAAVGVRGIDNVVLGVEKKSAAKLQDSRSVRKIVNLDNHIALACAGLKADARVLINRARVECQSHRLTVEDPCTVEYITRYIAGLQQKYTQSGGVRPFGLSTLIVGFDPYTGSPSLYQTDPSGTFSAWKANATGRNSNSIREFLEKNFKETSGQETVKLAIRALLEVVESGGKNIEVAVMTKDNGLRQLEEAEIDAIVAEIEAEKAAAEAAKKAPPKDT

SEQ ID NO: 8514 - protein, 248 aa, Allium cepa
MARYDRAITVFSPDGHLFQVEYALEAVRKGNAAVGVRGTDNVVLGVEKKSTPKLQDSRSVRKIVNLDDHIALACAGLKADARVLINKARIECQSHKLTVEDPVTVEYITRYIAGMQQKYTQSGGVRPFGLSTLIVGFDPYTGVPSLYQTDPSGTFSAWKANATGRNSNSMREFLEKNFKEVAGQETIKLAIRALLEVVESGGKNIEIAVMTKEEGLKQLEEAEIDAIVAEIEAEKAAAEAAKKAPRDS

SEQ ID NO: 8515 - protein, 249 aa, Amorphophallus konjac
MARYDRAITVFSPDGHLFQVEYALEAVRRGNAAVGVRGNDTVVLGVEKKSTPKLQDSRTVRKIVSLDNHIALACAGLKADARVLINKARIECQSHRLTVEDPVTVEYITRYIAGLQQKYTQSGGVRPFGLSTLIIGFDPYTAVPSLYQTDPSGTFSAWKANATGRNSNSMREFLEKNYKETSGQETVKLAIRALLEVVESGGKTIEIAVMTKEHGLRQLEEAEIDALVAEIEAEKAAAEAAKKAPPKDS

SEQ ID NO: 8516 - protein, 249 aa, Fagus grandifolia
MARYDRAITVFSPDGHLFQVEYALEAVRKGNAAVGVRGTDTIVLGVEKKSTAKLQDSRSVRKIVNLDDHIALACAGLKADARVLINRARIECQSHRLTVEDPVTVEYITRYIAGLQQKYTQSGGVRPFGLSTLIVGFDPYTNSPSLYQTDPSGTFSAWKANATGRNSNSIREFLEKNYKETSGQETVKLAIRALLEVVESGGKNIEVAVMTKEHGLRQLEEAEIDAVVAEIEAEKAAAEAAKKGPPKET

SEQ ID NO: 8517 - protein, 249 aa, Gossypium hirsutum
  Sequence also found in Organisms: Gossypium raimondii
MARYDRAITVFSPDGHLFQVEYALEAVRKGNAAVGVRGTDIVVLGVEKKSTAKLQDSRSVKKIVNLDNHIALACAGLKADARVLINRARIECQSHRLTVEDPVTVEYITRYVAGLQQKYTQSGGVRPFGLSTLIVGFDPYSGVPSLYQTDPSGTFSAWKANATGRNSNSIREFLEKNYKETSGQETIKLAIRALLEVVESGGKNIEVAVMTKEHGLRQLEEAEIDAIAAEIEAEKEAAEAAKKAPPKEK

SEQ ID NO: 8518 - protein, 249 aa, Gossypium hirsutum
MARYDRAITVFSPDGHLFQVEYALEAVRKGNAAVGVRGTDIVVLGVEKKSAAKLQDSRSVKKIVNLDDHIALACAGLKADARVLINRARIECQSHRLTVEDPVTVEYITRYIAGLQQKYTQSGGVRPFGLSTLIVGFDPYSGTPALYQTDPSGTFSAWKANATGRNSNSIREFLEKNYKETSGQETIKLAIRALLEVVESGGKNIEVAVMTKEHGLRQLEETEIDAIAAEIEAEKEAAEAAKKAPPKEK

SEQ ID NO: 8519 - protein, 249 aa, Vigna unguiculata
MARYDRAITVFSPDGHLFQVEYALEAVRKGNAAVGVRGTDNVVLGVEKKSTAKLQDSRTVRKIVNLDDHIALACAGLKADARVLINRARVECQSHRLTVEDPVTVEYITRYIAGLQQKYTQSGGVRPFGLSTLIVGFDPYTGAPSLYQTDPSGTFSAWKANATGRNSNSIREFLEKNYKETSGQETVKLAIRALLEVVESGGKNIEVAVMTKENGLRQLEEAEIDAIVAEIEAEKAAAEAAKKAPPKET

SEQ ID NO: 8520 - protein, 249 aa, Cyamopsis tetragonoloba
MARYDRAITVFSPDGHLFQVEYALEAVRKGNAAVGVRGTDNVVLGVEKKSTAKLQDSRTVRKIVNLDDHIALACAGLKADARVLINRARVECQSHRLTVEDPVTVEYITRYIAGLQQKYTQSGGVRPFGLSTLIVGFDPYTGAPSLYQTDPSGTFSAWKANATGRNSNSIREFLEKNYKETSGQETVKLAIRALLEVVESGGKNIEVAVMTKEHGLRQLEEAEIDAIVAEIEAEKAAAEAAKKAPPKET

SEQ ID NO: 8521 - protein, 248 aa, Flaveria ramosissima
  Sequence also found in Organisms: Guizotia abyssinica
MARYDRAITVFSPDGHLFQVEYALEAVRKGNAAVGVRGTDTIVLGVEKKSTVKLQDSRSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAIRALLEVVESGGKNIEVAVMTKEGLRQLDEAEIDAIVAEIEAEKAAAEAAKKAPAKET

SEQ ID NO: 8522 - protein, 248 aa, Flaveria ramosissima
MARYDRAITVFSPDGHLFQVEYALEAVRKGNAAVGVRGTDTIVLGVEKKSTVKLQDSRSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAIRALLEVVESGGKNIEVAVMTKEGLRQLEEAEIDGIVAEIEAEKAAAEAAKKAPAKET

SEQ ID NO: 8523 - protein, 249 aa, Ipomoea nil
MARYDRAITVFSPDGHLFQVEYALEAVRKGNAAVGVRGTDTVVLGVEKKSTPKLQDSRSVRKIVNLDDHIALACAGLKADARVLVNRARIECQSHRLTVEDPVTVEYITRYIAGLQQKYTQSGGVRPFGLSTLIIGFDPYTGVPSLYQTDPSGTFSAWKANATGRNSNSIREFLEKNYKETSGQETVKLAIRALLEVVESGGKNIEVAVMTKEHGLRQLEEAEIDAIVAEIEAEKAAAEAAKKGPAKET

SEQ ID NO: 8524 - protein, 249 aa, Papaver somniferum
MARYDRAITVFSPDGHLFQVEYALEAVRKGNAAVGVRGTDTVVLGVEKKSTAKLQDSRSVRKIVNLDNHIALACAGLKADARVLINKARIECQSHRLTVEDPVTVEYITRYIAGLQQKYTQSGGVRPFGLSTLIVGFDPHTDVPSLYQTDPSGTFSAWKANATGRNSNSMREFLEKNYKETSGQATVKLAIRALLEVVESGGKNIEIAVMGKDKVLRQLEESEIDIIVAEIEAEKAAAEAAKKPAPKNT

SEQ ID NO: 8525 - protein, 249 aa, Papaver somniferum
MARYDRAITVFSPDGHLFQVEYALEAVRKGNAAVGVRGTDTVVLGVEKKSTAKLQDSRSVRKIVNLDNHIALACAGLKADARVLINKARIECQSHRLTVEDPVTVEYITRYIAGLQQKYTQSGGVRPFGLSTLIVGFDPHTDVPSLYQTDPSGTFSAWKANATGRNSNSMREFLEKNYKETSGQETVKLAIRALLEVVESGGKNIEIAVMGKDKVLRQLEESEIDIIVAEIEAEKAAAEAAKKPARKNT

SEQ ID NO: 8526 - protein, 249 aa, Solanum lycopersicum
  Sequence also found in Organisms: Solanum tuberosum
MARYDRAITVFSPDGHLFQVEYAMEAVRKGNAAVGVRGTDTVVLGVEKKSTPKLQDSRSVRKIVNLDDHIALACAGLKADARVLVNKARIECQSHRLTVEDPVTVEYITRYIAGLQQKYTQSGGVRPFGLSTLIIGFDPHTGVPSLYQTDPSGTFSAWKANATGRNSNSTREFLEKNYKETSGQETVKLAIRALLEVVESGGKNIEVAVMTKEHGLKQLEEAEIDAIVAEIEAEKAAAEAAKKAPPKET

SEQ ID NO: 8527 - protein, 249 aa, Sarracenia psittacina
MARYDRAITVFSPDGHLFQVEYALEAVRKGNAAVGVRGSDTVVLGVEKKSTAKLQDSRSVRKIVSLDDHIALACAGLKADARVLINKARIECQSHRLTVEDPVTVEYITRYIAGLQQKYTQSGGVRPFGLSTLIVGFDPYTSVPSLYQTDPSGTFSAWKANATGRNSNSMREFLEKNYKETSGRETIKLAIRALLEVVDSGGKNIEVGVMTKEHGLRQLDEAEIDAIVAEIEAEKAAAEAAKKGPPKET

SEQ ID NO: 8528 - protein, 249 aa, Glycine max
MARYDRAITVFSPDGHLFQVEYALEAVRKGNAAVGVRGTDNVVLGVEKKSTAKLQDSRSVRKIVNLDDHIALACAGLKADARVLINRARVECQSHRLTVEDPVTVEYITRYIAGLQQKYTQSGGVRPFGLSTLIVGFDPYTHSPSLYQTDPSGTFSAWKANATGRNSNSIREFLEKNYKDTSGQETVKLAIRALLEVVESGGKNIEVAVMTKEQGLRQLEEAEIDAIVAEIEAEKAAAEAAKKAPPKET

SEQ ID NO: 8529 - protein, 249 aa, Fragaria vesca
MARYDRAITVFSPDGHLFQVEYALEAVRKGNAAVGVRGTDTIVLGVEKKSTAKLQDSRSVRKIVNLDNHIALACAGLKADARVLINKARIECQSHRLTVEDPVTVEYITRYIAGLQQKYTQSGGVRPFGLSTLIVGFDPYTNKPALYQTDPSGTFSAWKANATGRNSNSIREFLEKNYKETSGQETIKLAIRALLEVVESGGKNIEVAVMTKDHGLRQLEEAEIDAIVADIEAEKAAAEAAKKGPARES

SEQ ID NO: 8530 - protein, 249 aa, Trigonella foenum-graecum
MARYDRAITVFSPDGHLFQVEYALEAVRKGNAAVGVRGTDNVVLGVEKKSTAKLQDSRSVRKIVNLDDHIALACAGLKADARVLINRARVECQSHRLTVEDPCTVEYITRYIAGLQQKYTQSGGVRPFGLSTLIVGFDPYTGSPSLYQTDPSGTFSAWKANATGRNSNSIREFLEKNFKETAGQETVKLAIRALLEVVESGGKNIEVAVMTKEHGLRQLEEAEIDAIVAEIEAEKAAAEAAKKAPQKDT

SEQ ID NO: 8531 - protein, 248 aa, Cichorium intybus
MARYDRAITVFSPDGHLFQVEYALEAVRKGNAAVGVRGTDNIVLGVEKKSTVKLQDSRSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAIRALLEVVESGGKNIEVAVMTKEGLKQLEEGEIDAIVAEIEAEKAAAEAAKKAPVKQS

SEQ ID NO: 8532 - protein, 247 aa, Chrysanthemum coronarium
MARYDRAITVFSPDGHLFQVEYALEAVRKGNAAVGVRGTDNVVLGVEKKSTVKLQDSRSVRKIVNLDDHVALACAGLKADARVLINKARIECQSHKLTVEDPVTVEYITRYIAALQQKYTQSGGVRPFGLSTLIVGFDPYTSVPSLYQTDPSGTFSAWKANATGRNSNSMREFLEKNYKETSGQETIKLTIRALLEVVESGGKNIEVAVMTKEGLRQLEEAEIDTIVAEIEAEKAAAEAAKKGPAKE

SEQ ID NO: 8533 - protein, 249 aa, Trifolium pratense
MARYDRAITVFSPDGHLFQVEYALEAVRKGNAAVGVRGTDNVVLGVEKKSAAKLQDSRSVRKIVNLDNHIALACAGLKADARVLINRARVECQSHRLTVEDPCTVEYITRYIAGLQQKYTQSGGVRPFGLSTLIVGFDPYTGSPSLYQTDPSGTFSAWKANATGRNSNSIREFLEKNFKETAGQETVKLAIRALLEVVESGGKNIEVAVMTKEDGLRQLEEAEIDAIVAEIEAEKAAAEAAKKAPPKDT

SEQ ID NO: 8534 - protein, 249 aa, Cocos nucifera
MARYDRAITVFSPDGHLFQVEYALEAVRKGNAAVGVRGTDTIVLGVEKKSTPKLQDSRSVRKIVSLDNHIALACAGLKADARILINRARIECQSHRLTVEDPVTVEYITRYIAGLQQKYTQSGGVRPFGLSTLIVGFDPYTGVPALYQTDPSGTFSAWKANATGRNSNSMREFLEKNYKETTGQETVKLAIRALLEVVESGGKNIEIAVMMREQGLRQLDEAEIDAIVAEIEAEKAAAEAAKKAPSKET

SEQ ID NO: 8535 - protein, 249 aa, Ambrosia trifida
MARYDRAITVFSPDGHLFQVEYALEAVRKGNAAVGVRGTDTIVLGVEKKSTVKLQDSRSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAIRALLEVVESGGKNIEVAVMTKEGLRQLDEAEIDAIVAEIEAEKAAAEAAKKAPATKET

SEQ ID NO: 8536 - protein, 249 aa, Ambrosia trifida
MARYDRAITVFSPDGHLFQVEYALEAVRKGNAAVGVRGTDTIVLGVEKKSTVKLQDSRSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAIRALLEVVESGGKNIEVAVMTKEGLRQLDEAEIDAIVAEIEAEKAAAEAAKKAPASKET

SEQ ID NO: 8537 - protein, 249 aa, Malus domestica
MARYDRAITVFSPDGHLFQVEYALEAVRKGNAAVGVRGTDTIVLGVEKKSTAKLQDSRSVRKIVNLDNHIALACAGLKADARVLINKARIECQSHRLTVEDPVTVEYITRYIAGLQQKYTQSGGVRPFGLSTLIVGFDPYTDSPSLYQTDPSGTFSAWKANATGRNSNSIREFLEKNYKETSGQETVKLAIRALLEVVESGGKNIEVAVMTKDHGLKQLEEAEIDAIVADIEAEKAAAEAAKKGPPRET

SEQ ID NO: 8538 - protein, 248 aa, Arnica chamissonis
MARYDRAITVFSPDGHLFQVEYALEAVRKGNAAVGVRGTDTIVLGVEKKSTVKLQDSRSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETVKLAIRALLEVVESGGKNIEVGVMTKEGLKQLEEGEIDTIVAEIEAEKAAAEAAKKPPPKET

SEQ ID NO: 8539 - protein, 250 aa, Brassica oleracea
MARYDRAITVFSPDGHLFQVEYALEAVRKGNAAVGVRGPDTVVLAVEKKSTPKLQDSRSARKIVSLDNHVALACAGLKADARVLINKARIECQSHRLTLEDPVTVEYITRYIAGLQQKYTQSGGVRPFGLSTLIVGFDPYSRVPSLYQTDPSGTFSAWKANATGRNSNSIREFLEKNFKETSGQETVKLAIRALLEVVESGGKNIEVAVMTREESGLRQLEEAEIDAIVAEIEAEKAAAEAAKKGPQKDT

SEQ ID NO: 8540 - protein, 249 aa, Phaseolus vulgaris
MARYDRAITVFSPDGHLFQVEYALEAVRKGNAAVGVRGTDNVVLGVEKKSTAKLQDSRTVRKIVNLDDHIALACAGLKADARVLINRARVECQSHRLTVEDPVTVEYITRYIAGLQQKYTQSGGVRPFGLSTLIVGFDPYTGSPSLYQTDPSGTFSAWKANATGRNSNSIREFLEKNYKETSGQETVKLAIRALLEVVESGGKNIEVAVMTKEHGLRQLEEAEIDAIVAEIEVEKAAAEAAKKAPPKET

SEQ ID NO: 8541 - protein, 249 aa, Theobroma cacao
MARYDRAITVFSPDGHLFQVEYALEAVRKGNAAVGVRGTDIVVLGVEKKSTAKLQDSRTVRKIVNLDDHIALACAGLKADARVLINRARIECQSHRLTVEDPVTVEYITRYIAGLQQKYTQSGGVRPFGLSTLIVGFDPYTGIPSLYQTDPSGTFSAWKANATGRNSNSIREFLEKNYKETSGQETIKLAIRALLEVVESGGKNIEVAVMTKEHGLRQLDEAEIDAIAAEIEAEKAAAEAAKKAPPKET

SEQ ID NO: 8542 - protein, 249 aa, Centaurea maculosa
  Sequence also found in Organisms: Cirsium arvense
MARYDRAITVFSPDGHLFQVEYALEAVRKGNAAVGVRGTDTIVLGVEKKSTVKLQDSRSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAVRALLEVVESGGKNIEVAVMTKEGLRQLEEAEIDAIVAEIEAEKAAAEAAKKAPAAKQT

SEQ ID NO: 8543 - protein, 248 aa, Echinacea purpurea
MARYDRAITVFSPDGHLFQVEYALEAVRKGNAAVGVRGTDTIVLGVEKKSTVKLQDSRSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETVKLAIRALLEVVESGGKNIEVGVMTKEGLKQLEEAEIDTIVAEIEAEKAAAEAAKKPPSKET

SEQ ID NO: 8544 - protein, 249 aa, Echinacea purpurea
MARYDRAITVFSPDGHLFQVEYALEAVRKGNAAVGVRGTDTIVLGVEKKSTVKLQDSRSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAIRALLEVVESGGKNIEVAVMTKEGLRQLDEAEIDAIVAEIEAEKAAAEAAKKAPAVKET

SEQ ID NO: 8545 - protein, 250 aa, Eschscholzia californica
MARYDRAITVFSPDGHLFQVEYALEAVRKGNAAVGVRGTDTIVLGVEKKSTAKLQDSRSVRKIVNLDNHIALACAGLKADARVLINKARIECQSHRLTVEDPVTVEYITRYIAGLQQKYTQSGGVRPFGLSTLIVGFDPYTDVPSLYQTDPSGTFSAWKANATGRNSNSMREFLEKNYKETSGPETVKLAIRALLEVVESGGKNIEIAVMTKEHGLRQLEESEIDTIVAEIEAEKAAAEAAKKGPASKET

SEQ ID NO: 8546 - protein, 250 aa, Eschscholzia californica
MARYDRAITVFSPDGHLFQVEYALEAVRKGNAAVGVRGTDTIVLGVEKKSTAKLQDSRSVRKIVNLDNHIALACAGLKADARVLINKARIECQSHRLTVEDPVTVEYITRYIAGLQQKYTQSGGVRPFGLSTLIVGFDPYTDVPSLYQTDPSGTFSAWKANATGRNSNSMREFLEKNYKETSGQETIKLTIRALLEVVESGGKNIEIAVMTKEHGLRQLEESEIDAIVAEIEAEKAAAEAAKKAPAPKET

SEQ ID NO: 8547 - protein, 248 aa, Flaveria ramosissima
MARYDRAITVFSPDGHLFQVEYALEAVRKGNAAVGVRGTDTIVLGVEKKSTVKLQDSRSVRKIVSVDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAIRALLEVVESGGKNIEVAVMTKEGLRQLDEAEIDAIVAEIEAEKAAAEAAKKAPAKET

SEQ ID NO: 8548 - protein, 249 aa, Panax ginseng
MARYDRAITVFSPDGHLFQVEYALEAVRKGNAAVGVRGTDTIVLGVEKKSTVKLQDSRSVRKIVNLDDHIALACAGLKADARVLINRARIECQSHKLTVEDPVTVEYITRYIAGLQQKYTQSGGVRPFGLSTLIVGFDPYTGVPALYQTDPSGTFSAWKANATGRNSNSMREFLEKNYKETSGQETIKLAIRALLEVVESGGKNIEVAVMTKDQGLRQLDEAEIDAVVAEIEAEKEAAEAAKKGPSRET

SEQ ID NO: 8549 - protein, 250 aa, Humulus lupulus
MARYDRAITVFSPDGHLFQVEYALEAVRKGNAAVGVRGTDTIVLGVEKKSTAKLQDSRTVRKIVNLDDHIALACAGLKADARVLINKARIECQSHRLTVEDPVTVEYITRYIAGLQQKYTQSGGVRPFGLSTLIIGFDPYTGAPALYQTDPSGTFSAWKANATGRNSNSLREFLEKNYKETAGQETVKLAIRALLEVVESGGKNIEVAVMTREQGLRQLEEAEIDAIVAEIEAEKAAAEAAKKGPSTKET

SEQ ID NO: 8550 - protein, 249 aa, Medicago truncatula
MARYDRAITVFSPDGHLFQVEYALEAVRKGNAAVGVRGIDNVVLGVEKKSTAKLQDSRSVRKIVNLDDHIALACAGLKADARVLINRARVECQSHRLTVEDPCTVEYITRHIAGLQQKYTQSGGVRPFGLSTLIVGFDPYTGSPSLYQTDPSGTFSAWKANATGRNSNSIREFLEKNFKETSGQETVKLAIRALLEVVESGGKNIEVAVMTKEHGLRQLEEAEIDAIVAEIEAEKAAAEAAKKAPLKDT

SEQ ID NO: 8551 - protein, 249 aa, Nicotiana benthamiana
MARYDRAITVFSPDGHLFQVEYALEAVRKGNAAVGVRGTDTVVLGVEKKSTPKLQDSRSVRKIVNLDDHIALACAGLKADARVLVNRARIECQSHRLTVEDPVTVEYITRYIAGLQQKYTQSGGVRPFGLSTLIIGFDPYTGVPSLYQTDPSGTFSAWKANATGRNSNSLREFLEKNYKETSGQETVKLAIRALLEVVESGGKNIEVAVMTKEHGLKQLEEAEIDAIVAEIEAEKAAAEAAKKAPPKET

SEQ ID NO: 8552 - protein, 248 aa, Nicotiana benthamiana
MARYDRAITVFSPDGHLFQVEYALEAVRKGNAAVGVRGTDTVVLGVEKKSTPKLQDSRSVRKIVNLDDHIALACAGLKADARVLVNRARIECQSHRLTVEDPVTVEYITRYIAGLQQKYTQSGGVRPFGLSTLIIGFDPYTGVPALYQTDPSGTFSAWKANATGRNSNSLREFLEKNYKETSGQETVKLAIRALLEVVESGGKNIEVAVMTKEHGLKQLEEAEIDAIVAEIEAEKAAAEAAKKAPKET

SEQ ID NO: 8553 - protein, 249 aa, Elaeis guineensis
MARYDRAITVFSPDGHLFQVEYALEAVRKGNAAVGVRGTDTIVLGVEKKATPKLQDSRSVRKIVSLDNHIALACAGLKADARILINRARIECQSHRLTVEDPVTVEYITRYIAGLQQKYTQSGGVRPFGLSTLIVGFDPYTGAPALYQTDPSGTFSAWKANATGRNSNSMREFLEKNYKETSGQETVKLAIRALLEVVESGGKNIEIAVMTREQGLRQLDEAEIDAIVAEIEAEKAAAEAAKKAPSKET

SEQ ID NO: 8554 - protein, 249 aa, Arachis hypogaea
MARYDRAITVFSPDGHLFQVEYALEAVRKGNAAVGVRGTDNVVLGVEKKSTAKLQDSRTVRKIVNLDDHIALACAGLKADARVLINRARVECQSHRLTVEDPVTVEYITRYIAGLQQKYTQSGGVRPFGLSTLIVGFDPYTGTPSLYQTDPSGTFSAWKANATGRNSNSIREFLEKNYKEVSGQETIKLAIRALLEVVESGGKNIEVAVMTKEQGLRQLEEAEIDAIVAEIEAEKAAAEAAKKAPPKET

SEQ ID NO: 8555 - protein, 249 aa, Arachis hypogaea
MARYDRAITVFSPDGHLFQVEYALEAVRKGNAAVGVRGTDNVVLGVEKKSTAKLQDSRTVRKIVNLDDHIALACAGLKADARVLINRARVECQSHRLTVEDPVTVEYITRYIAGLQQKYTQSGGVRPFGLSTLIVGFDPYTGTPSLYQTDPSGTFSAWKANATGRNSNSVREFLEKNYKEVSGQETIKLAIRALLEVVESGGKNIEVAVMTKEQGLRQLEEAEIDAIVAEIEAEKAAAEAAKKAPPKET

SEQ ID NO: 8556 - protein, 249 aa, Cajanus cajan
MARYDRAITVFSPDGHLFQVEYALEAVRKGNAAVGVRGSDNVVLGVEKKSTAKLQDSRTVRKIVNLDDHVALACAGLKADARVLINRARVECQSHRLTVEDPVTVEYITRYIAGLQQKYTQSGGVRPFGLSTLIVGFDPYTGAPSLYQTDPSGTFSAWKANATGRNSNSIREFLEKNYKETSGQETVKLAIRALLEVVESGGKNIEVAVMTKEHGLRQLEEAEIDAIVAEIEAEKAAAEAAKKAPPRET

SEQ ID NO: 8557 - protein, 245 aa, Carthamus tinctorius
MARYDRAITVFSPDGHLFQVEYALEAVRKGNAAVGVRGTDTIVLGVEKKSTVKLQDSRSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAVRALLEVVESGGKNIEVAVMTKEGLRQLEEAEIDAIVAEIEAEKAAAEAAKKAPA

SEQ ID NO: 8558 - protein, 248 aa, Helianthus annuus
MARYDRAITVFSPDGHLFQVEYALEAVRKGNAAVGVRGTDTIVLGVEKKSTVKLQDSRSVRKIVTLDDHIALACAGLKADARVLINRARIECQSHRLTVEDPVTVEYITRYIAGLQQKYTQSGGVRPFGLSTLIVGFDPYTGVPALYQTDPSGTFSAWKANATGRNSNSMREFLEKNYKETSGQETVKLAIRALLEVVESGGKNIEVGVMTKEGLKQLEEAEIDTIVAEIEAEKAAAEAAKKAPSKQT

SEQ ID NO: 8559 - protein, 249 aa, Helianthus annuus
MARYDRAITVFSPDGHLFQVEYALEAVRKGNAAVGVRGTDTIVLGVEKKSTVKLQDSRSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAIRALLEVVESGGKNIEVAVMTKEGLRQLDEAEIDAIVAEIEAEKAAAEAAKKAPAAKET

SEQ ID NO: 8560 - protein, 249 aa, Daucus carota
MARYDRAITVFSPDGHLFQVEYALEAVRKGNAAVGVRGTDTIVLGVEKKSTVKLQDSRSVRKIVNLDDHIALACAGLKADARVLINRARIECQSHKLTVEDPVTVEYITRYIAGLQQKYTQSGGVRPFGLSTLIVGFDPHTGVPALYQTDPSGTFSAWKANATGRNSNSMREFLEKNYTETSGQETLKLAIRALLEVVESGGKNIEVAVMTRDKGLRQLDEAEIDTIVAEIEAEKEAAEAAKKGPSKET

SEQ ID NO: 8561 - protein, 249 aa, Daucus carota
MARYDRAITVFSPDGHLFQVEYALEAVRKGNAAVGVRGTDTIVLGVEKKSTVKLQDSRSVRKIVNLDDHIALACAGLKADARVLINRARIECQSHKLTVEDPVTVEYITRYIAGLQQKYTQSGGVRPFGLSTLIVGFDPHTGVPALYQTDPSGTFSAWKANATGRNSNSMREFLEKNYTETSGQETLKLAIRALLEVVESGGKNIEVAVMTRDKGLRQLDEAEIDTIVAEIEAEKEAAEAAKKGPFKET

SEQ ID NO: 8562 - protein, 249 aa, Castanea mollissima
MARYDRAITVFSPDGHLFQVEYALEAVRKGNAAVGVRGTDTIVLGVEKKSTAKLQDSRSVRKIVNLDNHIALACAGLKADARVLINKARIECQSHRLTLEDPATVEYITRYIAGLQQKYTQSGGVRPFGLSTLIIGFDPYTGAPSLYQTDPSGTFSAWKANATGRNSNSLREFLEKNYKETSGQETVKLAIRALLEVVESGGKNIEVAVMTKEHGLRQLEEAEIDAVVAEIEAEKAAAEAAKKGPPKET

SEQ ID NO: 8563 - protein, 248 aa, Artemisia annua
  Sequence also found in Organisms: Chrysanthemum coronarium
MARYDRAITVFSPDGHLFQVEYALEAVRKGNAAVGVRGTDTVVLGVEKKSTVKLQDSRSVRKIVNLDDHVALACAGLKADARVLINKARIECQSHKLTVEDPVTVEYITRYIAGLQQKYTQSGGVRPFGLSTLIVGFDPYTNVPSLYQTDPSGTFSAWKANATGRNSNSMREFLEKNYKETSGQETVKLTIRALLEVVESGGKNIEVAVMTKEGLRQLEETEIDVIVAEIEAEKAAAEAAKKTPSMQT

SEQ ID NO: 8564 - protein, 249 aa, Petroselinum crispum
MARYDRAITVFSPDGHLFQVEYALEAVRKGNAAVGVRGTDTIVLGVEKKSTVKLQDSRSVRKIVNLDDHIALACAGLKADARVLINRARIECQSHKLTVEDPVTVEYITRYIAGLQQKYTQSGGVRPFGLSTLIVGFDPHTGVPALYQTDPSGTFSAWKANATGRNSNSMREFLEKNYKETSGQETLKLAIRALLEVVESGGKNIEVAVMTRDKGLRQLDEAEIDTIVAEIEAEKEAAEAAKKGPSRET

SEQ ID NO: 8565 - protein, 249 aa, Malus domestica
MARYDRAITVFSPDGHLFQVEYALEAVRKGNAAVGVRGTDTIVLGVEKKSAAKLQDSRSVRKIVNLDNHIALACAGLKADARVLINKARIECQSHRLTVEDPVTVEYITRYIAGLQQKYTQSGGVRPFGLSTLIVGFDPYTDSPSLYQTDPSGTFSAWKANATGRNSNSIREFLEKNYKETSGQETVKLAIRALLEVVESGGKNIEVAVMTKDHGLKQLEEAEIDAIVADIEAEKAAAEAAKKGPPRET

SEQ ID NO: 8566 - protein, 250 aa, Cannabis sativa
MARYDRAITVFSPDGHLFQVEYALEAVRKGNAAVGVRGTDTIVLGVEKKSTAKLQDSRSVRKIVNLDDHIALACAGLKADARVLINKARIECQSHRLTVEDPATVEYITRYIAGLQQKYTQSGGVRPFGLSTLIIGFDPYTGAPALYQTDPSGTFSAWKANATGRNSNSLREFLEKNYKETAGQETIKLAIRALLEVVESGGKNIEVAVMTREQGLRQLEEAEIDAIVAEIEAEKAAAEAAKKGPSTKET

SEQ ID NO: 8567 - protein, 249 aa, Centaurea maculosa
MARYDRAITVFSPDGHLFQVEYALEAVRKGNAAVGVRGTDTIVLGVEKKSTVKLQDSRSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAVRALLEVVESGGKNIEVAVMTKEGLRQLEEAEIDAIVAEIEAEKAAAEAAKKAPASKQT

SEQ ID NO: 8568 - protein, 249 aa, Citrus clementina
MARYDRAITVFSPDGHLFQVEYALEAVRKGNAAVGVRGTDTIVLGVEKKSTVKLQDSRSVRKIVSLDNHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAIRALLEVVESGGKNIEVAVMTREKGLKQLDEAEIDAMVAEIEAEKAAAEAAKKGPPKET

SEQ ID NO: 8569 - protein, 249 aa, Citrus clementina
  Sequence also found in Organisms: Citrus sinensis
MARYDRAITVFSPDGHLFQVEYALEAVRKGNAAVGVRGTDIVVLGVEKKSAVKLQDSRMVRKIVSLDNHIALACAGLKADARVLVNRARIECQSHRLTVEDPVTVEYITRYIAGLQQKYTQSGGVRPFGLSTLIVGFDPYTGVPSLYQTDPSGTFSAWKANATGRNSNSIREFLEKNYKETSGQETVKLAIRALLEVVESGGKNIEVAVMTREHGLRQLEEAEIDAIVSEIEAEKAAAEAAKKAPPKET

SEQ ID NO: 8570 - protein, 249 aa, Cleome gynandra
MARYDRAITVFSPDGHLFQVEYALEAVRKGNAAVGVRGTDTIVLAVEKKSTPKLQDSRSARKIVSLDNHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSIREFLEKNYKETSGQETVKLAIRALLEVVESGGKNIEVAVMTREQGLRQLEEAEIDGIVAEIEAEKAAAEAAKKAPPKEA

SEQ ID NO: 8571 - protein, 249 aa, Coffea canephora
MARYDRAITVFSPDGHLFQVEYALEAVRKGNAAVGVRGTDTIVLGVEKKSTPKLQDSRSVRKIVNLDDHIALACAGLKADARVLINRARIECQSHRLTVEDPVTVEYITRYIAGLQQKYTQSGGVRPFGLSTLIIGFDPYTGVPALYQTDPSGTFSAWKANATGRNSNSIREFLEKNYKETAGQETVKLAIRALLEVVESGGKNIEVAVMTKKDGLRQLEEAEIDAIVAEIEEEKAAAEAAKKAPQKET

SEQ ID NO: 8572 - protein, 249 aa, Eucalyptus grandis
MARYDRAITVFSPDGHLFQVEYALEAVRKGNAAVGVRGTDTIVLGVEKKSTAKLQDSRSVRKIVSLDQHIALACAGLKADARVLINRARIECQSHRLTVEDPVTVEYITRYIAGLQQKYTQSGGVRPFGLSTLIIGFDPYTGAPSLYQTDPSGTFSAWKANATGRNSNSIREFLEKNYKDTSGQETVKLAIRALLEVVESGGKNIEIAVMTREHGLRQLEEAEIDAIVAEIEAEKAAAEAAKKAPLKET

SEQ ID NO: 8573 - protein, 248 aa, Fagopyrum esculentum
MARYDRAITVFSPDGHLFQVEYALEAVRKGNAAVGVRGSDAVVLGVEKKSTPKLQDSRTVKKIVNLDNHIALACAGLKADARVLINRARIECQSHKLTVEDPVTVEYITRYIAGLQQKYTQSGGVRPFGLSTLIVGFDPHTAVPSLYQTDPSGTFSAWKANATGRNSNSIREFLEKNYKETSGQETVKLAIRALLEVVESGGKNIEIGVMTKEGLRQLEEEEIDAIVAEIEAEKAAAEAAKKGPHKEA

SEQ ID NO: 8574 - protein, 249 aa, Panax ginseng
MARYDRAITVFSPDGHLFQVEYALEAVRKGNAAIGVRGTDTIVLGVEKKSTVKLQDSRSVRKIVNLDDHIALACAGLKADARVLINRARIECQSHKLTVEDPVTVEYITRYIAGLQQKYTQSGGVRPFGLSTLIVGFDPYTGVPALYQTDPSGTFSAWKANATGRNSNSMREFLEKNYKETSGQETIKLAIRALLEVVESGGKNIEVAVMTKDQGLRQLDEAEIDAVVAEIEAEKEAAEAAKKGPSRET

SEQ ID NO: 8575 - protein, 249 aa, Lotus japonicus
MARYDRAITVFSPDGHLFQVEYALEAVRKGNAAVGVRGTDNVVLGVEKKSTAKLQDSRSVRKIVNLDDHIALACAGLKADARVLINRARVECQSHRLTVEDPVTVEYITRYIAGLQQKYTQSGGVRPFGLSTLIVGFDPYTATPSLYQTDPSGTFSAWKANATGRNSNSIREFLEKNYKETSGQETVKLAIRALLEVVESGGKNIEVAVVTKEHGLRQLEEAEIDAIVAEIEAEKAATEAAKKAPPKET

SEQ ID NO: 8576 - protein, 249 aa, Lupinus angustifolius
MARYDRAITVFSPDGHLFQVEYALEAVRKGNAAVGVRGTDNVVLGVEKKSTAKLQDSRSVRKIVNLDNHIALACAGLKADARVLINKARVECQSHRLTVEDPVTVEYITRYIAGLQQKYTQSGGVRPFGLSTLIVGFDPYSGTPSLYQTDPSGTFSAWKANATGRNSNSIREFLEKNYKEVSGQETVKLAIRALLEVVESGGKNIEVAVVTKEHGLRQLEEAEIDAVVAEIEAEKAAAEAAKKAPPKET

SEQ ID NO: 8577 - protein, 249 aa, Nicotiana benthamiana
MARYDRAITVFSPDGHLFQVEYALEAVRKGNAAVGVRGTDTVVLGVEKKSTPKLQDSRSVRKIVNLDDHIALACAGLKADARVLVNRARIECQSHRLTVEDPVTVEYITRYIAGLQQKYTQSGGVRPFGLSTLIIGFDPYTGVPSLYQTDPSGTFSAWKANATGRNSNSLREFLEKNYKETSGQETVKLAIRALLEVVESGGKNIEVAVMTKEHGLKQLEEAEIDAIVAEIEAEKAAAEAAKKAPSKET

SEQ ID NO: 8578 - protein, 249 aa, Quercus alba
MARYDRAITVFSPDGHLFQVEYALEAVRKGNAAVGVRGTDTIVLGVEKKSTAKLQDTRSVRKIVNLDNHIALACAGLKADARVLINKARIECQSHRLTVEDPATVEYITRYIAGLQQKYTQSGGVRPFGLSTLIIGFDPYTGAPSLYQTDPSGTFSAWKANATGRNSNSLREFLEKNYKETSGQETVKLAIRALLEVVESGGKNIEVAVMTKEHGLRQLEEAEIDAVVAEIEAEKAAAEAAKKGPPKET

SEQ ID NO: 8579 - protein, 249 aa, Elaeis guineensis
MARYDRAITVFSPDGHLFQVEYALEAVRKGNAAVGVRGTDAIVLGVEKKATPKLQDSRSVRKIVSLDNHIALACAGLKADARVLINRARIECQSHRLTVEDPVTVEYITRYIAGLQQKFTQSGGVRPFGLSTLIIGFDPYTGVPALYQTDPSGTFSAWKANATGRNSNSMREFLEKNYKETSGQETVKLAIRALLEVVESGGKNIEIAVMTRETGLRQLDEAEIDAIVAEIEAEKAAAEAAKKAPSKET

SEQ ID NO: 8580 - protein, 249 aa, Rosa hybrid cultivar
MARYDRAITVFSPDGHLFQVEYALEAVRKGNAAVGVRGTDTIVLGVEKKSTAKLQDSRSVRKIVNLDNHIALACAGLKADARVLINKARIECQSHRLTVEDPVTVEYITRYIAGLQQKYTQSGGVRPFGLSTLIVGFDPYTNKPALYQTDPSGTFSAWKANATGRNSNSIREFLEKNYKETSGQDTIKLAIRALLEVVESGGKNIEVAVMTKDHGLRQLEEAEIDAIVADIEAEKAAAEAAKKGPARET

SEQ ID NO: 8581 - protein, 249 aa, Solanum phureja
MARYDRAITVFSPDGHLFQVEYAMEAVRKGNAAVGVRGTDTVVLGVEKKSTPKLQDSRSVRKIVNLDDHIALACAGLKADARVLVNKARIECQSHRLTVEDPVTVEYITRYIAGLQQKYTQSGGVRPFGLSTLIIGFDPHTGVPSLYQTDPSGTFSAWKANATGRNSNSTREFLEKNYKETSGQETVKLAIRALLEVIESGGKDIEVAVMTKEHGLKQLEEAEIDAIVAEIEAEKAAAEAAKKAPPKET

SEQ ID NO: 8582 - protein, 249 aa, Glycine max
MARYDRAITVFSPDGHLFQVEYALEAVRKGNAAVGVRGTDNVVLGVEKKSTAKLQDSRSVRKIVNLDNHIALACAGLKADARVLINRARVECQSHRLTVEDPVTVEYITRYIAGLQQKYTQSGGVRPFGLSTLIVGFDPYTGSPSLYQTDPSGTFSAWKANATGRNSNSIREFLEKNYKDTSGQETVKLAIRALLEVVESGGKNIEVAVMTKEHGLHQLEEAEIDAIVAEIEAEKAAAEAAKKAPPKET

SEQ ID NO: 8583 - protein, 248 aa, Nicotiana tabacum
MARYDRAITVFSPDGHLFQVEYALEAVRKGNAAVGVRGTDTVVLGVEKKSTPKLQDSRSVRKIVNLDDHIALACAGLKADARVLVNRARIECQSHRLTVEDPVTVEYITRYIAGLQQKYTQSGGVRPFGLSTLIIGFDPYTGVPALYQTDPSGTFSAWKANATGRNSNSLREFLEKNYKETSGQETVKLAIRALLEAVESGGKNIEVAVMTKEHGLKQLEEAEIDAIVAEIEAEKAAAEAAKKAPKET

SEQ ID NO: 8584 - protein, 249 aa, Vinca minor
MARYDRAITVFSPDGHLFQVEYALEAVRKGNAAVGVRGTDTVVLGVEKKSTPKLQDSRSVRKIVNLDDHIALACAGLKADARVLINKARIECQSHRLTVEDPATVEYITRYIAGLQQKYTQSGGVRPFGLSTLIIGFDPYTGAPSLYQTDPSGTFSAWKANATGRNSNSIREFLEKNYKETSGQETIKLAIRALLEVVESGGKNIEVAVMTKEHGLKQLEEAEIDAIVAEIEEEKAAAEAAKKGPPKET

SEQ ID NO: 8585 - protein, 249 aa, Vinca minor
MARYDRAITVFSPDGHLFQVEYALEAVRKGNAAVGVRGTDTIVLGVEKKSTPKLQDSRSVRKIVNLDDHIALACAGLKADARVLINKARIECQSHRLTVEDPATVEYITRYIAGLQQKYTQSGGVRPFGLSTLIIGFDPYSGTPSLYQTDPSGTFSAWKANATGRNSNSIREFLEKNYKETSGQETVKLAIRALLEVVESGGKNIEVAVMTKEHGLKQLEEAEIDAIVAEIEEEKAAAEAAKKGPPKET

SEQ ID NO: 8586 - protein, 124 aa, Ipomoea batatas
MARYDRAITVYSPDGHLFQVEYALEAVRKGNAAVGVRGTDTVVLGVEKKSTPKLQDSRSVRKIVNLDDHIALACAGLKADARVLVNRARIECQSHRLTVEDPVTVEYITRYIAGLQQKYTQVVV

SEQ ID NO: 8587 - protein, 248 aa, Amaranthus tuberculatus
MARYDRAITVFSPDGHLFQVEYALEAVRKGNAAVGVRGTDTVVLGVEKKSAAKLQDSRSVRKIVNLDNHIALACAGLKADARVLINRARIECQSHKLTLEDPVTVEYITRYIAGLQQKYTQSGGVRPFGLSTLIVGFDPYTNVPALYQTDPSGTFSAWKANATGRNSNSIREFLEKNYKETSGQETIKLAIRALLEVVESGGKNLEVAVMTKEGLRQLEEAEIDAIVAEIEAEKAAAEAAKKAPAKDT

SEQ ID NO: 8588 - protein, 248 aa, Chrysanthemum coronarium
MARYDRAITVFSPDGHLFQVEYALEAVRKGNAAVGVRGTDIVVLGVEKKSTVKLQDSRSVRKIVNLDNHIALACAGLKADARVLINKARIECQSHKLTVEDPVTVEYITRYIAGLQQKYTQSGGVRPFGLSTLIVGFDPYTNVPSLYQTDPSGTFSAWKANATGRNSNSMREFLEKNYKETSGQETVKLTIRALLEVVESGGKNIEVAVMTKEGLRQLEETEIDVIVAEIEAEKAAAEAAKKTPSMQT

SEQ ID NO: 8589 - protein, 248 aa, Chrysanthemum coronarium
MARYDRAITVFSPDGHLFQVEYALEAVRKGNAAVGVRGTDTVVLGVEKKSTVKLQDSRSVRKIVNLDDHIALACAGLKADARVLINKARIECQSHKLTVEDPVTVEYITRYIAGLQQKYTQSGGVRPFGLSTLIVGFDPYTDVPSLYQTDPSGTFSAWKANATGRNSNSMREFLEKNYKETSGQETVKLTIRALLEVVESGGKNIEVAVMTKEGLRQLEETEIDVIVAEIEAEKAAAEAAKKTPSMQT

SEQ ID NO: 8590 - protein, 247 aa, Allium cepa
MARYDRAITVFSPDGHLFQVEYALEAVRKGNAAVGVRGTDNVVLGVEKKSAPKLQDSRSVRKIVNLDDHIALACAGLKADARVLINKARIECQSHKLTVEDPVTVEYITRYIAGLQQKYTQSGGVRPFGLSTLIVGFDPYTGVPSLYQTDPSGTFSAWKANATGRNSNSMREYLEKNYKEVAGQETVKLAIRALLEVVESGGKNIEIAVMTKEGGLKQLEESEIDAIVAEIEAEKAAAEAAKKAPRD

SEQ ID NO: 8591 - protein, 248 aa, Ambrosia trifida
MARYDRAITVFSPDGHLFQVEYALEAVRKGNAAVGVRGTDAIVLGVEKKSTVKLQDSRSVRKIVTLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETVKLAIRALLEVVESGGKNIEVGVMTKEGLKQLEEDEIDTIVAEIEAEKAAAEAAKKAPSKQT

SEQ ID NO: 8592 - protein, 249 aa, Cirsium arvense
MARYDRAITVFSPDGHLFQVEYALEAVRKGNAAVGVRGTDTIVLGVEKKSTVKLQDSRSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAIRALLEVVESGGKNIEVAVMRKEGLRQLEEAEIDSIVAEIEAEKAAAEAAKKAPASKQT

SEQ ID NO: 8593 - protein, 249 aa, Cucumis sativus
MARYDRAITVFSPDGHLFQVEYALEAVRKGNAAVGVRGTDTIVLGVEKKATPKLQDSRSVRKIVNLDDHIALACAGLKADARVLINRARIECQSHRLTVEDPVTVEYITRYIAGLQQKYTQSGGVRPFGLSTLIIGFDPYTGAPSLYQTDPSGTFSAWKANATGRNSNSIREFLEKNYKETSGQETVKLAIRALLEVVESGGKNIEVAVMTKEHGLRQLEEAEIDALVAEIEAEKAAAEAAKKAPPKET

SEQ ID NO: 8594 - protein, 249 aa, Cucurbita pepo
MARYDRAITVFSPDGHLFQVEYALEAVRKGNAAVGVRGTDTVVLGVEKKAAPKLQDSRSVRKIVNLDNHIALACAGLKADARVLINRARIECQSHRLTVEDPVTVEYITRYIAGLQQKYTQSGGVRPFGLSTLIIGFDPYTGAPSLYQTDPSGTFSAWKANATGRNSNSIREFLEKNYKETSGQETVKLAIRALLEVVESGGKNIEVAVMTKEQGLRQLEEAEIDALVAEIEAEKAAAEAAKKAPPKET

SEQ ID NO: 8595 - protein, 249 aa, Cynara scolymus
MARYDRAITVFSPDRHLFQVEYALEAVRKGNAAVGVRGTDTIVLGVEKKSTVKLQDSTSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAIRALLEVVESGGKNIEVAVMTKEGLRQLEEAEIDAIVAEIEAEKAAAEAAKKAPASKQT

SEQ ID NO: 8596 - protein, 249 aa, Citrus sinensis
MARYDRAITVFSPDGHLFQVEYALEAVRKGNAAVGVRGTDTIVLGVEKKSTVKLQDSRSVRKIVSLDNHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAIRALLEVVESGGKNIEVAVMTREKGLKQLDEAEIDAMVAEIEAKKAAAEAAKKGPPKET

SEQ ID NO: 8597 - protein, 237 aa, Carica papaya
MARYDRAITVFSPDGHLFQVEYALEAVRKGNAAVGVRGSDIVVLGVEKKSTAKLQDSRSVKKIVSLDEHIALVCAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETVKLAIRALLEVVESGGKNIEIAVMRKEHGLRQLEEAEIDAIVAEIEAEKAA

SEQ ID NO: 8598 - protein, 249 aa, Capsicum annuum
MARYDRAITVFSPDGHLFQVEYAMEAVRKGNAAVGVRGTDTVVLGVEKKSTPKLQDSRSVRKIVNLDDHIALACAGLKADARVLVNKARIECQSHKLTVEDPVTVEYITRYIAGLQQKYTQSGGVRPFGLSTLIIGFDPHTGVPSLYQTDPSGTFSAWKANATGRNSNSIREFLEKNYKETSGQETVKLAIRALLEVVESGGKNIEVALMTKEHGLRQLEEAEIDAVVAEIEAEKAAAEAAKKAQPKET

SEQ ID NO: 8599 - protein, 249 aa, Scabiosa columbaria
MARYDRAITVFSPDGHLFQVEYALEAVRKGNAAVGVRGTDTVVLGVEKKSTVKLQDSRSVRKIVNLDDHIALACAGLKADARVLINRARIECQSHKLTVEDPVTVEYITRYIAGLQQKYTQSGGVRPFGLSTLIVGFDPYTDVPSLYQTDPSGTFSAWKANATGRNSNSMREFLEKNYKETSGQETVKLAVRALLEVVESGGKNIEVAVMTKDKGLKQLDEAEIDAIVSEIEAEKAAAEAAKKAPQRDA

SEQ ID NO: 8600 - protein, 250 aa, Eutrema halophilum
MARYDRAITVFSPDGHLFQVEYALEAVRKGNAAVGVRGTDTVVLAVEKKSTPKLQDSRSARKIVSLDNHIALACAGLKADARVLINKARIECQSHRLTLEDPVTVEYITRYIAGLQQKYTQSGGVRPFGLSTLIVGFDPYSHVPSLYQTDPSGTFSAWKANATGRNSNSIREFLEKNYKESSGQETVKLAIRALLEVVESGGKNIEVAVMTREESGLRQLEEAEIDAIVAEIEAEKAAAEAAKKGPPKET

SEQ ID NO: 8601 - protein, 248 aa, Nicotiana tabacum
MARYDRAITVFSPDGHLFQVEYALEAVRKGNAAVGVRGTDTVVLGVEKKSTPKLQDSRSARKIVNLDDHIALACAGLKADARVLVNRARIECQSHRLTVEDPVTVEYITRYIAGLQQKYTQSGGVRPFGLSTLIIGFDPYTGVPALYQTDPSGTFSAWKANATGRNSNSLRELLEKNYKETSGQETVKLAIRALLEVVESGGKNIEVAVMTKEHGLKQLEEAEIDAIVAEIEAEKAAAEAAKKAPKET

SEQ ID NO: 8602 - protein, 249 aa, Nicotiana tabacum
MARYDRAITVFSPDGHLFQVEYALEAVRKGNAAVGVRGTDTVVLGVEKKSTPKLQDSRSVRKIVNLDDHIALACAGLKADARVLVNRARIECQSHRLTVEDPVTVEYITRYIAGLQQKYTQSGGVRPFGLSTLIIGFDPYTGVPSLYQTDPSGTFSAWKANATGRNSNSLREFLEKNYKETSGQETVKLAIRALLEVVESGGKNIEVAVMTKEHGLKQLEEAEIDAVVAEIEAEKAAAEAAKKALPKET

SEQ ID NO: 8603 - protein, 249 aa, Juglans hindsii x Juglans regia
MARYDRAITVFSPDGHLFQVEYALEAVRKGNAAVGVRGTDTIVLGVEKKSTAKLQDSRSVRKIVDLDDHIALACAGLKADARVLVNRARIECQSHRLTVEDPVTVEYITRYIAGLQQKYTQSGGVRPFGLSTLIIGFDPYSGAPSLYQTDPSGTFSAWKANATGRNSNSIREFLEKNYKETSGQETVKLAIRALLEVVESGGKNIEVAVMTREHGLRQLEEAEIDAIVAEIDAEKAATEAAKKAPPKDT

SEQ ID NO: 8604 - protein, 177 aa, Panax ginseng
MARYDRAITVFSPDGHLFQVEYALEAVRKGNAAVGVRGTDTIVLGVEKKSTVKLQDSRSVRKIVNLDDHIALACAGLKADARVLINRARIECQSHKLTVEDPVTVEYITRYIAGLQQKYTQSGGVRPFGLSTLIVGFDPYTGVPSLYQTDPSGTFSAWKANATGRNSNSMREFLEKN

SEQ ID NO: 8605 - protein, 132 aa, Arachis hypogaea
MARYDRAITVFSPDGHLFQVEYALEAVRKGNAAVGVRGTDNVVLGVEKKSTAKLQDSRTVRKIVNLDDHIALACAGLKADARVLINRARVECQSHRLTVEDPVTVEYITRYIAGLQQKSHKVVVFGPLAFQP

SEQ ID NO: 8606 - protein, 59 aa, Petunia hybrida
MARYDRAITVFSPDGHLFQVEYALEAVRKGNAVVGVRGTDTVVLGVEKNLLLSFKTPGQ

SEQ ID NO: 8607 - protein, 259 aa, Trifolium pratense
IERRSKWRDTIEQSQFSLPTAISSKLNTLSKLFVKVTPPSVFVVPTTLFSNVVLGVEKKSTAKLQDSRSVRKIVNLDNHIALACAGLKADARVLINRARVECQSHRLTVEDPCTVEYITRYIAGLQQKYTQSGGVRPFGLSTLIVGFDPYTGSPSLYQTDPSGTFSAWKANATGRNSNSIREFLEKNFKETSGQETVKLAIRALLEVVESGGKNIEVAVMTKEDGLRQLEEAEIDAIVAEIEAEKAAAEAAKKAPFKDT

SEQ ID NO: 8608 - protein, 250 aa, Castanea mollissima
MARYDRAITVFSPDGHLFQVEYALEAVRKGNAAVGVRGLDAVVLGVEKKSTPKLQDSRSVKKIVSLDNHIALACAGLKADARVLINRARIECQSHRLTVEDPATVEYITRHIAGLQQKYTQSGGVRPFGLSTLIAGFDPYTGTPSLYQTDPSGTFQAWKANATGRNSNSMREFLEKNYKETSGQETVKLAIRALLEVVESGGKNIEIAVMTKEHGLHQLEEAEIDAIVAEIEAEKAAAEAAKKAPATKET

SEQ ID NO: 8609 - protein, 249 aa, Cocos nucifera
MARYDRAITVFSPDGHLFQVEYALEAVRKGNAAVGVRGTDTIVLGVEKKATPKLQDSRSVRKIVSLDNRIALACAGLKADARILINQARNECQSHRLTVEDPVTVEYITRYIAGLQQKYTQSGGVRPFGLSTLIIGFDPYTGVPALYQTDPSGTFSAWKANATGRNSNSMREFLEKNYKETSGQETVKLAIRALLEVVESGGKNIEIAVMTRETGLRQLDEAEIDAIVAEIEAEKAAAEAAKKAPSKET

SEQ ID NO: 8610 - protein, 247 aa, Allium cepa
MARYDRAITVFSPDGHLFQVEYALEAVRKGNAAVGVRGTDNVVLGVEKKSAPKLQDSRSVRKIVNLDDHIALACAGLKADARVLINKARIECQSHKLTVEDPVTVEYITRYIAGLQQKYTQSGGVRPFGLSTLIVGFDPYTGVPSLYQTDPSGTFSAWKANATGRNSNSMREYLEKNYKEVAGKETVKLAIRALLEVVESGGKNIEIAVMTKEEGLKQLEESEIDAIVAEIEAEKAAAEAAKKAPRD

SEQ ID NO: 8611 - protein, 248 aa, Allium cepa
MARYDRAITVFSPDGHLFQVEYALEAVRKGNAAVGVRGTDNVVLGVEKKSTPKLQDSRSVRKIVNLDDHIALACAGLKADARVLINKARIECQSHKLTVEDPVTVEYITRYIAGMQQKYTQSGGVRPFGLSTLIVGFDPYTGVPSLYQTDPSGTFSAWKANATGRNSNSMREYLEKNYKEVAGVETIKLAIRALLEVVESGGKNIEIAVMTKEEGLKQLEEAEIDAIVAEIEAEKAAAEAAKKAPRDN

SEQ ID NO: 8612 - protein, 247 aa, Allium cepa
MARYDRAITVFSPDGHLFQVEYALEAVRKGNAAVGVRGTDNVVLGVEKKSAPKLQDSRSVRKIVNLDDHIALACAGLKADARVLINKARIECQSHKLTVEDPVTVEYITRYIAGLQQKYTQSGGVRPFGLSTLIVGFDPYTGVPSLYQTDPSGTFSAWKANATGRNSNSMREYLEKNYKEVAGKETVKLAIRALLEVVESGGKNIEIAVMTKEGGLKQLEESEIDAIVAEIEAEKAAAEAAKKAPRD

SEQ ID NO: 8613 - protein, 249 aa, Amorphophallus konjac
MARYDRAITVFSPDGHLFQVEYALEAVRRGNAAVGVRGTDTVVLGVEKKSTPKLQDSRTVRKIVSLDNHIALACAGLKADARILINKARIECQSHRLTVEDPVTVEYITRYIAGLQQKYTQSGGVRPFGLSTLIIGFDPYTSVPSLYQTDPSGTFSAWKANATGRNSNSMREFLEKNYKETSGQETVKLAIRALLEVVESGGKTIEIAVMTKEHGLRQLEEAEIDALVTEIEAEKAAAETAKKALPKDT

SEQ ID NO: 8614 - protein, 250 aa, Brassica rapa
MARYDRAITVFSPDGHLFQVEYALEAVRKGNAAVGVRGTDTVVLAVEKKSTPKLQDTRSARKIVSLDNHVALACAGLKADARVLINKARIECQSHRLTLEDPVTVEYITRYIAGLQQKYTQSGGVRPFGLSTLIVGFDPYTRIPALYQTDPSGTFSAWKANATGRNSNSIREFLEKNYKETSGQETVKLAIRALLEVVESGGKNIEVALMTREEGTLRQLEEAEIDAIVAEIEAEKAAAEAAKKGPSKET

SEQ ID NO: 8615 - protein, 248 aa, Beta vulgaris
MARYDRAITVFSPDGHLFQVEYALEAVRKGNAAVGVRGTDTVVLGVEKKSAAKLQDSRSVRKIVNLDNHVALACAGLKADARVLINRARIECQSHRLTLEDPVTVEYITRFIAGLQQKYTQSGGVRPFGLSTLIVGFDPYTDVPALYQTDPSGTFSAWKANATGRNSNSLREFLEKNYKETSGQETIKLAIRALLEVVESGGKNLEVAVMTKEGLRQLEESEIDAIVAEIEAEKAAAEAAKKAPASSS

SEQ ID NO: 8616 - protein, 249 aa, Cleome spinosa
MARYDRAITVFSPDGHLFQVEYALEAVRKGNAAVGVRGSDTIVLAVEKKSTPKLQDSRSARKIVSLDNHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSIREFLEKNFKETSGQETVKLAVRALLEVVESGGKNIEVAVMTKEHGLKQLEEAEIDAVVAEIEAEKAAAEAAKKAPPKET

SEQ ID NO: 8617 - protein, 251 aa, Gossypium hirsutum
MARYDRAITVFSPDGHLFQVEYALEAVRKGNAAVGVRGTDIVVLGVEKKSAVKLQDSRSVRKIVSLDDHIALACAGLKADARVLINRARIECQSHRLTVEEPVTVEYITRYIAGLQQKYTQSGGVRPFGLSTLIVGFDPYTGVPSLYQTDPSGTFSAWKANATGRNSNSMREFLEKNYKETSGHETIKLAIRALLEVVESGGKNIEVATMTKEHGLRQLEESEIDAIVAEIEAEKAAAEAAKKALAAPKET

SEQ ID NO: 8618 - protein, 249 aa, Panax ginseng
MARYDRAITVFSPDGHLFQVEYALEAVRKGNAAVGVRGTDTIVLGVEKKSTVKLQDSRSVRKIVNLDDHIALACAGLKADARVLINRARIECQSHKLTVEDPVTVEYITRYIAGLQQKYTQSGGVRPFGLSTLIVGFDPYTGMPSLYQTDPSGTFSAWKANATGRNSNSMREFLEKNYKETSGQETIKLAIRALLEVVESGGKNIEVAVMTKDQGLHQLDEAEIDAVVAEIEAEKEAAEAAKKGPSRET

SEQ ID NO: 8619 - protein, 251 aa, Gossypium raimondii
MARYDRAITVFSPDGHLFQVEYALEAVRKGNAAVGVRGTDIVVLGVEKKSAVKLQDSRSVRKIVSLDDHIALACAGLKADARVLINRARIECQSHRLTVEDPVTVEYITRYIAGLQQKYTQSGGVRPFGLSTLIVGFDPYTSVPSLYQTDPSGTFSAWKANATGRNSNSMREFLEKNYKETSGHETIKLAIRALLEVVESGGKNIEVATMTKEHGLRQLEESEIDAIVAEIEAEKAAAEAAKKDLAAPKET

SEQ ID NO: 8620 - protein, 249 aa, Cucumis melo
MARYDRAITVFSPDGHLFQVEYALEAVRKGNAAVGVRGTDTIVLGVEKKATPKLQDSRSVRKIVNLDNHIALACAGLKADARVLINRARIECQSHRLTVEDPVTVEYITRYIAGLQQKYTQSGGVRPFGLSTLIIGFDPYTGAPSLYQTDPSGTFSAWKANATGRNSNSIREFLEKNYKETSGQETVKLAIRALLEVVESGGKNIEVAVMTKEHGLRQLEEAEIDALVAEIEAEKAAAEAAKKAPPKET

SEQ ID NO: 8621 - protein, 249 aa, Carica papaya
MARYDRAITVFSPDGHLFQVEYALEAVRKGNAVVGVRGADNVVLAVEKKSTPKLQDSRSVRKIVSLDNHIALACAGLKADARVLINRARIECQSHRLTVEDPVTVEYITRYIAGLQQKYTQSGGVRPFGLSTLIVGFDPYSGAPSLYQTDPSGTFSAWKANASGRNSNSIREFLEKNYKETSGQETVKLAIRALLEVVESGGKNIEVAVMTKEHGLRQLEEAEIDALVAEIEAEKAAAEAAKKAPPKET

SEQ ID NO: 8622 - protein, 247 aa, Chenopodium quinoa
MARYDRAITVFSPDGHLFQVEYALEAVRKGNAAVGVRGTDTVVLGVEKKSAAKLQDSRSVRKIVNLDDHIALACAGLKADARVLINRARIECQSHKLTLEDPVTVEYITRYIAGLQQKYTQSGGVRPFGLSTLIVGFDPHTNVPALYQTDPSGTFSAWKANATGRNSNSIREFLEKNYKETSGQETVKLAIRALLEVVESGGKNLEVAVMTKKGLHQLEESEIDAIVAEIEEEKAAAEAAKKGPSSS

SEQ ID NO: 8623 - protein, 236 aa, Euphorbia esula
MARYDRAITVFSPDGHLFQVEYALEAVRKGNAAVGVRGTDVVVLGVEKKSIAKLQDARSVRKIVSLDDHVALVCAGLKADARVLVNKARIECQSHKLTVEDPVTVEYITRFIAGLQQKYTQSGGVRPFGLSTLIVGFDPHTGVPSLYQTDPSGAFSAWKANATGRNSNSMREFLEKNFKETSGQETVKLAIRALLEVVESGGKNIEIGVMTKEKGLRQLEEAEIDAIVAEIEAEKA

SEQ ID NO: 8624 - protein, 249 aa, Juglans hindsii x Juglans regia
MARYDRAITAFPPDGHLFQVEYALEAVRKGNAAVGVRGTDTVVLGVEKKSAAKLQDSRSVRKIVNLDDHIALACAGLKADARVLVNRARIECQSHRLTVEDPVTVEYITRYIAGLQQKYTQSGGVRPFGLSTLIIGFDPYSGSPSLYQTDPSGTFSAWKANATGRNSNSIREFLEKNYKETSGQETVKLAIRALLEVVESGGKNIEVAVMTKEQGLRQLEEAEIDAIVAEIDAEKAAAEAAKKAPSKET

SEQ ID NO: 8625 - protein, 186 aa, Petunia hybrida
MARYDRAITVFSPDGHLFQVEYALEAVRKGNAVVGVRGTDTVVLGVEKKSTPKLQDSRSVRKIVNLDDHIALACAGLKADARVLVNRARIECQSHRLTVEDPVTVEYITRYIAGLQQKYTQSGGVRPFGLSTLIIGFDPYTNVPSLYQTDPSGTFSAWKANATGRNSNSIREFLEKNYKETSGQEQ

SEQ ID NO: 8626 - protein, 250 aa, Brassica napus
  Sequence also found in Organisms: Brassica oleracea
MARYDRAITVFSPDGHLFQVEYALEAVRKGNAAVGVRGTDTVVLAVEKKSTPKLQDTRSARKIVSLDNHVALACAGLKADARVLINKARIECQSHRLTLEDPVTVEYITRYIAGLQQKYTQSGGVRPFGLSTLIVGFDPYTRIPSLYQTDPSGTFSAWKANATGRNSNSIREFLEKNYKETSGQETVKLAIRALLEVVESGGKNIEVALMTREEGTLRQLEEAEIDAIVAEIEAEKAAAEAAKKGPSKET

SEQ ID NO: 8627 - protein, 244 aa, Chrysanthemum coronarium
MARYDRAITVFSPDGHLFQVEYALEAVRKGNAAVGVRGTDTVVLGVEKKSTVKLQDSRSVRKIVNLDDHVALACAGLKADARVLINKARIECQSHKLTVEDPVTVEYITRYIAALQQKYTQSGGVRPFGLSTLIVGFDPYTSVPSLYQTDPSGTFSAWKANATGRNSNSMREFLEKNYKETSGQETIKLTIRALLEVVESGGKNIEVAVMTKEGLRQLEEAEIDTIVAEVEAEKAAAKKGPAKE

SEQ ID NO: 8628 - protein, 249 aa, Amsonia hubrichtii
MARYDRAITVFSPDGHLFQVEYALEAVRKGNAAVGVRGTDTIVLGVEKKSTPKLQDSRSVRKIVNLDDHIALACAGLKADARVLINRARIECQSHRLTVEDPVTVEYITRYIAGLQQKYTQSGGVRPFGLSTLIIGFDPYTAAPSLYQTDPSGTFSAWKANATGRNSNSIREFLEKNYKETSGRETIKLAIRALLEVVESGGKNIEVAVMTKEHGLKQLEEAEIDAIVAEIEEEKAAAEAAKKGPPKET

SEQ ID NO: 8629 - protein, 249 aa, Aquilegia formosa
MARYDRAITVFSPDGHLFQVEYALEAVRKGNAAVGYRGIDNVVLAVEKKSTAKLQDSRSVRKIVNLDNHIALACAGLKADARVLINKARIECQSHRLTVEDPVTVEYITRYIAGLQQKYTQSGGVRPFGLSTLIVGFDPYTGAPSLYQTDPSGTFSAWKANATGRNSNSLREFLEKNYKETSGQETVKLAIRALLEVVESGGKNIEVAVMTKEHGLHQLEEAEIDAIVTEIEAEKEAAEAAKKPPAKET

SEQ ID NO: 8630 - protein, 250 aa, Brassica napus
MARYDRAITVFSPDGHLFQVEYALEAVRKGNAAVGVRGTDTVVLAVEKKSTPKLQDTRSARKIVSLDNHVALACAGLKADARVLINKARIECQSHRLTLEDPVTVEYITRYIAGLQQKYTQSGGVRPFGLSTLIVGFDPYTRIPALYQTDPSGTFSAWKANATGRNSNSIREFLEKNYKETSGQETVKLAIRALLEVVESGGKNIEVALMTREEGTLRQLEEAEIDAIVAEIEAEKAAAEAARKGPSKET

SEQ ID NO: 8631 - protein, 249 aa, Cucurbita pepo
MARYDRAITVFSPDGHLFQVEYALEAVRKGNAAVGVRGTDTIVLGVEKKAAPKLQDSRSVRKIVNLDNHIALACAGLKADARVLINRARIECQSHRLTVEDPVTVEYITRYIAGLQQKYTQSGGVRPFGLSTLIIGFDPYTGTPSLYQTDPSGTFSAWKANATGRNSNSIREFLEKNYKETSGQETVKLAIRALLEVVESGGKNIEVAVMTKEHGLRQLEEAEIDALVAEIEAEKAAAEAAKKAPPKET

SEQ ID NO: 8632 - protein, 249 aa, Euonymus alatus
MARYDRAITVFSPDGHLFQVEYALEAVRKGNAAVGVRGTDNIVLGVEKKSTAKLQDSRSVRKIVNLDDHIALACAGLKADARVLINKARIECQSHRLTLEDPVTVEYITRYIAGLQQKYTQSGGVRPFGLSTLIVGFDPYTDVPSLYQTDPSGTFSAWKANATGRNSNSIREFLEKNYKETSGHETLKLAIRALLEVVESGGKNIEVAVMTKEHGLRQLDEAEIDAVVAEIEAEKAAAEAAKRGPVQET

SEQ ID NO: 8633 - protein, 249 aa, Setaria italica
MARYDRAITVFSPDGHLFQVEYALEAVRKGNAAVGVRGTDTVVLGVEKKSTPKLQDSRSVRKIASLDTHIALACAGLKADARVLINRARVECQSHRLTVEDPVTVEYITRYIAGLQQKYTQSGGVRPFGLSTLIVGFDPYTDKPALYQTDPSGTFSAWKANATGRNSNSMREFLEKNYKETSGKETIKLAIRALLEVVESGGKNIEVAVMTKKDGLRELEEAEVDEYVAEIEAEKAAAEAAKKGAPKDT

SEQ ID NO: 8634 - protein, 248 aa, Panax ginseng
MARYDRAITVFSPDGHLFQVEYALEAVRKGNAAVGVRGTDTIVLGVEKKSTVKLQDSRSVRKIVNLDDHIALACAGLKADARVLINRARIECQSHKLTVEDPVTVEYITRYIAGLQQKYTQSGGVRPFGLSTLIVGFDPYTGVPALYQTDPSGTFSAWKANATGRNSNSMREFLEKNYKETSGQETIKLAIRALLEVVESGGKNIEVAVMTKDQGLRQLDEAEIDAVVAEIEAEKEAAKKGPSRETYA

SEQ ID NO: 8635 - protein, 249 aa, Momordica charantia
MARYDRAITVFSPDGHLFQVEYALEAVRKGNAAVGVRGTDTIVLGVEKKAAPKLQDSRSVRKIVNLDNHIALACAGLKADARVLINRARIECQSHRLTVEDPVTVEYITRYIAGLQQKYTQSGGVRPFGLSTLIIGFDPYTGAPSLYQTDPSGTFSAWKANATGRNSNSIREFLEKNYKETSGQETVKLAIRALLEVVESGGKNIEVAVMTKEHGLRQLEEAEIDALVAEIEAEKAAAEAAKKAPPKET

SEQ ID NO: 8636 - protein, 250 aa, Quercus alba
MARYDRAITVFSPDGHLFQVEYALEAVRKGNAAVGVRGLDAVVLGVEKKSTPKLQDSRSVKKIVSLDNHIALACAGLKADARVLINRARIECQSHRLTVEDPATVEYITRHIAGLQQKYTQSGGVRPFGLSTLIAGFDPYTGTPSLYQTDPSGTFQAWKANATGRNSNSMREFLEKNYKETSGQETVKLTIRALLEVVESGGKNIEIAVMTKEHGLHQLEEAEIDAIVAEIEAEKAAAEAAKKAPATKET

SEQ ID NO: 8637 - protein, 249 aa, Olea europaea
MARYDRAITVFSPDGHLFQVEYALEAVRKGNAAVGVRGTDTIVLAVEKKSTPKLQDSRSVRKIVNLDNHIALACAGLKADARVLINRARIECQSHKLTVEDPVTVEYITRYIAGLQQKYTQSGGVRPFGLSTLIIGFDPYSGVPSLYQTDPSGTFSAWKANATGRNSNSIREFLEKNYKETSGQETVKLAMRALLEVVESGGKNLEVAVMTKDHGLRQLEEAEIDAIVAEIDAEKAAAEAAKKAPPKET

SEQ ID NO: 8638 - protein, 249 aa, Pseudoroegneria spicata
  Sequence also found in Organisms: Secale cereale
MARYDRAITVFSPDGHLFQVEYALEAVRKGNAAVGVRGTDTVVLGVEKKSTPKLQDSRSVRKIASLDTHVALACAGLKADARVLINRARVECQSHRLTVEDPVTVEYITRYIAGLQQKYTQSGGVRPFGLSTLIVGFDPYTDKPALYQTDPSGTFSAWKANATGRNSNSMREFLEKNYKDTSGKETIKLTIRALLEVVESGGKNIEIAVMTKKDGLRQLEETEIDEYVAEIEAEKAAAEAAKKSGPKDT

SEQ ID NO: 8639 - protein, 250 aa, Raphanus sativus
MARYDRAITVFSPDGHLFQVEYALEAVRKGNAAVGVRGTDTVVLAVEKKSTPKLQDTRSARKIVSLDNHVALACAGLKADARVLINKARIECQSHRLTLEDPVTVEYITRYIAGLQQKYTQSGGVRPFGLSTLIVGFDPYTRIPSLYQTDPSGTFSAWKANATGRNSNSIREFLEKNYKETSGQETVKLAIRALLEVVESGGKNIEVALMTREEGTLRQLEEAEIDAIVAEIEAEKAAAEAAKKGPSKEI

SEQ ID NO: 8640 - protein, 250 aa, Sesamum indicum
MARYDRAITVFSPDGHLFQVEYALEAVRKGNAAVGVRGTDTIVLAVEKKSTPKLQDSRSVRKIVNLDDHIALACAGLKADARVLINRARIECQSYKLTIEDPVTVEYITRYIAGLQQKYTQSGGVRPFGLSTLIIGFDPHTGTPSLYQTDPSGTFSAWKANATGRNSNSIREFLEKNYKETSGQETVKLAIRALLEVVESGGKNIEVAVMTKEHGLRQLEEAEIDAIVADIEAEKAAAEAAKKAPSTKET

SEQ ID NO: 8641 - protein, 249 aa, Sorghum bicolor
MARYDRAITVFSPDGHLFQVEYALEAVRKGNAAVGVRGTDTVVLGVEKKSTPKLQDSRSVRKIACLDTHIALACAGLKADARVLINRARVECQSHRLTVEDPVTVEYITRYIAGLQQKYTQSGGVRPFGLSTLIVGFDPYTDKPALYQTDPSGTFSAWKANATGRNSNSMREFLEKNYKETSGKETIKLAIRALLEVVESGGKNIEVAVMTKKDGLRELEEAEIDEYVAEIEAEKAAAEAAKKGAPKDT

SEQ ID NO: 8642 - protein, 249 aa, Panicum virgatum
MARYDRAITVFSPDGHLFQVEYALEAVRKGNAAVGVRGADTVVLGVEKKSTPKLQDSRSVRKIASLDTHIALACAGLKADARVLINRARVECQSHRLTVEDPVTVEYITRYIAGLQQKYTQSGGVRPFGLSTLIVGFDPYTDKPALYQTDPSGTFSAWKANATGRNSNSMREFLEKNYKETSGKETIKLAIRALLEVVESGGKNIEVAVMTKKDGLRELEEAEIDEYVAEIEAEKAAAEAAKKGAPKDT

SEQ ID NO: 8643 - protein, 249 aa, Tabernaemontana elegans
MARYDRAITVFSPDGHLFQVEYALEAVRKGNAAVGVRGIDTIVLGVEKKSTPKLQDSRSVRKIVNLDDHIALACAGLKADARVLINRARIECQSHRLTVEDPVTVEYITRYIAGLQQKYTQSGGVRPFGLSTLIIGFDPYTGAPSLYQTDPSGTFSAWKANATGRNSNSIREFLEKNYKETSGQETVKLAIRALLEVVESGGKNIEVAVMTKEHGLKQLEEAEIDAIVSEIEEEKAAAEAAKKAPPKET

SEQ ID NO: 8644 - protein, 250 aa, Zamia vazquezii
MARYDRAITVFSPDGHLFQVEYALEAVRKGNAAVGVRGTDTIVLGVEKKSTAKLQDSRTVRKIVNLDDHIALACAGLKADARVLINRARIECQSHRLTVEDPATVEYITRYIAGLQQKYTQSGGVRPFGLSTLIVGFDPYTGVPSLYQTDPSGTFSAWKANATGRNSTSVREFLEKNYKETSGQETVKLAIRALLEVVESGGKNIEIAVMTREKGLRQLEESEVDAIVAETEAEKAAAEAAKKAPTPRES

SEQ ID NO: 8645 - protein, 249 aa, Avena sativa
MARYDRAITVFSPDGHLFQVEYALEAVRKGNAAVGVRGTDTVVLGVEKKSTPKLQDSRSLRKIASLDTHIALACAGLKADARVLINRARVECQSHRLTVEDPVTVEYITRYIAGLQQKYTQSGGVRPFGLSTLIVGFDPYTDKPALYQTDPSGTFSAWKANATGRNSNSMREFLEKNYKDTSGKETIKLTIRALLEVVESGGKNIEIAVMTKKDGLRQLEETEIDEYVAEIEAEKAAAEAAKKGGPKDT

SEQ ID NO: 8646 - protein, 249 aa, Avena sativa
MARYDRAITVFSPDGHLFQVEYALEAVRKGNAAVGVRGVDTVVLGVEKKSTPKLQDSRSVRKIASLDTHIALACAGLKADARVLINRARVECQSHRLTVEDPVTVEYITRYIAGLQQKYTQSGGVRPFGLSTLIVGFDPYTEKPALYQTDPSGTFSAWKANATGRNSNSMREFLEKNYKETSGKETIKLTIRALLEVVESGGKNIEIAVMTHKDGLRNLEEAEIDEYVAEIEAEKAAAEAAKKGGPKDT

SEQ ID NO: 8647 - protein, 249 aa, Avena sativa
MARYDRAITVFSPDGHLFQVEYALEAVRKGNAAVGVRGVDTVVLGVEKKSTPKLQDSRSVRKIASLDTHIALACAGLKADARVLINRARVECQSHRLTVEDPVTVEYITRYIAGLQQKYTQSGGVRPFGLSTLIVGFDPYTDKPALYQTDPSGTFSAWKANATGRNSNSMREFLEKNYKDTSGKETIKLTIRALLEVVESGGKNIEIAVMTKKDGLRQLEETEIDEYVAEIEAEKAAAEAAKKGGPKDT

SEQ ID NO: 8648 - protein, 250 aa, Arabidopsis lyrata
MARYDRAITVFSPDGHLFQVEYALEAVRKGNATVGVRGTDTVVLAVEKKSTPKLQDSRSARKIVSLDNHIALACAGLKADARVLINKARIECQSHRLTLEDPVTVEYITRYIAGLQQKYTQSGGVRPFGLSTLIVGFDPYSRLPSLYQTDPSGTFSAWKANATGRNSNSIREFLEKNYKESSGQETIKLAIRALLEVVESGGKNIEVAVMTREETGLRQLEEAEIDAIVAEIEAEKAAAEAAKKGPPKET

SEQ ID NO: 8649 - protein, 250 aa, Arabidopsis thaliana
MARYDRAITVFSPDGHLFQVEYALEAVRKGNAAVGVRGTDTVVLAVEKKSTPKLQDSRSARKIVSLDNHIALACAGLKADARVLINKARIECQSHRLTLEDPVTVEYITRYIAGLQQKYTQSGGVRPFGLSTLIVGFDPYSRLPSLYQTDPSGTFSAWKANATGRNSNSIREFLEKNYKESSGQETIKLAIRALLEVVESGGKNIEVAVMTREETGLRQLEEAEIDAIVAKIEAEKAAAEAAKKGPPKET

SEQ ID NO: 8650 - protein, 249 aa, Hordeum vulgare
MARYDRAITVFSPDGHLFQVEYALEAVRKGNAAVGVRGVDTVVLGVEKKSTPKLQDSRSVRKIASLDTHVALACAGLKADARVLINRARVECQSHRLTVEDPVTVEYITRYIAGLQQKYTQSGGVRPFGLSTLIVGFDPYTEKPALYQTDPSGTFSAWKANATGRNSNSMREFLEKNYKETSGKETIKLTIRALLEVVESGGKNIEIAVMTHKDGLRQLEEDEIDEYVAEIETEKAAAEAAKKGGPKDT

SEQ ID NO: 8651 - protein, 250 aa, Ocimum basilicum
MARYDRAITVFSPDGHLFQVEYALEAVRKGNAAVGVRGTDTIVLAVEKKSTPKLQDSRSVRKIVNLDDHIALACAGLKADARVLINKARIECQSHKLTVEDPVTVEYITRYIAGLQQKYTQSGGVRPFGLSTLIIGFDPHTGTPSLYQTDPSGTFSAWKANATGRNSNSIREFLEKNYKETSGQETVKLAIRALLEVVESGGKNIEVAVMTREHGLRQLEEAEIDAIVVDIEAEKAAAEAAKKAPATKET

SEQ ID NO: 8652 - protein, 249 aa, Brachypodium distachyon
MARYDRAITVFSPDGHLFQVEYALEAVRKGNAAVGVRGTDTVVLGVEKKSTPKLQDSRSVRKIASLDTHIALACAGLKADARVLINRARVECQSHRLTVEDPVTVEYITRYIAGLQQKYTQSGGVRPFGLSTLIVGFDPYTDKPALYQTDPSGTFSAWKANATGRNSNSMREFLEKNYKDTSGKETIKLTIRALLEVVESGGKNIEIAVMTKKDGLRQLEETEIDEYVAEIEAEKAAAEAAKKSGPKDT

SEQ ID NO: 8653 - protein, 249 aa, Catharanthus roseus
MARYDRAITVFSPDGHLFQVEYALEAVRKGNAAVGVRGTDTIVLGVEKKSTPKLQDSRSVRKIVNLDDHIALACAGLKADARVLINRARIECQSHRLTVEDPVTVEYITRYIAGLQQKYTQSGGVRPFGLSTLIIGFDPYTRAPSLYQTDPSGTFSAWKANATGRNSNSIREFLEKNYKETSGRETIKLAIRALLEVVESGGKNIEVAVMTKEDGLKQLEEAEIDEIVAEIEAEKAAAEAAKKAPPKET

SEQ ID NO: 8654 - protein, 249 aa, Lupinus angustifolius
MARYDRAITVFSPDGHLFQVEYALEAVRKGNAAVGVRGSDNVVLGVEKKSTAKLQDSRSVRKIVNLDNHIALACAGLKADARVLVNKARVECQSHRLTVEDPVTVEYITRYIAGLQQKYTQSGGVRPFGLSTLIVGFDPYSGKPSLYQTDPSGTFSAWKANATGRNSNSIREFLEKNYKEVSGQETIKLAIRALLEVVESGGKNIEVAVVTKEHGLRQLEETEIDAIVADIEAEKAAAEAAKKGPSKET

SEQ ID NO: 8655 - protein, 249 aa, Zea mays
MARYDRAITVFSPDGHLFQVEYALEAVRKGNAAVGVRGTDTVVLGVEKKSTPKLQDSRSVRKIACLDTHIALACAGLKADARVLINRARVECQSHRLTVEDPVTVEYITRYIAGLQQKYTQSGGVRPFGLSTLIVGFDPYTDKPALYQTDPSGTFSAWKANATGRNSNSMREFLEKNYKETSGKETIKLAIRALLEVVESGGKNIEVAVMTKKDGLRELEEAEIDEYVAEIEAEKAAAEAAKKGGPRDT

SEQ ID NO: 8656 - protein, 250 aa, Mimulus guttatus
MARYDRAITVFSPDGHLFQVEYALEAVRKGNAAVGVRGTDTIVLAVEKKSAPKLQDSRSVRKIVNLDDHIALACAGLKADARVLINKARIECQSHKLTIEDPVTVEYITRYIAGLQQKYTQSGGVRPFGLSTLIIGFDPHTGIPSLYQTDPSGTFSAWKANATGRNSNSIREFLEKNYKETSGQETLKLAIRALLEVVESGGKNIEVAVMTKEHGLHQLEEAEIDAIVAEIEAEKAAAEAAKKGPSTKET

SEQ ID NO: 8657 - protein, 249 aa, Tropaeolum majus
MARYDRAITVFSPDGHLFQVEYALEAVRKGNAAVGVRGSDNVVLAVEKKSAPKLQDTRSIRKIVNLDNHVALACAGLKADARVLINKARIECQSHRLTVEDPVTVEYITRYIAGLQQKYTQSGGVRPFGLSTLIVGFDPYAGTPSLYQTDPSGTFSAWKANATGRNSNSIREFLEKNYKETSGQETVKLAIRAMLEVVEGGGKNIEVAVMTKEHGLRQLEEAEIDAIVADIEAEKAAAEAAKKGPVKET

SEQ ID NO: 8658 - protein, 249 aa, Oryza sativa
MARYDRAITVFSPDGHLFQVEYALEAVRKGNAAVGVRGSDTVVLGVEKKSTPKLQDSRSVRKIASLDTHIALACAGLKADARVLINRARVECQSHRLTVEDAVTVEYITRYIAGLQQKYTQSGGVRPFGLSTLIVGFDPYTDKPALYQTDPSGTFSAWKANATGRNSNSMREFLEKNYKETSGKETIKLAIRALLEVVESGGKNIEIAVMTQKDGLRQLEEAEIDEYVAEIEAEKAAAEAAKKGAPKET

SEQ ID NO: 8659 - protein, 249 aa, Tripterygium wilfordii
MARYDRAITVFSPDGHLFQVEYALEAVRKGNAAVGVRGTDNIVLGVEKKSAAKLQDSRSVRKIVNLDDHIALACAGLKADARVLINKARIECQSHRLTVEDPVTVEYITRYIAGLQQKYTQSGGVRPFGLSTLIVGFDPYTDVPSLYQTDPSGTFSAWKANATGRNSNSIREFLEKNYKETSGHETLKLAIRALLEVVESGGKNIEVAVMTKEHGLRQLGEAEIDAVVAEIEAEKAAAEAAKRAPVQET

SEQ ID NO: 8660 - protein, 249 aa, Citrullus lanatus
MARYDRAITVFSPDGHLFQVEYALEAVRKGNAAVGVRGTDTIVLGVEKKAAPKLQDSRSVRKIVNLDNHIALACAGLKADARVLINRARIECQSHRLTVEDPVTVEYITRYIAGLQQKYTQSGGVRPFGLSTLIIGFDPYTGAPSLYQTDPSGTFSAWKANATGRNSNSIREFLEKNYKETSGQETVKLAIRALLEVVESGGKNIEVAVMTKEHGLRQLEEAEIDSLVAEIEAEKAAAEAAKKAPPKET

SEQ ID NO: 8661 - protein, 249 aa, Triticum aestivum
MARYDRAITVFSPDGHLFQVEYALEAVRKGNAAVGVRGTDTVVLGVEKKSTPKLQDSRSVRKIASLDTHVALACAGLKADARVLINRARVECQSHRLTVEDPVTVEYITRYIAGLQQKYTQSGGVRPFGLSTLIVGFDPYTEKPALYQTDPSGTFSAWKANATGGNSNSMREFLEKNYKDTSGKETIKLTIRALLEVVESGGKNIEIAVMTKKDGLRQLEETEIDEYVAEIEAEKAAAEAAKKSGPKDT

SEQ ID NO: 8662 - protein, 249 aa, Echinochloa colona
MARYDRAITVFSPDGHLFQVEYALEAVRKGNAAVGVRGTDTVVLGVEKKSTPKLQDSRSVRKIASLDTHIALACAGLKADARVLINRARVECQSHRLTVEDPVTVEYITRYIAGLQQKYTQSGGVRPFGLSTLIVGFDPYTQKPALYQTDPSGTFSAWKANATGRNSNSMREFLEKNYKETSGKETIKLAIKALLEVVESGGKNIEIAVMTHKDGLRELEEAEIDEYVAEIEAEKAAAEAAKKGAQKET

SEQ ID NO: 8663 - protein, 250 aa, Brassica juncea
MARYDRAITVFSPDGHLFQVEYALEAVRKGNAAVGVRGTDTVVLAVEKKSTPKLQDTRSARKIVSLDNHIALACAGLKADARVLINKARIECQSHRLTLEDPVTVEYITRYIAGLQQKYTQSGGVRPFGLSTLIVGFDPYTRIPALYQTDPSGTFSAWKANATGRNSNSIREFLEKNYKETSGQETVKLAIRALLEVVESGGKNIEVALMTREEGTLKQLEEAEIDAIVAEIEAEKAAAEAAKKGPSRET

SEQ ID NO: 8664 - protein, 250 aa, Ocimum basilicum
MARYDRAITVFSPDGHLFQVEYALEAVRKGNAAVGVRGTDTIVLAVEKKSTPKLQDSRSVRKIVNLDDHIALACAGLKADARVLINKARIECQSHKLTVEDPVTVEYITRYIAGLQQKYTQSGGVRPFGLSTLIIGFDPHTGTPSLYQTDPSGTFSAWKANATGRNSNSIREFLEKNYKETSGQETVKLAIRALLEVVESGGKNIEVAVMTREHGLRQLEEGEIDAIVVDIEAEKAAAEAAKKAPATKET

SEQ ID NO: 8665 - protein, 249 aa, Festuca arundinacea
MARYDRAITVFSPDGHLFQVEYALEAVRKGNAAVGVRGVDTVVLGVEKKSTPKLQDSRSVRKIANLDTHIALACAGLKADARVLINRARVECQSHRLTVEDPVTVEYITRYIAGLQQKYTQSGGVRPFGLSTLIVGFDPYTEKPALYQTDPSGTFSAWKANATGRNSNSMREFLEKNYKETSGKETIKLTIRALLEVVESGGKNIEIAVMTHKDGLRNLEEAEIDEYVAEIEAEKAAAEAAKKGGPKDT

SEQ ID NO: 8666 - protein, 249 aa, Setaria italica
MARYDRAITVFSPDGHLFQVEYALEAVRKGNAAVGVRGVDTVVLGVEKKSTPKLQDSRSVRKIASLDTHIALACAGLKADARVLINRARVECQSHRLTVEDPVTVEYITRYIAGLQQKYTQSGGVRPFGLSTLIVGFDPYTQKPALYQTDPSGTFSAWKANATGRNSNSMREFLEKNYKETSGKETIKLAIRALLEVVESGGKNIEVAVMTHKDGLRELEEAEIDEYVAEIEAEKAAAEAAKKGAPKET

SEQ ID NO: 8667 - protein, 249 aa, Zea mays
MARYDRAITVFSPDGHLFQVEYALEAVRKGNAAVGVRGVDTVVLGVEKKSTPKLQDSRSVRKIASLDTHIALACAGLKADARVLINRARVECQSHRLTVEDPVTVEYITRYIAGLQQKYTQSGGVRPFGLSTLIVGFDPYTQKPALYQTDPSGTFSAWKANATGRNSNSMREFLEKNYKETSGKETIKLAIRALLEVVESGGKNIEIAVMTHEDGLHELEEAEIDEYVAEIEAEKAAAEAAKKGAPKGN

SEQ ID NO: 8668 - protein, 249 aa, Zea mays
MARYDRAITVFSPDGHLFQVEYALEAVRKGNAAVGVRGTDTVVLGVEKKSTPKLQDSRSVRKIACLDTHIALACAGLKADARVLINRARVECQSHRLTVEDPVTVEYITRYIAGLQQKYTQSGGVRPFGLSTLIVGFDPYTDKPALYQTDPSGTFSAWKANATGRNSNSMREFLEKNYKETSGKETIKLAIRALLEVVESGGKNIEVAVMTKKDGLRELEESEIDEYVAEIEAEKAAAEAAKKGAPKNA

SEQ ID NO: 8669 - protein, 249 aa, Pennisetum glaucum
MARYDRAITVFSPDGHLFQVEYALEAVRKGNAAVGVRGIDIVVLGVEKKSTPKLQDSRSLRKIASLDTHIALACAGLKADARVLINRARVECQSHRLTVEDPVTVEYITRYIAGLQQKYTQSGGVRPFGLSTLIVGFDPYTQKPALYQTDPSGTFSAWKANATGRNSNSMREFLEKNYKETSGKETIKLAIRALLEVVESGGKNIEVAVMTHKDGLRELEEAEIDEYVAEIEAEKAAAEAAKKGAPKET

SEQ ID NO: 8670 - protein, 250 aa, Orobanche aegyptiaca
MARYDRAITVFSPDGHLFQVEYALEAVRKGNAAVGVRGTDTIVLAVEKKSTPKLQDSRSVRKIVNLDDHIALACAGLKADARVLINKARIECQSHKLTIEDPVTVEYITRYIAGLQQKYTQSGGVRPFGLSTLIIGFDPHTGIPSLYQTDPSGTFSAWKANATGRNSNSIREFLEKNYTDTSGQETLKLAIRALLEVVESGGKNIEVAVMTKEHGLKQLEEAEIDAIVAEIEAEKAAAEAAKKGPSAKET

SEQ ID NO: 8671 - protein, 251 aa, Phalaenopsis aphrodite
MARYDRAITVFSPDGHLFQVEYALEAVRKGNAAVGVRGIDTIVLGVEKKATPKLQDSRTMKKIASLDSHIALACAGLKADARVLINRARIECQSHRLTLEDPVTVEYITRYIAGLQQKYTQSGGVRPFGLSTLIVGFDPYTGAPSLYQTDPSGTFSAWKANATGRNSNSMREFLEKNYKETSGQETVKLAIRALLEVVESGGKNIEIAVMTKEDGLRQLEESEIDAIVAEIESEKAAAEAAKKGPSKETQP

SEQ ID NO: 8672 - protein, 250 aa, Lippia dulcis
MARYDRAITVFSPDGHLFQVEYALEAVRKGNAAVGVRGTDNIVLAVEKKSAPKLQDSRSVRKIVNLDDHIALACAGLKADARVLINRARIECQSHKLTIEDPVTVEYITRYIAGLQQKYTQSGGVRPFGLSTLIIGFDPHTGIPSLYQTDPSGTFSAWKANATGRNSNSIREFLEKNYKEVSGQETVKLAIRALLEVVESGGKNIEVAVMTKEHGLHQLEEAEIDAIVAEIEAEKAAAEAAKKGPATKET

SEQ ID NO: 8673 - protein, 250 aa, Raphanus sativus
MARYDRAITVFSPDGHLFQVEYALEAVRKGNAAVGVRGTDTVVLAVEKKSTPKLQDTRSARKIVSLDNHVALACAGLKADARVLINKARIECQSHRLTLEDPVTVEYITRYIAGLQQKYTQSGGVRPFGLSTLIVGFDPYTRIPSLYQTDPSGTFSAWKANATGRNSNSIREFLEKNYKETSGQETVKLAIRALLEVVESGGKNIEVALMTREEGTLKQLEEAEIDAIVAEIEAEKAAAEAAKKGPSRET

SEQ ID NO: 8674 - protein, 249 aa, Oryza sativa
MARYDRAITVFSPDGHLFQVEYALEAVRKGNAAVGVRGTDTVVLGVEKKSTPKLQDSRSMRKIASLDTHIALACAGLKADARVLINRARVECQSHRLTVEDPVTVEYITRYIAGLQQKYTQSGGVRPFGLSTLIVGFDPYTEKPALYQTDPSGTFSAWKANATGRNSNSMREFLEKNYKDTSGKETIKLAIRALLEVVESGGKNIEIAVMTHKDGLRELEEAEIDEYVAEIEAEKAAAEAAKKGAPKET

SEQ ID NO: 8675 - protein, 249 aa, Secale cereale
MARYDRAITVFSPDGHLFQVEYALEAVRKGNAAVGVRGVDTVVLGVEKKSTPKLQDSRSVRKIASLDTHIALACAGLKADARVLINRARVECQSHRLTVEDPVTVEYITRYIAGLQQKYTQSGGVRPFGLSTLIVGFDPYTEKPALYQTDPSGTFSAWKANATGRNSNSMREFLEKNYKETSGKETIKLTIRALLEVVESGGKNIEIAVMTHKDGLRQLEEEEIDEYVAEIEAEKAAAEAAKKGGRKDT

SEQ ID NO: 8676 - protein, 249 aa, Saccharum officinarum
MARYDRAITVFSPDGHLFQVEYALEAVRKGNAAVGVRGVDTVVLGVEKKSTPKLQDSRSVRKIASLDTHIALACAGLKADARVLINRARVECQSHRLTVEDPVTVEYITRYIAGLQQKYTQSGGVRPFGLSTLIVGFDPYTQKPALYQTDPSGTFSAWKANATGRNSNSMREFLEKNYKETSGKETIKLAIKALLEVVESGGKNIEIAVMTHKDGLRELEEAEIDEYVAEIEAEKAAAEAAKKGAPKEN

SEQ ID NO: 8677 - protein, 249 aa, Saccharum officinarum
MARYDRAITVFSPDGHLFQVEYALEAVRKGNAAVGVRGTDTVVLGVEKKSTPKLQDSRSVRKIACLDTHIALACAGLKADARVLINRARVECQSHRLTVEDPVTVEYITRYIAGLQQKYTQSGGVRPFGLSTLIVGFDPYTDKPALYQTDPSGTFSAWKANATGRNSNSMREFLEKNYKETSGKETIKLAIRALLEVVESGGKNIEVAVMTKKDGLQELEEALIDEYVAEIEAEKAAAEAAKKGAPKDT

SEQ ID NO: 8678 - protein, 249 aa, Panicum virgatum
MARYDRAITVFSPDGHLFQVEYALEAVRKGNAAVGVRGVDTVVLGVEKKSTPKLQDSRSVRKIASLDTHIALACAGLKADARVLINRARIECQSHRLTVEDPVTVEYITRFIAGLQQKYTQSGGVRPFGLSTLIVGFDPYTNKPALYQTDPSGTFSAWKANATGRNSNSMREFLEKNYKETSGKETIKLAIRALLEVVESGGKNIEVAVMTHKDGLRELEEAEIDEYVAEIEAEKAAAEAAKKGAPKET

SEQ ID NO: 8679 - protein, 284 aa, Eutrema halophilum
FFGLSLKLDSSLYYFFSLGKGKQKYHRTKENGVRDGHYGRAITVFSPDGHLFQVEYALEAVRKGNAAVGVRGTDTVVLAVEKKSTPKLQDSRSARKIVSLDNHIALACAGLKADARVLINKARIECQSHRLTLEDPVTVEYITRYIAGLQQKYTQSGGVRPFGLSTLIVGFDPYSHVPSLYQTDPSGTFSAWKANATGRNSNSIREFLEKNYKESSGQETVKLAIRALLEVVESGGKNIEVAVMTREESGLRQLEEAEIDAIVAEIEAEKAAAEAAKKGPPKET

SEQ ID NO: 8680 - protein, 250 aa, Eutrema parvulum
MARYDRAITVFSPDGHLFQVEYALEAVRKGNAAVGVRGTDTVVLAVEKKSTPKLQDTRSARKIVSLDNHIALACAGLKADARVLINKARIECQSHRLTLEDPVTVEYVTRYIAGLQQKYTQSGGVRPFGLSTLIVGFDPYTRIPSLYQTDPSGTFSAWKANATGRNSNSIREFLEKNYKETSGQETVKLAIRALLEVVESGGKNIEVALMTREEGGLRQLEEAEIDAIVAEIEAEKAAAEAAKKGPSKET

SEQ ID NO: 8681 - protein, 250 aa, Triphysaria pusilla
MARYDRAITVFSPDGHLFQVEYALEAVRKGNAAVGVRGTDTIVLAVEKKSTPKLQDSRSARKIVNLDNHIALACAGLKADARVLINRARIECQSHKLTVEDPVTVEYITRYIAGLQQKYTQSGGVRPFGLSTLIVGFDPHTGIPSLYQTDPSGTFSAWKANATGRNSNSIREFLEKNYTETSGQETVKLAIRALLEVVESGGKNIEVAVMTKEHGLRQLEEAEIDAIVAELEAEKAAAEAAKKAPSSRES

SEQ ID NO: 8682 - protein, 194 aa, Avena sativa
MARYDRAITVFSPTATSSRSSTPSRPSARATPPSASAAPTPSSSASRRSPPPSSRTPGRCGRSRAWTRTSRWRARGSRRTRGCSSTAPASSARATASPSRTPSPSSTSHATSPACSRSTPRAAGSAPSASPPSSSASIRTRTSPRSTRPTPPAPSPPGRPTPRGGTPTPCGSSSRRTTRTHPARRPSSSQSALF

SEQ ID NO: 8683 - protein, 204 aa, Fraxinus spp
MARYDRAITVFSPDGHLFQVEYALEAVRKGNAAVGVRGTDTIVLAVEKKSTPKLQDSRSVRKIVNLDNHIALACAGLKADARVLINRARIECQSHKLTVEDPVTVEYITRYIAGLQQKYTQSGGVRPFGLSTLIIGFDPYTSVPSLYQTDPSGTFSAWKANATGRNSNSIREFLEKNYKETSGQETVKLAMRAYLKLLRVVERT

SEQ ID NO: 8684 - protein, 71 aa, Chenopodium quinoa
QLNNKHNNRRDTTEPLQSSHLTVISFRSNTLLKPSVRVTLPSVFVVPILLFLGLRRNLLLNFRIPGRSEKL

SEQ ID NO: 8685 - protein, 249 aa, Echinochloa colona
MARYDRAITVFSPDGHLFQVEYALEAVRKGNAAVGVRGVDTVVLGVEKKSTPKLQDSRSVRKIASLDTHIALACAGLKADARVLINRARVECQSHRLTVEDPVTVEYITRYIAGLQQKYTQSGGVRPFGLSTLIVGFDPYTQKPALYQTDPSGTFSAWKANATGRNSNSMREFLEKNYKETSGKETIKLAIKALLEVVESGGKNIEIAVMTHKDGLRELEEAEIDEYVAEIEAEKAAAEAAKKGAQKET

SEQ ID NO: 8686 - protein, 249 aa, Ananas comosus
MARYDRAITVFSPDGHLFQVEYALEAVRKGNAAVGVRGSDTIVLGVEKKSTPKLQDSRTVRKIVSLDTHIALACAGLKADARVLINRARIECQSHRLTVEDPASVEYITRYIAGLQQKYTQSGGVRPFGLSTLIVGFDPYTAVPALYQTDPSGTFSAWKANATGRNSNSMREFLEKNYKETSGRDTIKLAIRALLEVVESGGKNIEIAVMTRDEGLKQLEEAEIDEYVAEIEAEKAAAEAAKKAPPRET

SEQ ID NO: 8687 - protein, 250 aa, Antirrhinum majus
MARYDRAITVFSPDGHLFQVEYALEAVRKGNAAVGVRGTDTIVLAVEKKSAPKLQDSRSVRKIVNLDDHIALACAGLKADARVLINRARIECQSHKLTVEDPVTVEYITRYIAGLQQKYTQSGGVRPFGLSTLIIGFDPHTGTPSLYQTDPSGTFSAWKANATGRNSNSIREFLEKNYKETSGQETVKLAIRALLEVVESGGKNIEVAVMTKEHGLRQLEESEIDAIAADIEAEKAAAEAAKKAPSTKET

SEQ ID NO: 8688 - protein, 251 aa, Arabidopsis lyrata
MARYDRAITVFSPDGHLFQVEYALEAVRKGNAAVGVRGTDTVVLAVEKKSTPKLQDSRSARKIVSLDNHIALACAGLKADARVLINKARIECQSHRLTLEDPVTVEYITRYIAGLQQKYTQSGGVRPFGLSTLIVGFDPYTRIPALYQTDPSGTFSAWKANATGRNSNSIREFLEKNYKESSGQETVKLAIRALLEVVESGGKNIEVAVMTREEEGVLKQLEEEEIDIIVAEIEAEKAAAEAAKKGPAKET

SEQ ID NO: 8689 - protein, 250 aa, Arabidopsis thaliana
MARYDRAITVFSPDGHLFQVEYALEAVRKGNAAVGVRGTDTVVLAVEKKSTPKLQDSRSARKIVSLDNHIALACAGLKADARVLINKARIECQSHRLTLEDPVTVEYITRYIAGLQQKYTQSGGVRPFGLSTLIVGFDPYTRIPALYQTDPSGTFSAWKANATGRNSNSIREFLEKNYKESAGQETVKLAIRALLEVVESGGKNIEVAVMTREEGVLKQLEEEEIDIIVAEIEAEKAAAEAAKKGPAKET

SEQ ID NO: 8690 - protein, 137 aa, Brassica juncea
MARYDRAITVFSPDGHLFQVEYALEAVRKGNAAVGVRGTDTVVLAVEKKSTPKLQDTRSARKIVSLDNHVALACAGLKADARVLINKARIECQSHRLTLEDPVTVEYITRYIAGLQQKYTQSGGVRPFGLSTLIVGF

SEQ ID NO: 8691 - protein, 250 aa, Brassica napus
  Sequence also found in Organisms: Brassica rapa
MARYDRAITVFSPDGHLFQVEYALEAVRKGNAAVGVRGTDTVVLAVEKKSTPKLQDTRSARKIVSLDNHIALACAGLKADARVLINKARIECQSHRLTLEDPVTVEYITRYIAGLQQKYTQSGGVRPFGLSTLIVGFDPYTRIPALYQTDPSGTFSAWKANATGRNSNSIREFLEKNYKETSGQETVKLAIRALLEVVESGGKNIEVALMTREEGTLKQLEEAEIDAIVAEIEAEKAAAEAAKKAPSRET

SEQ ID NO: 8692 - protein, 92 aa, Brassica rapa
MWLSRLTIFLADLVSWSLGVDFFSTARTTVSVPRTPTAALPFRTASRAYSTWNRWPSGENTVIARSYLAISPFVLSDSIHLSLPFSSMSIPT

SEQ ID NO: 8693 - protein, 249 aa, Brachypodium distachyon
MARYDRAITVFSPDGHLFQVEYALEAVRKGNAAVGVRGSDTVVLGVEKKSTPKLQDSRSVRKIASLDTHIALACAGLKADARVLINRARVECQSHRLTVEDPVTVEYITRYIAGLQQKYTQSGGVRPFGLSTLIVGFDPYTEKPALYQTDPSGTFSAWKANATGRNSNSMREFLEKNYKETSGKETIKLTIRALLEVVESGGKNIEIAVMTHKDGLRNLEEAEIDEYVAEIEAEKAAAEAAKKSGPRDT

SEQ ID NO: 8694 - protein, 249 aa, Cenchrus ciliaris
MARYDRAITVFSPDGHLFQVEYALEAVRKGNAAVGVRGVDTVVLGVEKKSTPKLQDSRSLRKIASLDTHIALACAGLKADARVLINRARVECQSHRLTVEDPVTVEYITRYIAGLQQKYTQSGGVRPFGLSTLIVGFDPYTQKPALYQTDPSGTFSAWKANATGRNSNSMREFLEKNYKETSGKETIKLAIRALLEVVESGGKNIEVAVMTHQDGLRELEEAEIDEYVAEIEAEKAAAEAAKKGAPKET

SEQ ID NO: 8695 - protein, 249 aa, Euonymus alatus
MARYDRAITVFSPDGHLFQVEYALEAVRKGNAAVGVRGTDNVVLGVEKKSAAKLQDSRSVRKIVNLDDHIALACAGLKADARVLINKARIECQSHRLTLEDPVTVEYITRYIAGLQQKYTQSGGVRPFGLSTLIVGFDPYTAVPSLYQTDPSGTFSAWKANATGRNSNSIREFLEKNYKETSGHDTLKLAIRALLEVVESGGKNIEVAVMTKEHGLRQLDEAEIDVVVAEIEAEKAAAEAAKRAPVQGT

SEQ ID NO: 8696 - protein, 237 aa, Flaveria ramosissima
MARYDRAITVFSPDGHLFQVEYALEAVRKGNAAVGVRGTDTIVLGVEKKSTVKLQDSRSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAIRALLEVVESGGKNIEVAVMTKEGLRQLEEAEIDAIVAEIEAEKASC

SEQ ID NO: 8697 - protein, 249 aa, Momordica charantia
MARYDRAITVFSPDGHLFQVEYALEAVRKGNAAVGVRGSDTIVLGVEKKSTPKLQDSRSVRKIVNLDDHIALACAGLKADARVLINRARVECQSHRLTVEDPVTVEYITRYIARLQQKYTQSGGVRPFGLSTLIIGFDPYTGAPSLYQTDPSGTFSSWKANATGRNSNSIREFLEKNYKETSGQETVKLAIRALLEVVESGGKNIEVAVMTKEHGLKQLDEAEIDAIVAEIESEKAAAEAAKKAPPKEP

SEQ ID NO: 8698 - protein, 250 aa, Raphanus sativus
MARYDRAITVFSPDGHLFQVEYALEAVRKGNAAVGVRGTDTVVLAVEKKSTPKLQDTRSARKIVSLDNHVALACAGLKADARVLINKARIECQSHRLTLEDPVTVEYITRYIAGLQQKYTQSGGVRPFGLSTLIVGFDPYTRIPSLYQTDPSGTFSAWKANATGRNSNSIREFLEKNYKETSGQETVKLAIRALLEVVESGGKNIEVALMTREEGTLKQLEEAEIDAIVAEIEAEKAAAEAAKKGTSRET

SEQ ID NO: 8699 - protein, 249 aa, Sorghum bicolor
MARYDRAITVFSPDGHLFQVEYALEAVRKGNAAVGVRGVDTVVLGVEKKSTPKLQDSRSVRKIASLDTHIALACAGLKADARVLINRARVECQSHRLTVEDPVTVEYITRYIAGLQQKYTQSGGVRPFGLSTLIVGFDPYTQKPALYQTDPSGTFSAWKANATGRNSNSMREFLEKNYKETSGKETIKLAIKALLEVVESGGKNIEIAVMTHKDGLRELEEAEIDEYVAEIEAEKAAAEAAKKGAPREN

SEQ ID NO: 8700 - protein, 249 aa, Panicum virgatum
MARYDRAITVFSPDGHLFQVEYALEAVRKGNAAVGVRGVDTVVLGVEKKSTPKLQDSRSVRKIASLDTHIALACAGLKADARVLINRARVECQSHRLTVEDPVTVEYITRFIAGLQQKYTQSGGVRPFGLSTLIVGFDPYTNKPALYQTDPSGTFSAWKANATGRNSNSMREFLEKNYKETSGKETIKLAIRALLEVVESGGKNIEVAVMTHKDGLRELEEAEIDEYVAEIEAEKAAAEAAKKGAPKET

SEQ ID NO: 8701 - protein, 271 aa, Eutrema parvulum
MAFKVLMHCLSEFLQLNLGMYTKDEKAELSVLVDRATGGASIKDGEIELMLHRRTCMDDSRGVEESLEETVCVNGTCSGLTVRGNHYVSINKVGEGGRWRRETGQEIYSPLVMAFTHDNKEKWKAASNSVKGYAMDPLYTFPPNIALITLEELDLGNVLLRLAHLYEAGEDSDYSKLAKVELKKLFSGKIIKEVKEMSLAANQEKANMKEKMRWKVEGEGEQSSSLPLKGGPLDGSALVVELGPMEIRTFLLRFSQKPVKQRRRRKLILGL

SEQ ID NO: 8702 - protein, 249 aa, Triphysaria pusilla
SRYDRAITVFSPDGHLFQVEYALEAVRKGNAAVGVRGTDIIVLAVEKKSAPKLQDSRSVRKIVNLDDHIALACAGLKADARVLINRARIECQSHKLTIEDPVTVEYITRYIAGLQQKYTQSGGVRPFGLSTLIIGFDPHTGTPSLYQTDPSGTFSAWKANATGRNSNSIREFLEKNYKETHGQETVKLAIRALLEVVESGGKNIEVAVMTKKHGLRQLEEAEIDAIAAEIEAEKAAAEAAKKGPSTTDA

SEQ ID NO: 8703 - protein, 250 aa, Triphysaria pusilla
MARYDRAITVFSPDGHLFQVEYALEAVRKGNAAVGVRGTDTIVLAVEKKSTPKLQDSRSARKIVNLDNHIALACAGLKADARVLINRARIECQSHKLTVEDPVTVEYITRYIAGLQQKYTQSGGVRPFGLSTLIVGFDPHTGIPSLYQTDPSGTFSAWKANATGRNSNSIREFLEKNYTDTSGQETVKLAIRALLEVVESGGKNIEVAVMTKEHGLRQLEEAEIDAIVAELEAEKAAAEAAKKAPSSRES

SEQ ID NO: 8704 - protein, 250 aa, Utricularia gibba
MARYDRAITVFSPDGHLFQVEYALEAVRKGNAAVGVRGKDVIVLAVEKKSTPKLQDSRSVRKIVNLDDHIALACAGLKADARVLINRARIECQSYKLTVEDPVTVEYITRYIAGLQQKYTQSGGVRPFGLSTLIIGFDPHTGTPSLYQTDPSGTFSAWKANATGRNSNSIREFLEKNYKETSGQETVKLAIRALMEVVESGGKNIEVAVMTKEEGLRQLEEAEIDAIAAEIEAEKAAAEAARKGRTTTEG

SEQ ID NO: 8705 - protein, 244 aa, Amaranthus tuberculatus
DRAITVFSPDGHLFQVEYAHEAVRKGNAAVGVRGTDTVVLGVEKKSAAKLQDSRSVRKIVNLDNHIALACAGLKADARVLINRARIECQSHKLTLEDPVTVEYITRYIAGLQQKYTQSGGVRPFGLSTLIVGFDPYTNVPALYQTDPSGTFSAGKANATGRNSNSIREFLEKNYKETSGQETIKLAIRALLEVVESGGKNLEVAVMTKEGLRQLEEAEIDAIVAEIEAEKAAAEAAKKAPAKDT

SEQ ID NO: 8706 - protein, 250 aa, Brassica napus
  Sequence also found in Organisms: Brassica oleracea
MARYDRAITVFSPDGHLFQVEYALEAVRKGNAAVGVRGADTVVLAVEKKSTPKLQDTRSARKIVSLDNHIALACAGLKADARVLINKARIECQSHRLTLEDPVTVEYITRYIAGLQQKYTQSGGVRPFGLSTLIVGFDPYTRIPALYQTDPSGTFSAWKANATGRNSNSIREFLEKNYKETSGQETVKLAIRALLEVVESGGKNIEVALMTREEGTLKQLEEAEIDAIVAEIEAEKAAAEAAKKAPSRET

SEQ ID NO: 8707 - protein, 250 aa, Triphysaria pusilla
MARYDRAITVFSPDGHLFQVEYALEAVRKGNAAVGVRGADTIVLAVEKKSTPKLQDSRSARKIVNLDNHIALACAGLKADARVLINRARIECQSHKLTVEDPVTVEYITRYIAGLQQKYTQSGGVRPFGLSTLIVGFDPHTGIPSLYQTDPSGTFSAWKANATGRNSNSIREFLEKNYTDTSGQETVKLAIRALLEVVESGGKNIEVAVMTKEHGLRQLEEAEIDAIVAELEAEKAAAEAAKKAPSSRES

SEQ ID NO: 8708 - protein, 249 aa, Tripterygium wilfordii
MARYDRAITVFSPDGHLFQVEYALEAVRKGNAAVGVRGIDNIVLGVEKKSAAKLQDSRSVRKIVNLDDHIALACAGLKADARVLINKARIECQSHRLTVEDPVTVEYVTRYIAGLQQKYTQSGGVRPFGLSTLIVGFDPYTDVPSLYQTDPSGTFSAWKANATGRNSNSIREFLEKNYKETSGHDTLKLAIRALLEVVESGGKNIEVAVMTKEHGLRQLDEAEIDAVVAEIEAEKAAAEAAKRAPVQET

SEQ ID NO: 8709 - protein, 251 aa, Citrullus lanatus
MARYDRAITVFSPDGHLFQVEYALEAVRKGNAAVGVRGSDTIVLGVEKKSTPKLQDSRSVRKIVNLDDHIALACAGLKADARVLINRARVECQSHRLTVEDPVTVEYITRYIAGLQQKYTQSGGVRPFGLSTLIIGFDPYTGSPSLYQTDPSGTFSSWKANATGRNSNSIREFLEKNYKETSGQETVKLAIRALLEVVESGGKNIEVAVMTKEHGLKQLDEAEIDAIVAEIEVEKAAAEAAKKAPAPPKET

SEQ ID NO: 8710 - protein, 196 aa, Chrysanthemum coronarium
TVFSPDGHLFQVEYALEAVRKGNAAVGVRGTDIVVLGVEKKSTVKLQDSRSVRKIVNLDDHIALACAGLKADARVLINKARIECQSHKLTVEDPVTVEYITRYIAGLQQKYTQSGGVRPFGLSTLIVGFDPYTNVPSLYQTDPSGTFSAWKANATGRNSNSMRNFWRKIIRRLLVKKLSNLPSELCLKLLRVEGRT

SEQ ID NO: 8711 - protein, 253 aa, Cucumis melo
MARYDRAITVFSPDGHLFQVEYALEAVRKGNAAVGVRGSDTIVLGVEKKSTPKLQDSRSVRKIVNLDDHIALACAGLKADARVLINRARVECQSHRLTVEDPVTVEYITRYIAGLQQKYTQSGGVRPFGLSTLIIGFDPYTGTPSLYQTDPSGTFSSWKANATGRNSNSIREFLEKNYKETSGQETVKLAIRALLEVVESGGKNIEVAVMTKEHGLKQLDEAEIDAIVAEIEAEKAAAEAAKKAPAPAPPKET

SEQ ID NO: 8712 - protein, 250 aa, Plantago ovata
MARYDRAITVFSPDGHLFQVEYALEAVRKGNAAVGVRGTDTIVLAVEKKSAPKLQDSRSVRKIVNLDDHIALACAGLKADARVLINRARIECQSHKLTIEDPVTVEYITRYIAGLQQKYTQSGGVRPFGLSTLIIGFDPHTGTPSLYQTDPSGTFSAWKANATGRNSNSIREFLEKNYTETSGQETLKLAIRALLEVVESGGKNIEVAVMTKEHGLRQLEESEIDAIVAEIEAEKAAAEAAKKAPSTRET

SEQ ID NO: 8713 - protein, 243 aa, Raphanus sativus
MARYDRAITVFSPDGHLFQVEYALEAVRKGNAAVGVRGTDTVVLAVEKKSTPKLQDTRSARKIVSLDNHVALACAGLKADARVLINKARIECQSHRLTLEDPVTVEYITRYIAGLQQKYTQSGGVRPFGLSTLIVGFDPYTRIPSLYQTDPSGTFSAWKANATGRNSNSIREFLEKNYKETSGQETVKLAIRALLEVVESGGKNIEVALMTREEGTLKQLEEAEIDAIVAEIEAEKAAAEAAK

SEQ ID NO: 8714 - protein, 65 aa, Fraxinus spp
ARYDRAITVFSPDGHLLQVEYALEAVRKGTPPSVFEAPIPSSLPSRRIHPQAPGLQIGEKDCQFR

SEQ ID NO: 8715 - protein, 194 aa, Olea europaea
MARYDRAITVFSPDGHLFQVEYALEAVRKGNAAVGVRGTDTIVLAVEKKSTPKLQDSRSVRKIVNLDNHIALACAGLKADARVLINRARIECQSHKLTVEDPVTVEYITRYIAGLQQKYTQSGGVRPFGLSTLIIGFDPYTSVPSLYQTDPSGTFSAWKANATGRNSNSIREFLEKNYKEMWPGDYQTSHAGFT

SEQ ID NO: 8716 - protein, 261 aa, Fagus grandifolia
MARYDRAITVFSPDGHLFQVEYALEAVRKGNAAVGVRGLDNVVLGVEKKSTPKLQDSRSVKKIVSLDDHVALACAGLKADARVLINRARIECQSHRLTVEDPVTVEYITRYIAGLQQKYTQSGGVRPFGLSTLIAGFDPYTGVPSLYQTDPSGTFQAWKANATGRNSNSMREFLEKNYKETSGQETVKLAIRALLEVVESGGKNIEIAVMTKEHGLHQLEEAEIDTIVADIEAEKAAAEAAKKAPAKEPSSVALSYFTRTF

SEQ ID NO: 8717 - protein, 233 aa, Helianthus annuus
MARYDRAITVFSPDGHLFQVEYALEAVRKGNAAVGVRGTDSVVLGVEKKSTVKLQDSRSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAIRALLEVVESGGKNIEVAVMTKEGLRQLEEAEIDTVVAEIEAE

SEQ ID NO: 8718 - protein, 250 aa, Mimulus guttatus
MARYDRAITVFSPDGHLFQVEYALEAVRKGNAAVGVRGTDTIVLAVEKKSAPKLQDSRSVRKIVNLDNHIALACAGLKADARVLINKARIECQSHKLTIEDPVTVEYITRYIAGLQQKYTQSGGVRPFGLSTLIIGFDPHTGTPSLYQTDPSGTFSAWKANATGRNSNSIREFLEKNYKETHGQETLKLAIRALLEVVESGGKNIEVGVMTKEHGLKQLEESEIDAVVAEIEAEKAAAEAAKKAPSTKET

SEQ ID NO: 8719 - protein, 232 aa, Gerbera hybrid cultivar
MARYDRAITVFSPDGHLFQVEYALEAVRKGNAAVGVRGTDTIVLGVEKKSTVKLQDSRSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAIRALLEVVESGGKNIEVAVMTKEGLRQLEEAEIDAIVAGIEA

SEQ ID NO: 8720 - protein, 232 aa, Cichorium intybus
MARYDRAITVFSPDGHLFQVEYALEAVRKGNAAVGVRGTDNIVLGVEKKSTVKLQDSRSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETIKLAIRALLEVVESGGKNIEVAVMTKEGLKQLEEGEIDAIVAEIEA

SEQ ID NO: 8721 - protein, 239 aa, Linum usitatissimum
FSPDGHLFQVEYALEAVRKGNAAVGVRGTDTVVLGVEKKSAVKLQDSRSVRKIVNLDNHIALACAGLKADARVLINKARIECQSHRLTVEDPVTVEYITRYIAGLQQKYTQSGGVRPFGLSTLIIGFDPYTKVPSLYQTDPSGTFSAWKANATGRNSNSIREFLEKNYKETSGQETVKLAIRALLEVVESGGKNIEVAVMTKEHGLKQLEEAEIDAIVAEIEAEKAAAEAAKKAPARDA

SEQ ID NO: 8722 - protein, 237 aa, Papaver somniferum
PDGHLFQVEYALEAVRKGNAAVGVRGTDTVVLGVEKKSTAKLQDSRSVRKIVNLDNHIALACAGLKADARVLINKARIECQSHRLTVEDPVTVEYITRYIAGLQQKYTQSGGVRPFGLSTLIVGFDPHTDVPSLYQTDPSGTFSAWKANATGRNSNSMREFLEKNYKETSGQETVKLAVRALLEVVESGGKNIEIAVMGKDKVLRQLEESEIDIIVAEIEAEKAAAEAAKKPASKNT

SEQ ID NO: 8723 - protein, 243 aa, Primula obconica
RAITVFSPDGHLFQVEYALEAVRKGNAAVAVRGSDTIVLGVEKKSTPKLQDSRSVRKIVNLDNHIALACAGLKADARVLINKARIECQSHRLTLEDPVTVEYITRYIAGLQQKYTQSGGVRPFGLSTLIVGFDPYTNVPSLYQTDPSGTFSAWKANATGRNSNSMREFLEKNYKETSGHETTKLAIRALLEVVESGGKNVEVAVMKKEGLQQLEEEEIDAIVAEIEAEKAAAEAAKKGPSKEN

SEQ ID NO: 8724 - protein, 249 aa, Abies balsamea
MARYDRAITVFSPDGHLFQVEYALEAVRKGNAAVGVRGTDNIVLAVERKSTAKLEDSRTVRKIVNLDNHIALACAGLKADARVLINKARIECQSHRLTVEDPVTVEYITRYIAGLQQKYTQSGGVRPFGLSTLIVGFDPYTGAPSLYQTDPSGTFSAWKANATGRNSNSIRDFLEKNYKETAGHETIKLAARALLEVVESKGNNIEIAVMTHDKGLRQLEESEVEAIVAEVEAEKAAAEAAKKAPTPRD

SEQ ID NO: 8725 - protein, 249 aa, Pinus taeda
  Sequence also found in Organisms: Picea glauca
MARYDRAITVFSPDGHLFQVEYALEAVRKGNAAVGVRGTDNIVLAVERKSTAKLEDSRTVRKIVNLDNHIALACAGLKADARVLINKARIECQSHRLTVEDPVTVEYITRYIAGLQQKYTQSGGVRPFGLSTLIVGFDPYTGAPSLYQTDPSGTFSAWKANATGRNSNSIRDFLEKNYKETAGHETIKLAARALLEVVESKGNNIEIAVMTRDKGLRQLEESEVEAIVAEVEAEKAAAEAAKKAPTPRD

SEQ ID NO: 8726 - protein, 249 aa, Pseudotsuga menziesii
MARYDRAITVFSPDGHLFQVEYALEAVRKGNAAVGVRGTDNIVLAVERKSTAKLEDSRTVRKIVNLDNHIALACAGLKADARVLINKARIECQSHRLTVEDPVTVEYITRYIAGLQQKYTQSGGVRPFGLSTLIVGFDPYTGAPSLYQTDPSGTFSAWKANATGRNSNSIRDFLEKNYKETAGHETIKLAARALLEVVESKGNNIEIAVMTCDKGLRQLEESEVEAIVAEVEAEKAAAEAAKKAPTPRD

SEQ ID NO: 8727 - protein, 249 aa, Ceratodon purpureus
MARYDRAITVFSPDGHLFQVEYALEAVRKGNAAVGVRGTDTIVLGVEKKSTAKLQDARTVRKILKLDEHVSLAFAGLTADARVLVNRARIECQSHRLTVEDPVTVEYITRFIAGLQQKYTQSGGVRPFGISTLIVGFDPYTGVPSLYQTDPSGTFSAWKANATGRNSNSVREFLEKNYTETSGTETVKLAVRALLEVVESGGKNIEIAVMTKNEGLRLLDEAEVEEIVAGIEAEKAAAEAAKKGPPRDQ

SEQ ID NO: 8728 - protein, 249 aa, Medicago truncatula
MSRYDRAITIFSPDGHLFQVKYALEAVRKGNAAVGVRGTDSIVLGVEKKSTAKLQDSRLVRKIVKLDDHIALACAGLKADARVLVTRARVECQSHRLTVGDPCTVEYITHYIAGLQQKYTQSSGVRPFGLSTLIVGFDPYTGSLSLYQTDPSGTFSAWKANATGRNSNSIREFLEKNYKDTSGQETVKLAIRSLLEVVESGGKNIEVAVMTKEYGLCQLEEAEIDAIVAEIEAEKAAAEAAKKVLPKDT

SEQ ID NO: 8729 - protein, 249 aa, Physcomitrella patens
MARYDRAITVFSPDGHLFQVEYALEAVRKGNAAVGVRGTDTIVLGVEKKSTAKLQDARTVRKILKLDEHVSLAFAGLTADARVLVNRARIECQSHRLTVEDPVTVEYITRFIAGLQQKYTQSGGVRPFGISTLIVGFDPYTGVPALYQTDPSGTFSAWKANATGRNSNSVREFLEKNYTETSGAETVKLAVRALLEVVESGGKNIEIAVMTKNEGLRLLDEAEVEEIVAGIEAEKAAVEAAKKGPPRDQ

SEQ ID NO: 8730 - protein, 249 aa, Physcomitrella patens
MARYDRAITVFSPDGHLFQVEYALEAVRKGNAAVGVRGTDTIVLGVEKKSTAKLQDARTVRKILKLDEHVSLAFAGLTADARVLVNRARIECQSHRLTVEDPVTVEYITRFIAGLQQKYTQSGGVRPFGISTLIVGFDPYTGVPSLYQTDPSGTFSAWKANATGRNSNSVREFLEKNYTETSGAETVKLAVRALLEVVESGGKNIEIAVMTKNEGLRLLDEAEVEGIVAAIEAEKAAAEAAKKGPPRDQ

SEQ ID NO: 8731 - protein, 249 aa, Cedrus atlantica
MARYDRAITVFSPDGHLFQVEYALEAVRKGNAAVGVRGTDNIVLAVERKSTAKLEDSRTVRKIVNLDNHIALACAGLKADARVLINKARIECQSHRLTVEDPVTVEYITRYIAGLQQKYTQSGGVRPFGLSTLIVGFDPYTGAPSLYQTDPSGTFSAWKANATGRNSNSIRDFLEKNYKETAGHETIKLAARALLEVVESKGNNIEIAVMTRDKGLRQLEESEVEAIVTEVEAEKAAAEAAKKAPTPRD

SEQ ID NO: 8732 - protein, 250 aa, Distylium racemosum
MARYDRAITVFSPDGHLFQVEYALEAVRKGNAAVGVRGTDNIVLCVERKSTAKLEDSRTVRKIVNLDNHIALACAGLKADARVLINKARIECQSHRLTVEDPVTVEYITRYIAGLQQKYTQSGGVRPFGLSTLIIGFDPYAGSPSLYQTDPSGTFSAWKANATGRNSNSIRDFLEKNYKETSGDETIKLAARALLEVVESKGNNIEIAVMTRDKGLRQLEESEVEAIVAEVEAEKAAAEAAKKSHAPRES

SEQ ID NO: 8733 - protein, 249 aa, Pinus pinaster
MARYDRAITVFSPDGHLFQVEYALEAVRKGNAAVGVRGTDNIVLAVERKSTAKLEDSRTVRKIVNLDNHIALACAGLKADARVLINKARIECQSHRLTVEDPVTVEYITRYIAGLQQKYTQSGGVRPFGLSTLIVGFDPYTGAPSLYQTDPSGTFSAWKANATGRNSNSIRDFLEKNYKETAGHETIKLAARALLEVVESKGNNIEIAVMTRDKGLQQLEESEVEAIVAEVEAEKAAAEAAKKAPTPRD

SEQ ID NO: 8734 - protein, 249 aa, Picea glauca
MARYDRAITVFSPDGHLFQVEYALEAVRKGNAAVGVRGTDNIVLAVERKSTAKLEDSRTVRKIVNLDNHIALACAGLKADARVLINKARIECQSHRLTVEDPVTVEYITRYIAGLQQKYTQSGGVRPFGLSTLIVGFDPYTGAPSLYQTDPSGTFSAWKANATGRNSNSIRDFLEKNYKETAGHETIKLAARALLEVVESKGNNIEIAVMTRDKGLRQLEESEVEAIVAEVESEKAAAEAAKKAPTPRD

SEQ ID NO: 8735 - protein, 249 aa, Capsicum annuum
MARYNRAITVFSLDGHLFQVEYTLEDVRKDIATVGVRGTDTIVLEVEKKSTPRLQDSRSVRKIVNLDDHIALACAGLKADAQILVNWARIECQSHKLTVEDPVTVEYITRYIAGLQQKYTQSGGVRPFGLSTLIIGFDPHTGVPSLYQTDPSGTFSAWKANATGRNSNSIREFLEKNYKETSGQETVKLAIRALLEVVESGGKNIEVALMTKEHGLRQLEEAEIDAVVAEIEAEKAAAEAAKKAQPKET

SEQ ID NO: 8736 - protein, 237 aa, Linum usitatissimum
PDGHLFQVEYALEAVRKGNAAVGVRGTDTVVLGVEKKSAVKLQDSRSVRKIVNLDNHIALACAGLKADARVLINKARIECQSHRLTVEDPVTVEYITRYIAGLQQKYTQSGGVRPFGLSTLIIGFDPYTKVPSLYQTDPSGTFSAWKANATGRNSNSIREFLEKNYKETSGQETVKLAIRALLEVVESGGKNIEVAVMTKEHGLKQLEEAEIDAIVAEIEAEKAAAEAAKKAPARDA

SEQ ID NO: 8737 - protein, 226 aa, Hevea brasiliensis
YDRAITVFSPDGHLFQVEYALEAVRKGNAAVGVRGTDVVVLGVEKKSTAKLQDARTVRKIVSLDDHIALVCAGLKADARVLVNRARIECQSHRLTVEDPVTVEYITRYIAGLQQKYTQSGGVRPFGLSTLIVGFDPYTGVPSLYQTDPSGAFSAWKANATGRNSNSMREFLEKNYKETSGQETVKLAIRALLEVVESGGKNIEIAVMTKEHGLRQLEEAEIDAIVA

SEQ ID NO: 8738 - protein, 249 aa, Physcomitrella patens
MARYDRAITVFSPDGHLFQVEYALEAVRKGNAAVGVRGTDTIVLGVEKKSTAKLQDARTVRKILKLDEHVSLAFAGLTADARVLVNRARIECQSHRLTVEDPVTVEYITRFIAGLQQKYTQSGGVRPFGISTLIVGFDPYTGVPSLYQTDPSGTFSAWKANATGRNSNSVREFLEKNYTETSGAETVKLAVRALLEVVESGGKNIEIAVMTKNEGLRLLDEAEVEEIVSGIEAEKAAAEAAKKGPPRDQ

SEQ ID NO: 8739 - protein, 249 aa, Picea glauca
MARYDRAITVFSPDGHLFQVEYALEAVRKGNAAVGVRGTDNIVLAVERKSTAKLEDSRTVRKIVNLDNHIALACAGLKADARVLINKARIECQSHRLTVEDPVTVEYITRYIAGLQQKYTQSGGVRPFGLSTLIVGFDPYTGAPSLYQTDPSGTFSAWKANATGRNSNSIRDFLEKNYKETAGHETIKLAARALLEVVESKGNNIEIAVMTRDKGLRQLEESDVEAIVAEVEAEKAAAEAAKKAPTHRD

SEQ ID NO: 8740 - protein, 231 aa, Liriodendron tulipifera
MARYDRAITVFSPDGHLFHVEYALDAVRKGNAAVGVRGTDTIVLGVEKKSTAKLQDSRSVRKIVNLDNHIALACAGLKADARVLINKARIECQSHRLTVEDPVTVEYITRYIAGLQQKYTQSGGVRPFGLSTLIVGFDPYTGVPSLYQTDPSGTFSAWKANATGRNSNSMREFLEKNYKETSGQETVKLPIRALLEVVESGGKNIEIAVMTKEGLRQLDESEIDAIVMEIE

SEQ ID NO: 8741 - protein, 249 aa, Gnetum gnemon
MARYDRAITVFSPDGHLFQVEYALEAVRKGNAAVGVRGNDNIVLAVERKSTAKLEDSRTVRKIVNLDNHIALACAGLKADARVLINRARIECQSHRLTVEDPVTVEYITRYIAGLQQKYTQSGGVRPFGLSTLIVGFDPYTGEPALYQTDPSGTFSAWKANATGRNSNSIRDFLEKNYKPTSGDETIKLAARALLEVVESKGNNIEIAVMTRDKGLRQLEESEVEAIIAEVEAEKAAAEAAKKAPAPRE

SEQ ID NO: 8742 - protein, 250 aa, Podocarpus macrophillus
MARYDRAITVFSPDGHLFQVEYALEAVRKGNAAVGVRGTDNIVLCVERKSTAKLEDSRTVRKIVNLDTHIALACAGLKADARVLINKARIECQSHRLTVEDPVTVEYITRFIAGLQQKYTQSGGVRPFGLSTLIIGFDPYSGAPSLYQTDPSGTFSAWKANATGRNSNSIRDFLEKNYKETSGDETIKLAARALLEVVESKGNNIEIAVMTRDKGLRQLEESDVEAIVAEVEAEKAAAEAAKKSHAPRES

SEQ ID NO: 8743 - protein, 228 aa, Glycyrrhiza uralensis
MARYDRAITVFSPDGHLFQVEYALEAVRKGNAAVGVRGTDNVVLGVEKKSTAKLQDSRTVRKIVNLDDHIALACAGLKADARVLINRARVECQSHRLTVEDPVTVEYITRYIAGLQQKYTQSGGVRPFGLSTLIVGFDPYTGSPSLYQTDPSGTFSAWKANATGRNSNSIREFLEKNYKETSGQETVKLAIRALLEVVESGGKNIEVAVMTKEHGLRQLEEAEIDAIV

SEQ ID NO: 8744 - protein, 249 aa, Physcomitrella patens
MARYDRAITVFSPDGHLFQVEYALEAVRKGNAAVGVRGTDTIVLGVEKKSTTKLQDARTVWKILRLDEHVSLAFAGLTADARVLVNRARIECQSHRLTVEDPVTVEYITCFIAGLQQKYTQSGGVRPFGISTLIAGFDPCTGVPALYQTDPSGTFSAWKANATGHNSNSVREFLEKNHTETSGAETVKLAVRALLEVVESGGKNIEIAVMTKNKGLRLLDEAEVEEIVAGIEAEKIAAEAAKKGPPRDQ

SEQ ID NO: 8745 - protein, 250 aa, Cryptomeria japonica
  Sequence also found in Organisms: Sequoia sempervirens
MARYDRAITVFSPDGHLFQVEYALEAVRKGNACVGVRGTDNIVLCVERKSTAKLEDSRTVRKIVNLDNHIALACAGLKADARVLINKARIECQSHRLTVEDPVTVEYITRYIAGLQQKYTQSGGVRPFGLSTLIIGFDPYTSSPSLYQTDPSGTFSAWKANATGRNSNSIRDFLEKNYKECSGDETIKLAAKALLEVVESKGNNIEIAVMTQDKGLRQLEESEVEAIVAEVEAEKAAAEAAKKSHTPRES

SEQ ID NO: 8746 - protein, 250 aa, Taxus baccata
MARYDRAITVFSPDGHLFQVEYALEAVRKGNACVGVRGTDNIVLCVERKSTAKLEDSRTVRKIVNLDNHVALACAGLKADARVLINKARIECQSHRLTVEDPVTVEYITRYIAGLQQKYTQSGGVRPFGLSTLIIGFDPYTSSPSLYQTDPSGTFSAWKANATGRNSNSIRDFLEKNYKECSGGETIKLAAKALLEVVESKGNNIEIAVMTKDKGLQQLEESEVEAVVAEVEAEKAAAEAAKKSHTPRES

SEQ ID NO: 8747 - protein, 266 aa, Cucumis sativus
MARYDRAITVFSPDGHLFQVEYALEAVRKGNAAVGVRGSDTIVLGVEKKSTPKLQDSRSVRKIVNLDDHIALACAGLKADARVLINRARVECQSHRLTVEDPVTVEYITRYIAGLQQKYTQSGGVRPFGLSTLIIGFDPYTGTPSLYQTDPSGTFSSWKANATGRNSNSIREFLEKNYKETSGQETVKLAIRALLEASCYGISLLFACTLLVVESGGKNIEVAVMTKEHGLKQLEEAEIDAIVAEIEAEKAAAEAAKKAPAPPKET

SEQ ID NO: 8748 - protein, 265 aa, Secale cereale
REEQTNPKPPRPAAGGLARYDRAITVFSPDGHLFQVEYALEAVRKGNAAVGVRGTDTVVLGVEKKSTPKLQDSRSVRKIASLDTHVALACAGLKADARVLINRARVECQSHRLTVEDPVTVEYITRYIAGLQQKYTQSGGVRPFGLSTLIVGFDPYTDKPALYQTDPSGTFSAWKANATGRNSNSMREFLEKNYKDTSGKETIKLTIRALLEVVESGGKNIEIAVMTKKDGLRQLEETEIDEYVAEIEAEKAAAEAAKKSGPKDT

SEQ ID NO: 8749 - protein, 250 aa, Cephalotaxus harringtonia
MARYDRAITVFSPDGHLFQVEYALEAVRKGNACVGVRGTDNIVLCVERKSTAKLEDSRTIRKIVNLDDHVALACAGLKADARVLINKARIECQSHRLTVEDPVTVEYITRYIAGLQQKYTQSGGVRPFGLSTLIIGFDPYTNCPSLYQTDPSGTFSAWKANATGRNSNSIRDFLEKNYKECAGDETIKLAAKALLEVVESKGNNIEIAVMTKDKGLQQLEESEVEAVVAEVEAEKAAAEAAKKSHTPRES

SEQ ID NO: 8750 - protein, 237 aa, Avena sativa
MARYDRAITVFSPVGHLFQVEYALEAVRKGNAAVGVRGVDTVVLGVEKKSTPKLQDSRSVRKIASLDTHIALACAGLKADARVLINRARVECQSHRLTVEDPVTVEYITRYIAGLQQKYTQSGGVRPFGLSTLIVGFDPYTDKPALYQTDPSGTFSAWKANATGRNSNSMREFLEKNYKDTSGKETIKLTIRALLEVVESGGKNIEIAVMTKKDGLRQLEETEIDEYVAEIEAERLR

SEQ ID NO: 8751 - protein, 248 aa, Sciadopitys verticillata
MARYDRAITVFSPDGHLFQVEYALEAVRKGNACVGVRGRDNIVLCVERKSTAKLEDSRTVRKIVNLDNHIALACAGLKADARVLINKARIECQSHRLTVEDPVTVEYITRYIAGLQQKYTQSGGVRPFGLSTLIIGFDPYTGAPSLYQTDPSGTFSAWKANATGRNSNSIRDFLEKNYKETSGVETIKLAARALLEVVESKGNNIEIAVMTQEKGLRQLEESEVESIVAEVEAEKAAAEAAKKSHTAI

SEQ ID NO: 8752 - protein, 186 aa, Guizotia abyssinica
MARYDRAITVFSPDGHLFQVEDALEAVRKGNAAVGVRGTDTIVLGVEKKSTVKLQDSRSVRKIVSLDDHIALACAGLKADARVLINRARIECQSHRLTVEDPVTVEYITRYIAGLQQKYTQSGGVRPFGLSTLIVGFDPYTGVPSLYQTDPSGTFSAWKANATGRNSNSMREFLEKNTRRPLGKKL

SEQ ID NO: 8753 - protein, 175 aa, Thalictrum flavum
VEYALEAVRKGNAAVGVRGTDTIVLGVEKKSTAKLQDSRSVRKIVNLDNHIALACAGLKADARVLINKARIECQSHRLTVEDPVTVEYITRYIAGLQQKYTQSGGVRPFGLSTLIVGFDPYTGVPSLYQTDPSGTFSAWKANATGRNSNSMREYLEKNYKETSGQELLSWRSVLA

SEQ ID NO: 8754 - protein, 257 aa, Cucurbita pepo
MARYDRAITVFSPDGHLFQVEYALEAVRKGNAAVGVRGSDTVVLGVEKKSTPKLQDSRSVRKIVNLDDHIALACAGLKADARVLINRARVECQSHRLTVEDPVTVEYITRYIAGLQQKYTQSGGVRPFGLSTLIIGFDPYTGTPSLYQTDPSGTFSSWKANATGRNSNSIREFLEKNYKETSGQETVKLAIRALLEVVESGGKNIEVAVMTKEHGLKQLEEAEIDAIVAEIEAEKQRQRLPRSPGRRKHDHFSCSTH

SEQ ID NO: 8755 - protein, 78 aa, Chrysanthemum coronarium
MREFLEKNYKETSGQETIKLTIRALLEVVESGGKNIEVAVMTKEGLRQLDEAEIDTIVAEIEAEKAAAEAAKKGPAKE

SEQ ID NO: 8756 - protein, 80 aa, Phalaenopsis aphrodite
MREFLEKNFKETSGQETVKLAIRALLEVVESGGKNIEVAVMAKEHGLRRLEESEIDAIVVELDAEKAASEAAKRAPSWER

SEQ ID NO: 8757 - protein, 230 aa, Echinochloa colona
VEYALEAVRKGNAAVGVRGTDTVVLGVEKKSTPKLQDSRSVRKIASLDTHIALACAGLKADARVLINRARVECQSHRLTVEDPVTVEYITRYIAGLQQKYTQSGGVRPFGLSTLIVGFDPYTDKPALYQTDPSGTFSAWKANATGRNSNSMREFLEKNYKETSGKETIKLAIRALLEVVESGGKNIEVAVMTKKDGLRELEEAEIDEYVAEIEAEKAAAEAAKKGASKDT

SEQ ID NO: 8758 - protein, 278 aa, Sarracenia psittacina
MARYDRAITVFSPDGHLFQVEYALEAVRKGNAAVGVRGSDTVVLGVEKKSTAKLQDSRSVRKIVSLDDHIALACAGLKADARVLINKARIECQSHRLTVEDPVTVEYITRYIAGLQQKYTQSGGVRPFGLSTLIVGFDPYTSVPSLYQTDPSGTFSAWKANATGRNSNSMREFLEKNYKETSGRETIKLAIRALLEVVDSGGKNIEVGVMTKEHGLRQLDEAEIDAIVAEIEAEKAAAEAAKKGPPRKHKTYFALFSFTEVLYSILIISRLDEAKFWY

SEQ ID NO: 8759 - protein, 257 aa, Selaginella moellendorffii
ILGFLSKMSSGRYDRAITVFSPDGHLFQVEYAQEAVRKGNAAVGVRGTDTIVLGVEKKSTAKLQDARTVHKILSLDEHVALAFAGLTADARVLVNRARVECQSHRLTVEDPVTVEYITRYIAGLQQKYTQSGGVRPFGISTLIIGFDPHTGAPSLYQTDPSGTFSAWKANATGRNSNSVREYLEKNYTETSGMDTVKLAVRALLEVVESGGKNIEIAVMTRQGLKLLEEPEIEEIVNGIEAEKAAAEAAKKGPPRDS

SEQ ID NO: 8760 - protein, 359 aa, Solanum phureja
MSCSSSLILPSISSNGFRRFSPLKLDKSRVFMSSISVGSRIAAVDDALFTDYKPTNAFLFPGQGAQAVGMGAEAQKVPAAAELYKRANEIMGFDLLDICINGPKEKLDSTVLSQPAIYVTSLAAVEILRAREGGQQIIDSVDVTCGLSLGEYTALAFTGAFSFEDGLKLVKLRGEAMQDAADAAKSAMVSIIGLDSEKVQKLCDAANEEVDEANKVQIANFLCPGNYAVSGGVKGIEAVEAKAKSFKARMTVRLAVAGAFHTSFMNPAVSRLEAALGATEIRTPRIPVISNVDAQPHADPDTIKKILASQVTSPVQWETTMKTLLSKGLKKSYELGPGKVIAGIVKRMDRGAEIENIGA

SEQ ID NO: 8761 - protein, 359 aa, Solanum lycopersicum
MSCSSSLILPSISSNGFRRFSPLKLDKSRVFMSSISVGSQIAAVDDALFTDYKPTNAFLFPGQGAQAVGMGAEAQKVPAAAELYKRANEIMGFDLLDICINGPKEKLDSTVLSQPAIYVTSLAAVEILRAREGGQQIIDSVDVTCGLSLGEYTALAFTGAFSFEDGLKLVKLRGEAMQDAADAAKSAMVSIIGLDSDKVQKLCDAANEEVDEANKVQIANFLCPGNYAVSGGVKGIEAVEAKAKSFKARMTVRLAVAGAFHTSFMNPAVSRLEAALSATEIRTPRIPVISNVDAQPHADPDTIKKILASQVTSPVQWETTIKTLLTKGLKKSYELGPGKVIAGIVKRMDRGAEIENIGA

SEQ ID NO: 8762 - protein, 362 aa, Solanum melongena
MSCSSSLILPSISSNGFRRFSSKNLDKSRVFMSSISVGSQSAAATAVNDALFADYKPNNAFLFPGQGAQAVGMGAEAQKVPAAAELYKRANEIMGFDLLDICINGPKEKLDSTVLSQPAIYVTSLAAVEILRAREGGQQIIDSVGVTCGLSLGEYTALAFAGAFSFEDGLKLVKLRGEAMQDAADAAKSSMVSIIGLDSDKVQKLCDAANEEVDEANKVQIANFLCPGNYAVSGGVKGIEAVEAKAKSFKARMTVRLAVAGAFHTSFMNPAVSRLEAALGATEIRTPRIPVISNVDAQPHADPDTIKKILASQVTSPVQWETTIKTLLTKGLKKSYELGPGKVIAGIVKRMDRGAEIENIGA

SEQ ID NO: 8763 - protein, 384 aa, Capsicum annuum
MLFSAFTINTTESTCSSTTMSCSSSTLILPSVVTKNGFRRFSSKQQLDKSRVFMTSISVGSRAAASAVVDDALFADYKPTNAFLFPGQGAQAVGMGVEAQKVPAAAELYKRANEIMGFDLLDICINGPKEKLDSTVLSQPAIYVTSLAAVEMLRAREGGQLIIDSVDVTCGLSLGEYTALAFAGAFSFEDGLKLVKLRGEAMQDAADAAKSAMVSIIGLDSDKVQQLCDAANEEVDEANKVQIANFLCPGNYAVSGGVKGIEAVEAKAKSFKARMTVRLAVAGAFHTSFMNPAVSRLETALGATEIRTPRIPVISNVDAQPHADPDTIKKILASQVTSPVQWETTIKTLLTKGLKKSYELGPGKVIAGIVKRMDRGAEIENIGA

SEQ ID NO: 8764 - protein, 374 aa, Nicotiana benthamiana
MSSSSSLLLPSISLHNRAPLPLSSSNCFVSSNDTRRFSPIHLDKSRVFMSVSVGSRTAVDDALFADYKPTNAFLFPGQGAQSVGMGAEAQKVPAAAELYKRANEIMGFDLLDICINGPKEKLDSTVLSQPAIYVTSLAAVEILRAREGGQQVIDSVDVTCGLSLGEYTALAFAGAFSFEDGLKLVKLRGEAMQDAADAAKSAMVSIIGLDSEKVQKLCDAANEEVDEANKVQIANFLCTGNYAVSGGLKGVEVVEAKAKSFKARMTVRLAVAGAFHTSFMNPAVSRLEAALGATEIRTPRIPVISNVDAQPHADPDTIKKILARQVTSPVQWETTVKTLLTKGLKKSYELGPGKVIAGIMKRMDKGAVIENIGA

SEQ ID NO: 8765 - protein, 374 aa, Nicotiana benthamiana
MSSSSSLLLPSISLNNRDPLSLSRSNCFVSGNGIRRFSPIQLDKSRVFMSVSVGSRTAVDDALFADYKPTNAFLFPGQGAQSVGMGAEAQKVPAAAELYKRANEIMGFDLLDICINGPKEKLDSTVLSQPAIYVTSLAAVEILRAREGGQQIIDTVDVTCGLSLGEYTALAFAGAFSFEDGLKLVKLRGEAMQDAADAAKSAMVSIIGLDSEKVQKLCDAANEEVDEANRVQIANFLCTGNYAVSGGLKGVEVVEAKAKSFKARMTVRLAVAGAFHTSFMNPAVSRLEDALGATEIRTPRIPVISNVDAQPHADPDTINKILARQVTSPVQWETTVKTLLTKGLKKSYELGPGKVIAGIVKRMDKGAVIENIGA

SEQ ID NO: 8766 - protein, 364 aa, Plantago ovata
KNSAAVGSSFRSYNGLGFRNDVRRISPWNVEKSRVLMSVAVGSQATTAVEDTLFKDYKPSSVFLFPGQGAQAVGMGVEAQKVPAAAELYKRANDILGFDLLDICINGPKEKLDSTVLSQPAIYVTSLAAVEVLRARDGGQQIIDSVDVTCGLSLGEYTALAFAGAFSFEDGLKLVKLRGEAMQDAADAAKSAMVSIIGLDSAKVQLLCDAANEEVDEADRVQIANFLCTGNYAVSGGLKGIEAVEAKAKSFKARMTVRLAVAGAFHTSFMEPAVSRLEAALASTELRVPRIPVISNVDAEPHANPDTIKKILARQVTSPVQWETTVKTLLSRGLKKSYELGPGKVIAGIVKRMDKGAEIENIGA

SEQ ID NO: 8767 - protein, 370 aa, Mimulus guttatus
MASSIVLPSISLATKSLRSSSCLGYKNEIRMAPRLNLEKSRVFMSVAVGSEAVVVDDALFKDYTPSSAFLFPGQGAQTVGMGVEAQKVPAAAELYKRANDILGFDLLDICVNGPKEKLDSTVLSQPAIYVTSLAAVEVLRARDGGQQIIDSVDVTCGLSLGEYTALAFAEAFSFEDGLKLVKLRGEAMQDAANAAKSAMVSIIGLDSAKVQLLCDAANEEVDEANKVQIANFLCTGNYAVSGGLKGIEAVEAKAKSFKARMTVRLAVAGAFHTGFMEPAVSRLEAVLASTVIRPPRIPVISNVDAQPHADPDTIKKILARQVTSPVQWETTVKTLLSKGLKKSYELGPGKVIAGIVKRMDKSAEIENIGA

SEQ ID NO: 8768 - protein, 384 aa, Theobroma cacao
MHTLLHLRLASSANSHYSLFAMSAASLALPSSLSSLRANGAAPPRCFRLHNPSRSRVFMSVSVGSQAVVDDALFADYKPTSAFLFPGQGAQAVGMGKEAQSVPAAAELYKKANDILGFDLLDVCINGPKEKLDSTVISQPAIYVTSLAAVELLRTRDGGQQIIDSVDVTCGLSLGEYTALAFAGAFSFEEGLKLVKLRGEAMQEAADAAKSAMVSVIGLDSEKVQQLCDAANQEVDEADKVQIANYLCPGNYAVSGGVKGVEAVEAKAKSFKARMTVRLAVAGAFHTSFMDPAVSRLEAALAATQVRTPRIPVISNVDAQPHADSETIKNILARQVTSPVQWETTVKTLLTKGLKKSYELGPGKVIAGIVKRMDKGAEIENIGA

SEQ ID NO: 8769 - protein, 383 aa, Gossypium raimondii
MHSLRLASSAHSQSLFTMSAASASLALPSPLSSFRSNGPLPSRCFLRLNNPSRSRVFMSVSVGSQTVVDDALFADYKPTSAFLFPGQGAQAVGMGKEAQAVPAAAELYKKANNILGFDLLDLCINGPKEKLDSTVISQPAIYVTSLAAVELLRARDGGPQIIDSVDVTCGLSLGEYTALAFAGAFSFEDGLKLVKLRGEAMQEAADAAKSAMVSIIGLDSEKVQQLCDAANQEVDVADKVQIANYLCPGNYAVSGGLKGVEAVEAKAKSFKARMTVRLAVAGAFHTSFMDPAVSRLEAALAATQIRTPRIPVISNVDVQPHADPETIKKILARQVTSPVQWETTVKTLLTKGLKKSYELGPGKVIAGIVKRMDKSAEIENIGA

SEQ ID NO: 8770 - protein, 417 aa, Catharanthus roseus
MHVFFHRPFIGFRFNPTISSASFCSCSFSQSNSIFTNTMSASSLVLPSSISVNKKKLAFGSSESFKLCNSLGFKNGIRGFSLKNLDKSRVFMSIAVGSQTTVDDALFNDYKPTCAFLFPGQGAQAVGMGAEAQKVPAAAELYKKANEILGFDLLDICLNGPKEKLDSTVLSQPAIYVTSLAAVEVLRASEGGQQIIDSVDVTCGLSLGEYTALAFSGAFSFEDGLKLVKLRGEAMQDASDAAQSAMVSVIGLDSEKVQQLCDAANEEVDEANKVQIANFLCPGNYAVSGGVKGVEAVEAKAKSFKARMTVRLAVAGAFHTRFMEPAVSSLEAALAATEIRTPRIPVISNVDAQPHADPDTIKKILARQVTSPVQWETTVKTLLTKGVKKSYELGPGKVIAGIVKRMDKSAVLENIVA

SEQ ID NO: 8771 - protein, 383 aa, Gossypium hirsutum
MHSLRLASSAHSQSLFTMSAASASLALPSPLSSFRSNGPLPSRCFLRLNNPSRSRVFMSVSVGSQTVVDDALFADYKPTSAFLFPGQGAQAVGMGKEAQAVPAAAELYKKANNILGFDLLDLCINGPKEKLDSTVISQPAIYVTSLAAVELLRARDGGPQIIDSVDVTCGLSLGEYTALAFAGAFSFEDGLKLVKLRGEAMQEAADAAKSAMVSIIGLDSEKVQQLCDAANQEVDVADKVQIANYLCPGNYAVSGGLKGVEAVEAKAKSFKARMTVRLAVAGAFHTSFMDPAVSRLEAALAATQIRTPRIPVISNVDAQPHADPETIKKILARQATSPVQWETTVKTLLTKGMKKSYELGPGKVIAGIVKRMDKSAEIENIGA

SEQ ID NO: 8772 - protein, 408 aa, Sesamum indicum
MHALVLHHNHRLPLYLVRFNLPSAKSSSLSRAMSSSVVLPSISLTKPALGSSESFRSSTCLGFKNEIRRVSRLGLGKSRVFMSVAVGSEAVVVDDALFKDYKPSSAFLFPGQGAQAVGMGVEAQKVPAAAELYKRANDILGFDLLDICINGPKEKLDSTVLSQPAIYVTSLAAVEVLRARDGGQQIIDSVDVTCGLSLGEYTALAFAGAFSFEDGLKLVKLRGEAMQDAADAAKSAMVSIIGLDSAKVQQLCDAANEEVDEANKVQIANFLCPGNYAVSGGLKGIEAVEAKAKSFKARMTVRLAVAGAFHTGFMEPAVSRLEAALASTVIRSPRIPVISNVDAEPHADPNTIKKILARQVTSPVQWETTVKTLLNRGLKKSYELGPGKVIAGIVKRMDKGADIENICA

SEQ ID NO: 8773 - protein, 412 aa, Panax ginseng
MHAFLHSRIIRLNPSTSSFGFLSLSSPSISLSIMSSSLILPSISTQKLTFSDAPESLRSSNYLCFRGFKNGIREFSPRNLDKSRAFMSVSVGSQTAVNDDLFSDYKPTSAFLFPGQGAQAVGMGVEAQKVPAAAELYNKANEILGFDLLDVCINGPKEKLDSTVLSQPAIYVTSLAAVEVLRARDGGQQIIDSVDVTCGLSLGEYTALAFAGAFSFEDGLKLVKLRGQAMQEAADAAKSAMVSVIGLDSEKVQLLCDAANEEVDEANKVKIANFLCPGNYAVSGGVKGVEALEAKAKSFKARMTVRLAVAGAFHTSFMDPAVSRLEAALAATEIRIPRIPVISNVDAQPHADPETIKKILARQVTSPVQWETTVKTLLTKGLRKSYELGPGKVIAGIVKRMDRGAEIENISA

SEQ ID NO: 8774 - protein, 368 aa, Vitis vinifera
MASSLLLPSVSPRNLSFSASHSFRGFNLSGFSPRNVGRSRVSMSVSVGSRTCVDDALFADYKPTCAFLFPGQGAQAVGMGSEAQSVPAAADLYKKANDILGFDLLDVCINGPKEKLDSTVLSQPAIYVTSLAAVEVLRARDGGQQIIDSVDVTCGLSLGEYTALAFAGAFSFEDGLKLVKLRGEAMQDAADAAKSAMVSVIGLDSEKVQLLCDAANEEVDEDNKVQIANFLCPGNYAVSGGVKGVEAVEAKAKSFKARMTVRLAVAGAFHTHFMEPAVSRLEATLAATEIRTPRIPVISNVDAQPHADPDTIKKILARQVTSPVLWETTVKTLLTKGLKKSYELGPGKVIAGIFKRMDKTADLENVSA

SEQ ID NO: 8775 - protein, 371 aa, Olea europaea
MASSSLVLPSISLRRSSISTINLGFRNEISRISLKNLDRGGKVFMSVAVGSQATVVDDALFKDYKLSRAFLFPGQGAQAVGMGVEAQNVTAAAELYKRANDILGFDLLDVCINGPKEKLDSTVLSQPAIYVTSLAAVEVLRARDGGQAIIDSVDVTCGLSLGEYTALAFAGAFSFEDGLKLVKLRGEAMQDAADAAESAMVSIIGLDSEKVQQLCDAANQEVDEADKVQIANFLCPGNYAVSGGLKGIEAVEAKAKSFKARMTVRLAVAGAFHTSFMDPAVSRLEAALASTELRTPRIPVISNVDAQPHADPDTIKKILARQVTSPVQWETTVKTLLNKGVEKCYELGPGKVIAGIVKRMDKSADIENIGA

SEQ ID NO: 8776 - protein, 402 aa, Quercus alba
MHSHLHRSLIQRTLSSSSSRFALPPFSNSLSTMASSSLTLPSISLHKQLPFNASSSNSLRIRSLRPRNPDRSRVFMTSVSVGSQALVNDSLFSDYSPTSAFLFPGQGAQAVGMGKEAQNVPAAAELYKKANDILGFDLLDICINGPKEKLDSTVISQPAIYVTSLAAVELFRVRDGGQQIIDSVDVTCGLSLGEYTALAFAGAFSFEDGLKLVKLRGEAMQEAADAAKGAMVSIIGLDSEKVQQLCDAANQEVDEADKVQIANYLCPGNYAVSGGVKGVEALEAKAKSFKARMTVRLAVAGAFHTSFMEPAVSRLEAALAATEIRTPKIPVISNVDAQPHADPDTIKKILARQVTSPVQWETTVKTLLTKGLKKSYELGPGKVIAGIVKRMDKSAVIENVGA

SEQ ID NO: 8777 - protein, 346 aa, Castanea mollissima
NSLQIRSLRPRNPDRSRVFMTGVSVGSQALVNDSLFSGYNPTSAFLFPGQGAQAVGMGKEAQNVPAAAELYKRANDILGFDLLDICINGPKEKLDSTVISQPAIYVTSLAAVELFRVRDGGQQIIDSVDVTCGLSLGEYTALAFAGAFSFEDGLKLVKLRGEAMQEAADAAKSAMVSVIGLDSEKVQQLCDAANQEVDEADKVQIANYLCPGNYAVSGGVKGVEAVEAKAKSFKARMTVRLAVAGAFHTSFMEPAVSRLEAALAATEITTPKIPVISNVDAQPHADPDTIKKILALQVTSPVQWETTVKTLLTKGLKKSYELGPGKVIAGIVKRMDKSAVIENVGA

SEQ ID NO: 8778 - protein, 318 aa, Flaveria ramosissima
GGIKSGFQRLNLEKSRVSMSVSVGSATAVDDALFADYKPTTAFLFPGQGAQVVGMGQEAHKVPAAAELYSKANEILGFDILDVCINGPKEKLDSTVLSQPAIYVTSLAAVEILRARDGGQHIIDSVDVTCGLSLGEYTALAFAGAFSFEDGLKLVKLRGQAMQEAADAAKGAMVSIIGLDSDKVQQLCDAANEEVEEAERVQIANFLCTGNYAVSGGVKGIEAVEAKAKSFKARMTVRLAVAGAFHTRFMNPALSQLESALSATQIKTPRIPVISNVDAQPHADPETIKKNLGSPGYITGPVGNNGQDSFIKRTGKEL

SEQ ID NO: 8779 - protein, 416 aa, Tabernaemontana elegans
MHALFHWPLIGFCFKPTISCARFCSTSLSGSNCIFTNTMSASSLVLPSSISVNNKLAFGPSESFKCCSSLGFKNGIRGFSLKNLDKSRVFMSVAVGSQTTVDDALFKDYKPSCAFLFPGQGAQAVGMGAEAQMVPAAAELYKKANKILGFDLLDICLNGPKDKLDSTVLSQPAIYVTSLAAVEVLRAREGGQQIIDSVDVTCGLSLGEYTALAFAGAFSFEDGLKLVKLRGEAMQDAADAAQSAMVSVIGLDSEKVQQLCDAANEEVDEANKVQIANFLCPGNYAVSGGVKGVEAVEAKAKSFKARMTVRLAVAGAFHTSFMEPAVSRLEAALAATEIITPRIPVISNVDTQPHADPDTIKKILARQVTSPVQWETTVKALLTKGVKKSYELGPGKVIAGIVKRMDKGADLENIVA

SEQ ID NO: 8780 - protein, 386 aa, Arachis hypogaea
MQALLHHSPLIRTSHSSFSAMASSSSLTLPSLSLNNFPSSPSNAHSRTFNLPLLRSRVFMSVASGSQVSVLNDAPFSDYKPSNAFLFPGQGAQAVGMGKEAQNVPAAAVLYKKANEILGYDLLDICINGPKDKLDSTVLSQPAIYVTSLAAVELLRARDGGQQIIDSVDVTCGLSLGEYTALAFAGAFSFEDGLKLVKLRGEAMQDAADAAKSAMVSVIGLDSEKVQQLCDAANQEVPEAEKVQIANYLCPGNYAVSGGLKGVEVLESKAKSFKARMTVRLAVAGAFHTSFMEPAVSRLEAALAATEIRTPRIPVISNVDAQPHADPETIKKILARQVTSPVQWETTVKTLLNKGLKKSYELGPGKVIAGIIKRVDKGADIENIGA

SEQ ID NO: 8781 - protein, 385 aa, Arachis hypogaea
MQALLHHSPLIRTSHSSFPAMASSSLTLPSLSLNNFPSSPSNAHSRTFNLPLLRSRVFMSVASGSQVSVLNDSLFSDYKPSNAFLFPGQGAQAVGMGKEAQNVPAAAVLYKKANEILGYDLLDICINGPKDKLDSTVLSQPAIYVTSLAAVELLRARDGGQQIIDSVDVTCGLSLGEYTALAFAGAFSFEDGLKLVKLRGEAMQDAADAAKSAMVSVIGLDSEKVQQLCDAANQEVPEAEKVQIANYLCPGNYAVSGGLKGVEVLESKAKSFKARMTVRLAVAGAFHTSFMEPAVSRLEAALAATEIRTPRIPVISNVDAQPHADPDTIKKILARQVTSPVQWETTVKTLLNKGLKKSYELGPGKVIAGIIKRVDKGADIENIGA

SEQ ID NO: 8782 - protein, 391 aa, Echinacea purpurea
MLVPHFLRPFSSFNPLSTTMASSSSLLLPSVSLNHHQLKNTSSSVCFGGLKHGFRRLNLDKSRVSMSLSVGSTTAVDDALFADYKPTTAFLFPGQGAQAVGMGQEALKVPAAAELYNQANQILGFDILDVCINGPKEKLDSTVLSQPAIYVTSLAAVEILRARDGGQQIIDSVDVTCGLSLGEYTALAFAGAFSFEDGLKLVKLRGQAMQEAADAAKGAMVSIIGLDSDKVQQLCDAANEEVEEAEKVQIANFLCNGNYAVSGGVKGIEAVEAKAKSFKARMTVRLAVAGAFHTRFMNPALSQLESALSATEIKTPRIPVISNVDAQPHADPETIKKILARQVTSPVQWETTVKTLLSRGLVKSYELGPGKVIAGIVKRMDKTSPIENISA

SEQ ID NO: 8783 - protein, 395 aa, Helianthus annuus
MLVSNSPQFLRHFSSFNLLSTTMASSSSSSLLLPSVSLNHHQLKTSSSVCFGTLKHGFRRINLDKSRVSMSLSAGSTTAIDDALFTDYKPTTAFLFPGQGAQAVGMGQEALKVPAAAELYNKANEILGFDILDVCINGPKEKLDSTVLSQPAIYVTSLAAVEILRARDGGQQIIDSVDVTCGLSLGEYTALAFAGAFSFEDGLKLVKLRGQAMQEAADAAKGAMVSIIGLDSDKVQQLCDAANEEVEEAEKVQIANFLCTGNYAVSGGVKGIEAVEAKAKSFKARMTVRLAVAGAFHTRFMNPALSQLESALSATEIKTPRIPVISNVDAQPHADPETIKKILARQVTSPVQWETTVKTLLSRGLVKSYELGPGKVIAGIVKRMDKTSPIENISA

SEQ ID NO: 8784 - protein, 326 aa, Flaveria ramosissima
MSVSVGSTTAVDDALFADYKPTTAFLFPGQGAQVVGMGQEAHKVPAAAELYNKANEILGFDILDVCINGPKEKLDSTVLSQPAIYVTSLAAVEILRARDGGQQIIDSVDVTCGLSLGEYTALAFAGAFSFEDGLKLVKLRGQAMQEAADAAKGAMVSIIGLDSDKVQQLCDAANEEVEEAERVQIANFLCTGNYAVSGGVKGIEAVEAKAKSFKARMTVRLAVAGAFHTRFMNPALSQLESALSATQIKTPRIPVISNVDAQPHADPETIKKILARQVTSPVQWETTVKTLLSRGLEKSYELGPGKVIAGIVKRMDKTSPIENISA

SEQ ID NO: 8785 - protein, 365 aa, Cucumis sativus
MASSFALPSTISLKKFPLNASSSFRNGFRTASISRSRVLMSASVGSQTLVDDSLFLDYKPTSAFLFPGQGAQAVGMGKESHSVPAAADLFNRANDILGFDLLDVCTNGPKEKLDSTVISQPAIYVTSLAAVELLRARDGGQQIIDSVDVTCGLSLGEYTALAFAGAFSFEDGLRLVKLRGEAMQAAADGAKSAMVSIIGLDSEKVQQLCDAANQEVDEANKVQIANFLCPGNYAVSGGLKGIEAVEAKAKSFKARMTVRLAVAGAFHTSFMEPAVSRLEAALAATEIRTPRIPVISNVDAQPHADPSTIKKILARQVTSPVQWETTVKTLLSKGLKKSYELGPGKVIAGIVKRVDKSAEIENIAA

SEQ ID NO: 8786 - protein, 383 aa, Gossypium hirsutum
MHSLRLASSAHSQSLFTMSAASASLALPSPLSSFRSNGPLPSRCFLRLNNPSRSRVFMSVSVESQTVVNDALFADYKPTSAFLFPGQGAQAVGMGKEAQAVPAAAELYKKANNILGFDLLDLCINGPKEKLDSTVISQPAIYVTSLAAVELLRARDGGPQIIDSVDVTCGLSLGEYTALAFAGAFSFEDGLKLVKLRGEAMQEAADAAKSAMVSIIGLDSEKVQQLCDAANQEVDVADKVQIANYLCPGNYAVSGGLKGVQAVEAKAKSFKARLTVRLAVAGAFHTSFMDPAVSRLEAALAATQIRTPRIPVISNVDVQPHADPETIKKILARQVTSPVQWETTVKTLLTKGLKKSYELGPGKVIAGIVKRMDKSAEIENIGA

SEQ ID NO: 8787 - protein, 362 aa, Castanea mollissima
LHKQLPFNASSSDSSSNSLQIRSLRPRNPDRSRVFMTGVSVGSQALVNDSLFSGYNPTSAFLFPGQGAQAVGMGKEAQNVPAAAELYKRANDILGFDLLDICINGPKEKLDSTVISQPAIYVTSLAAVELFRVRDGGQQIIDSVDVTCGLSLGEYTALAFAGAFSFEDGLKLVKLRGEAMQEAADAAKSAMVSVIGLDSEKVQQLCDAANQEVDEADKVQIANYLCPGNYAVSGGVKGVEAVEAKAKSFKARMTVRLAVAGAFHTSFMEPAVSRLEAALAATEITTPKIPVISNVDAQPHADPDTIKKILALQVTSPVQWETTVKTLLTKGLKKSYELGPGKVIAGIVKRMDKSAVIENVGA

SEQ ID NO: 8788 - protein, 371 aa, Olea europaea
MASSSLALPSVSLRRSSISTRNLGFRNEISRISLKNLDRGGKVFMSVAVGSQATVIDDALFKDYKPSRAFLFPGQGAQAVGMGVEAKNVTAAAELYKRANDILGFDLLDVCINGPKEKLDSTVLSQPAIYVTSLAAVEVLRARDGGQAIIDSVNVTCGLSLGEYTALAFAGAFSFEDGLKLVKLRGEAMQDAADAAESAMVSIIGLDSEKVQQLCDAANQEVDEADKVQIANFLCPGNYAVSGGLKGIEAVEAKAKSFKARMTVRLAVAGAFHTSFMDPAVSRLEAALASTELRTPRIPVISNVDAQPHADPDTIKKILARQVTSPVQWETTVKTLLNKGVEKCYELGPGKVIAGIVKRMDKSADIENIGA

SEQ ID NO: 8789 - protein, 358 aa, Glycine max
MSSSLALPSTPFFANGTRIFALKHSLPRSRVSMSVSAGSQASVHQALFADYKASTSFLFPGQGAQAVGMGKEAQNVPAAAVLFNKANDILGFDLLDICINGPKEKLDSTVISQPAIYVTSLAAIELLRAREGGQQIIDSVDVTCGLSLGEYTALAFAGAFSFEDGLKLVKLRGEAMQDAADAARSAMVSVIGLDSEKVQQLCDAANQEVPEAEKVQIANYLCPGNYAVSGGLKGVEVLESKAKSFKARMTVRLAVAGAFHTSFMEPAVSRLEAALATTEIRTPRIPVISNVNAQPHTDPNTIKKILARQVTSPVQWETTVKTLLTKGLKKSYELGPGKVIAGIVKRMDKGADIENIGA

SEQ ID NO: 8790 - protein, 327 aa, Ananas comosus
MSVSVGSEVSVSHDALFKDCKPTCAFLFPGQGAQTVGMGVEAQSVPAAAELYKKANDILGFDLLDVCTNGPKEKLDSTVISQPAIYVTSLAAVEVLRARDGGQEIIDSVDVTCGLSLGEYTALAFADAFSFEDGLKLVKLRGEAMQDAADAASSAMVSVIGLDSEKVQLLCDAANEEVDEENKVQIANFLCPGNYAVSGGVKGIEAVEAKAKSFKARMTVRLAVAGAFHTSFMEPAVSRLEAALVSTEIRTPKIPVISNVDAQAHSDPGTIKKILARQVTSPVQWELTVKTLLGKGLKKSYELGPGKVIAGILKRMDKGAAIENIGA

SEQ ID NO: 8791 - protein, 344 aa, Flaveria ramosissima
GGLKRGFQRINLEKSRVSMSVSVGSTTAVDDALFADYKPTTAFLFPGQGAQVVGMGQEAHKVPAAAELYNKANEILGFDILDVCINGPKEKLDSTVLSQPAIYVTSLAAVEILRARDGGQQIIDSVDVTCGLSLGEYTALAFAGAFSFEDGLKLVKLRGQAMQEAADAAKGAMVSIIGLDSDKVQQLCDAANEEVEEAERVQIANFLCTGSYAVSGGVKGIEAVEAKAKSFKARMTVRLAVAGAFHTRFMNPALSQLESALSATQIKTPRIPVISNVDAQPHADPETIKKILARQVTSPVQWETTVKTLLSRGLEKSYELGPGKVIAGIVKRMDKTSPIENISA

SEQ ID NO: 8792 - protein, 384 aa, Vigna unguiculata
MQALIHHSHSYSLFLRHASSTSLSAMSSSLILPSAPFLAPSSSNGRATLPLTRSRVSMSSVSTGSQPSVQQTLFADYKPSTSFLFPGQGAQAVGMGKEAQNVPAAALLFSKANDILGFDLLDICINGPKEKLDSTVISQPAIYVTSLAAVELLRAREGGQQIIDSVDVTCGLSLGEYTALAFAGSFSFEDGLKLVKLRGEAMQDAADAAKSAMVSVIGLDSEKVQQLCDAANEEVSEAEKVQIANYLCPGNYAVSGGLKGIEVVESKAKSFKARMIVRLAVAGAFHTSFMEPAVSRLEAALAATEIRTPRIPVISNVNAQPHTDPVTIKKTLARQVTSPVQWETTVKTLLTKGLKKSYELGPGKVISGIVKRMDKGTDIENIGA

SEQ ID NO: 8793 - protein, 415 aa, Amsonia hubrichtii
MLSSTNPLINFRFNPTISTSRFCTTSLSESNYIFTNIMSASSLVLPSSISVNKKLAFGTSESFKCCNSLGFKNGIRGFSLKNLDKSRVFMSVAVGSQTTVNDALFKDYKPSCAFLFPGQGAQAVGMGAEAQKVPAAAELYKKANEILRFDLLDICLNGPKDKLDSTVLSQPAIYVTSLAAVEVLRACEGGQQIIDSVDVTCGLSLGEYTALAFAGAFSFEDGLKLVKLRGEAMQDAADAAQSAMVSVIGLDSEKLQQLCDAANEEVDEANKVQIANFLCPGNYAVSGGVKGVEAVEAKAKSFKARMTVRLAVAGAFHTSFMEPAVSRLEAALAATEIKSPRIPVISNVDAQPHADPDTIKKILARQVTSPVQWETTMKTLLTNGVKKSYELGPGKVIAGIVKRMDKGADLENIVA

SEQ ID NO: 8794 - protein, 390 aa, Tripterygium wilfordii
RPPILRTSAFCSSGSLALSSTATMATFSLALTSVSPTKLSFFDSIKSCNGNGIRIRNLNRSRVFMSVSVGSQTVVDDALFADYKPNCAFLFPGQGAQAIGMGKEAQSVPAAADLYKKANDVLGFDILDVCANGPKEKLDSTVISQPAIYVTSLAAVEVLRARDGGQQIIDSVDVTCGLSLGEYTALAFAGAFSFEDGLKLVKLRGQAMQEASDAAKSAMVSVVGLDSEKVQLLCNAANEEVDEANKVQIANYLCPGNYAVSGGVKGIEAVEAKAKSFKARMTVRLAVAGAFHTSFMEPAVSRLEAALAATVIKPPRIPVISNVDAQPHADPNIIKKILARQVTSPVQWETTVKTLLSRGLKNGYELGPGKVIAGILKRIDKGASIENIGA

SEQ ID NO: 8795 - protein, 388 aa, Brassica napus
MRSLLHLTILRTHPLKAHCLILRTTTMATSYSSSLLLPPSVSLNKSRNGSSLGLSVNRSRVSMSVSAGSQTTLNDSLFADYKPSSAFLFPGQGAQAIGMGKEAQSVAAAADLYTKANHILGYDLLDICVNGPKEKLDSTVISQPAIYVTSLAAVELLRVREGGEQIINSVDVTCGLSLGEYTALAFAGAFSFEDGLKLVKLRGEAMQAAADAAKSAMVSIIGLDSEKVQQLCDAANQEVEEADKVQIANFLCPGNYAVSGGLKGIEAVEAKAKSFKARMTVRLAVAGAFHTSFMEPAVSRLEAALASTEIRSPRIPVISNVDAQPHADPDTIKKILARQVTSPVQWETTVKTLLSKGLKSSYELGPGKVIAGIFKRVDKSASVENISA

SEQ ID NO: 8796 - protein, 389 aa, Brassica oleracea
MRSLLNCTKLRTPPLKAHSLILRTTTMATSYSSSSLLLSPSVSLNKSRNGSSLGFSVNRSRVSMSVSAGSQTTVNDSLFADYKPTSAFLFPGQGAQAIGMGKEAQSVAAAADLYTKANHILGYDLLDICVNGPKEKLDSTVISQPAIYVTSLAAVELLRVREGGEQIINSVDVTCGLSLGEYTALAFAGAFSFEDGLKLVKLRGEAMQAAADAAKSAMVSIIGLDSEKVQQLCDAANQEVEEADKVQIANFLCPGNYAVSGGLKGIEAVEAKAKSFKARMTVRLAVAGAFHTSFMEPAVSRLEAALASTEIRSPRIPVISNVDAQPHADPDTIKKILARQVTSPVQWETTVKTLLSKGLKSSYELGPGKVIAGIFKRVDKTASVENISA

SEQ ID NO: 8797 - protein, 407 aa, Centaurea maculosa
MLFSHQSLLTRFSSPRFLRRFSSSNLLPTMASSSSLLLPSVSLNHHHQVSLDSRSSSSVCFGGFKHGGVRRLNLEKSRVSMSVSVGSNTVVVDDALFADYKPTNAFLFPGQGAQAVGMGQEAQKVPAAAQLYNKANEILGFDILDVCINGPKEKLDSTVLSQPAIYVTSLAAVEILRARDGGQQIIDSVDVTCGLSLGEYTALAFAGAFSFEDGLKLVKLRGEAMQAAADAAKGAMVSIIGLDSDKVQQLCDAANEEVEEAEKVQIANFLCTGNYAVSGGVKGIEAVEAKAKSFKARMTVRLAVAGAFHTRFMNPAVSKLESALADTQIRTPRIPVISNVDAQPHADPDTIRKILACQVTSPVQWETTVKTLLSRGLEKSYELGPGKVIAGIVKRMDKTSPIENIGA

SEQ ID NO: 8798 - protein, 405 aa, Cirsium arvense
MLFSHQSLLTRFSSPRFLRRFSSSNLLPTMASSSLLLPSVSLNHHQVSFDSRSSSSVCFGGFKHGGVRRLNLEKSRVSMSVSVGSNTVVVDDALFADYKPTNAFLFPGQGAQAVGMGQEAQKVPAAAQLYNKANEILGFDILDVCINGPKEKLDSTVLSQPAIYVTSLAAVEILRARDGGQQIIDSVDVTCGLSLGEYTALAFAGAFSFEDGLKLVKLRGEAMQAAADAAKGAMVSIIGLDSDKVQQLCDAANEEVEEAEKVQIANFLCTGNYAVSGGVKGIEAVEAKAKSFKARMTVRLAVAGAFHTRFMNPAVSKLESALADTQIRTPRIPVISNVDAQPHADPDTIRKILACQVTSPVQWETTVKTLLSRGLEKSYELGPGKVIAGIVKRMDKTSPIENIGA

SEQ ID NO: 8799 - protein, 386 aa, Prunus mume
MHTFLRLNLHHPLILLTSLPTMTAFLALPSISLNSSSVSGLRNGKGAPLGIRSLGRSRVSMTASVGSQTLQSDALFADYKPNFAFLFPGQGAQAVGMGREAQSVPAAAELYKKANDILGFDLLDVCFNGPKEKLDSTVISQPAIYVTSLAAVELLRARDGGQQIIDSVDVTCGLSLGEYTALAFAGSFSFEDGLNLVKLRGEAMQEAADAAKSAMVSVIGLDSDKVQQLCDAANQEVDDANKVQIANYLCTGNYAVSGGVKGVEAVEAKAKSFKARMTVRLAVAGAFHTSFMEPAVSRLEAKLAATQIRTPRIPVISNVDAQPHSDPETIKKILARQVTSPVQWETTVKTLLSKGLKKSYELGPGKVIAGIVKRMERSAEIENIAA

SEQ ID NO: 8800 - protein, 376 aa, Triphysaria pusilla
MSSSIALPSISVSKAAFGASESFRSSTCLGFRNEIRRNSSFNLKKSRVSTSVAVGSDVVVVDDALFKDYKPSSAFLFPGQGAQAVGMGVEAQKVPAAAELYKRANDILGFDLLDICINGPKEKLDSTVLSQPAIYVTSLAAVEVLRARDGGQQIIESVDVTCGLSLGEYTALAFAGAFSFEDGLKLVKLRGEAMQDAADAAKSAMVSIIGLDSAKVQQLCDAANEEVDEASKVQIANFLCTGNYAVSGGLKGIEAVEAKAKSFKARMTVRLAVAGAFHTGFMEPAVSRLESALASTVIKTPRIPVISNVDAEPHADPATIKKILARQVTSPVQWETTVKTLLSRGLKKSYELGPGKVIAGIVKRMDKGADLENIGA

SEQ ID NO: 8801 - protein, 386 aa, Fragaria vesca
MRTLHNLHHHRSLILRTSLSTMSAASLAVSPISLNFSGLRNGTARPVLGVRNLSRSRVSMSVSVGSSPTVTDDALFADYKPTNAFLFPGQGAQALGMGKEAQSVPAAAELYKKANDILGFDLLDVCINGPKEKLDSTVISQPALYVTSLAAVELLRARDGGQQIIDSVDVTCGLSLGEYTALAFAGSFSFEDGLKLVKLRGEAMQEAADAAKGAMVSVIGLDSDKVQQLCDAANEEVDDKDKVQIANYLCTGNYAVSGGVKGVEALEAKAKSFKARMTVRLAVAGAFHTRFMDPAVSRLEAKLAATQIRTPRIPVISNVDAQPHSDPEVIKKILARQVTSPVQWETTVKTLLSKGLKKSYELGPGKVIAGIVKRMDRSAEIENIGA

SEQ ID NO: 8802 - protein, 365 aa, Prunus persica
MTASLALSSISLNSSFVSGLRNGKGAPLGIRSLGRSRVSMTASVGSQTLQSDALFADYNSNFAFLFPGQGAQAVGMGREAQSVPAAAELYKKANDILGFDLLDVCINGPKEKLDSTVISQPAIYVTSLAAVELLRARDGGQQIIDSVDVTCGLSLGEYTALAFAGSFSFEDGLNLVKLRGEAMQEAADAAKSAMVSVIGLDSDKVQQLCDAANQEVDDANKVQIANYLCTGNYAVSGGVKGVEAVEAKAKSFKARMTVRLAVAGAFHTSFMEPAVSRLEAKLAATQIRTPRIPVISNVDAQPHSDPETIKKILARQVTSPVQWETTVKTLLSKGLKKSYELGPGKVIAGIVKRMERSAEIENIAA

SEQ ID NO: 8803 - protein, 398 aa, Elaeis guineensis
MGPPSISPRAALASRSPSPLSPVYLAARRLCDRAPMASASVALIPSARLPRISVHGGLRSLPRNLSRSRVSMSVSVGSRASAAEDTLFQDYKPSCAFLFPGQGAQTVGMGVEAQSVPAAADLFKKANDLLGFDLLDVCTNGPKEKLDSTVISQPAIYVTSLAAVEVLRTRDGGQDIIDSVDVTCGLSLGEYTSLAFAGAFSFEDGLKLVKLRGEAMQDAADAASSAMVSVIGLDSEKVQLLCDAANEEVDDKEKVQIANFLCPGNYAVSGGVKGVEAVEAKAKSFKARMTVRLAVAGAFHTRFMEPAVSRLEAALATTEIRTPKIPVISNVDAQPHSDPDMIKKILARQVTSPVQWELTVKTLLSKGLKKSYELGPGKVIAGIVKRMNKGADIENVGA

SEQ ID NO: 8804 - protein, 419 aa, Triphysaria pusilla
SSLTPPKTSLIQWIFVNIPIFYLTFLLIRFNSIIYEINFHLSKQCHPQSCFLLFLSPKPLSAPPNPSEAPPVWVSGTIRRASRFNVEKHKVFMSVAVGSDPVVVDDAMFKDYKPSSSFLFPGQGAQAVGMGVEAQKVPAAAELYKRANDILGFDLLDICINGPKEKLDSTVLSQPAIYVTSLAAVEVLRARDGGQQIIDSVDVTCGLSLGEYTALAFAGAFSFEDGLKLVKLRGEAMQDAADAAKSAMVSIIGLDSAKVQQLCDAANEEVDEASKVQIANFLCTGNYAVSGGLKGIEAVEAKAKSFKARMTVRLAVAGAFHTGFMEPAVSRLESALASTAIKTPRIPVISNVDAEPHADPATIKKILARQVTSPVQWETTVKTLLSRGLKKSYELGPGKVIAGIVKRMDKGADLENIGA

SEQ ID NO: 8805 - protein, 387 aa, Brassica napus
RSLLNRTKLRTPPLKAHSLILRTTTMATSYSSSLLLPPSVSLNKSRNASSLGFSVNRSRASMSVSAGSQTTLNDSLFADYKPTSAFLFPGQGAQAIGMGKEAQSVAAAADLYTKANHILGYDLLDICVNGPKEKLDSTVISQPAIYVTSLAAVELLRVREGGEQIINSVDVTCGLSLGEYTALAFAGAFSFEDGLKLVKLRGEAMQAAADAAKSAMVSIIGLDSEKVQQLCDAANQEVEEADKVQIANYLCPGNYAVSGGLKGIEAVEAKAKSFKARMTVRLAVAGAFHTSFMEPAVSRLEAALASTEIRSPRIPVISNVDAQPHADPDTIKKILARQVTSPVQWETTVKTLLSKGLKSSYELGPGKVIAGIFKRVDKTASVENISA

SEQ ID NO: 8806 - protein, 376 aa, Ocimum basilicum
MASSIALPSISLSKSAFADSASLRSSASFCFRNEIRRVSRLNLEKSRLLMSVAVGSEAAIVDDALFKDYKPSTAFLFPGQGAQAVGMGLEAQKVPAAAELYKRANDILGFDLLDICINGPKEKLDSTVLSQPAIYVTSLAAVEVLRAREGGQQIIDSVDVTCGLSLGEYTALAFAEAFSFEDGLKLVKLRGQAMQDAADAAQSAMTSIIGLDSAKVQELCDAANEEVDEANKVQIANFLCTGNYAVSGGLKGIEAVEAKSKSFKARMTVRLAVAGAFHTSFMEPAVSRLEAALASTPIRKPRIPVISNVDAEPHADPETIKKILARQATSPVQWETTVKTLLSRGLTKSYELGPGKVIAGIVKRMDRSADIENIGA

SEQ ID NO: 8807 - protein, 391 aa, Petroselinum crispum
MQAAILAKPTSSSYHLLKMASSSLLLPSISPHPISSKTPASLCLTRFSNYGIKGCRNFNKSRVFMSVSTGSQTATVDDALFLDYNPTSAFLFPGQGAQAVGMGVEAQKVPAAAELFSKANEILGFDLLDVCVTGPKEKLDSTVLSQPAIYVTSLAAVEVLRAREGGQQIIDSIDVTCGLSLGEYTALAFAGAFSFEDGLKLVKLRGQAMQEAADAAKSAMVSVIGLDSEKVQLLCDAANEEVDEADKVQIANFLCSGNYAVSGGVKGVEVLEAKAKSFKARMTVRLAVAGAFHTRFMNPAVSRLEAALAATEIKIPRIPVISNVDAQPHADPETIKKILARQVTSPVQWETTVKTLLNKGLKKSYELGPGKVIAGILKRVDRSAEIENISA

SEQ ID NO: 8808 - protein, 408 aa, Cirsium arvense
MLFSHQSIHRFNPPRFLRPFSSFNLLPAMASSSLLLPSVSLNHQVSFDAPDSLSSKSSSSVCFGGFKHGFRRLNLEKSRVSMSASSVGSTIAVADALFADYKATNAFLFPGQGAQAVGMGQEAQKVPAAAQLYNKANEILGFDILDVCINGPKEKLDSTVLSQPAIYVTSLAAVEILRARDGGQQIIDSVDVTCGLSLGEYTALAFAGAFSFEDGLKLVKLRGEAMQEAADAAKGAMISIIGLDSDKVQQLCDAANEEVEEAGKVQIANFLCTGNYAVSGGVKGIEAVEAKAKSFKARMTVRLAVAGAFHTRFMNPAVSRLESALAATQIRTPRVPVISNVDAQPHADPETIKKILASQVTSPVQWETTVKTLLSRGLEKSYELGPGKVIAGIVKRMDKTSPIENISA

SEQ ID NO: 8809 - protein, 363 aa, Cocos nucifera
MASASVSLIPSAHLPRISAHGGLRSLPKNLSRSRVSMSVSVGSRASAAEDTLFQDYKPSCAFLFPGQGAQTVGMGVEAQSVPAAADLFKKANDILGFDLLDVCTNGPKEKLDSTVISQPAIYVASLAAVEVLRARDGGQDIIDSVDVTCGLSLGEYTSLAFAGAFSFEDGLKLVKLRGEAMQDAADAASSAMVSVIGLDSEKVQLLCDAANEEVDEKDKVQIANFLCPGNYAVSGGLKGVEAVEVKAKSFKARMTVRLAVAGAFHTSFMEPAVSRLEAAMATTEIRAPKIPVISNVDAQPHSDPDTIKKILARQVTSPVRWELTVKTLLSKGLKKSYELGPGKVIAGIVKRMNKGADIENVGA

SEQ ID NO: 8810 - protein, 155 aa, Flaveria ramosissima
MQPMKKSRKLREFKLQILVHWNYAVSGGVKGIEAVEAKAKSFKARMTVRLAVAGAFHTRFMNPALSQLESALSATQIKTPRIPVISNVDAQPHADPETIKKILARQVTSPVQWETTVKTLLSRGLEKSYELGPGKVIAGIVKRMDKTSPIENISA

SEQ ID NO: 8811 - protein, 326 aa, Panax ginseng
MSVSVGSQTAANGALFLDYKPTSAFLFPGQGAQVVGMGVEAQNVPAASDLYNKANEILGFDLLDVCINGPKEKLDSTVLSQPAIYVTSLAAVEVLRARDGGQQIIDSVDVTCGLSLGEYTALAFAGAFSFEDGLKLVKLRGQAMQEAADAAKSAMVSVIGLDSEKVQLLCDAANEEVDETNKVQIANFLCPGNYAVSGGVKGVEALEAKAKSFKARMTVRLAVAGAFHTSFMNPAVSRLEAALAATEIRIPRIPVISNVDAQPHSDPATIKKILARQVTSPVQWETTVKTLLTKGLKKSYELGPGKVIAGIVKRMDRAAEIENISA

SEQ ID NO: 8812 - protein, 327 aa, Olea europaea
MSIAVGSQSTVVDDALFNDYRPSRAFLFPGQGAQAVGMGVEAQKVPAAAELYKRANDILGFDLLDVCINGPKEKLDSTVLSQPAIYVTSLAAVEVLRACDGGQAIIDSVDVTCGLSLGEYTALAFAGAFSFEDGLKLVKLRGEAMQDAADAAKSAMVSIIGLDSKKVQLLCDAANQEVDEADKVQIANFLCPGNYAVSGGLKGIEAVEAKAKSFKARMTVRLAVAGAFHTSFMDPAVSRLEAALASSELRTPKIPVISNVDAQPHADPNTIKKILARQVTSPVQWEMTVKTLLTKGVEKSYELGPGKVIAGIVKRMDKGAEIENIGA

SEQ ID NO: 8813 - protein, 376 aa, Triphysaria pusilla
MSSSIVLPSISLSKAAFGASESFRSSTCLGFGNDIRRASRFNLEKSKVFMSVAVGSDLVVVDDAMFKDYKPSSAFLFPGQGAQAIGMGVEAQKVPAAAELYKRANDIMGFDILNICINGPKEKLDSTVLSQPAIYVTSLAAVEVLRARDGGQQIIDSVDVTCGLSLGEYTALAFAGAFSFEDGLKLVKLRGEAMQDAADASKSAMVSIIGLDSAKVQQLCDAANEEVDEASKVQIANFLCTGNYAVSGGLKGIEAVEAKAKSFKARMTVRLAVAGAFHTSFMEPAVSRLESALASTVIKTPRIPVISNVDAEPHADPATIKKILARQVTSPVQWETTVKTLLSRGLNKSYELGPGKVIAGIVKRMDKGAYLENIGA

SEQ ID NO: 8814 - protein, 384 aa, Brassica rapa
MRSLLHRTPRLKAHCLILRTTTMATSYSSSLLLPPSVSLNKSRNGSSLGFSVNRSRVSTNVSAGSQTTLNDSLFADYKPSSAFLFPGQGAQAIGMGKEAQSVAAAADLYTKANNILGYDLLDICVNGPKEKLDSTVISQPAIYVTSLAAVELLRVREGGEQIINSVDVTCGLSLGEYTALAFAGAFSFEDGLKLVKLRGEAMQAAADAAKSAMVSIIGLDSEKVQQLCDAANQEVEEADKVQIANFLCPGNYAVSGGLKGIEAVEAKAKSFKARMTVRLAVAGAFHTSFMEPAVSRLEAALASTEIRSPRIPVISNVDAQPHADPDTIKKILARQVTSPVQWETTVKTLLSKGLKSSYELGPGKVIAGIFKRVDKSASVENISA

SEQ ID NO: 8815 - protein, 393 aa, Arabidopsis lyrata
MRSLLHHTILRTSRSHFLILRPPLSPMATAASSSLLLPSVSLNNLPGSKNASFCFAAKNLNRSRVSMSVSAGSQSTTVHDSFFADYKPTSAFLFPGQGAQAVGMGKEAQSVAAAGELYKKANDILGYDLLDICVNGPKEKLDSTVISQPAIYVTSLAAVELLRVREGGEQIINSVDVTCGLSLGEYTALAFAGAFSFEDGLKLVKLRGEAMQAAADAAKSAMVSIIGLDSEKVQQLCDAANQEVDEADKVQIANYLCPGNYAVSGGLKGIEVVEAKAKSFKARMTVRLAVAGAFHTSFMEPAVTRLEAALAATEIRSPRIPVISNVDAQPHADPDTIKKILARQVTSPVQWETTVKTLLSKGLKSSYELGPGKVIAGIFKRVDKSASVENISA

SEQ ID NO: 8816 - protein, 393 aa, Arabidopsis thaliana
MRSLLHRTILLTSPSHSLIRRTSLSAMATTASSSLLLPSISLNNLSSSKNASFGFAAKNLSRSRISMSVSAGSQSTTVHDSLFADYKPTSAFLFPGQGAQAVGMGKESQSVGAAGELYKKANDILGYDLLDICVNGPKEKLDSTVISQPAIYVTSLAAVELLRVREGGEQIINSVDVTCGLSLGEYTALAFAGAFSFEDGLKLVKLRGEAMQAAADAAKSAMVSIIGLDSEKVQQLCDAANQEVDEADKVQIANYLCPGNYAVSGGLKGIEVVEAKAKSFKARMTVRLAVAGAFHTSFMEPAVSRLEAALAATEIRSPRIPVISNVDAQPHADPDTIKKILARQVTSPVQWETTVKTLLSKGLKSSYELGPGKVIAGIFKRVDKSASFENISA

SEQ ID NO: 8817 - protein, 385 aa, Phaseolus vulgaris
MKALIHHSHSHSHSLFLRHTSSSSSLSAMSSSLFLPSAPFLTPSSNGRPTLPLPRSRVSMSVSTGSQPSVHQTLFADYKPSNSFLFPGQGAQAVGMGKEAQNVPAAALLFSKANDILGFDLLDICINGPKEKLDSTVISQPAIYVTSLAAVELLRAREGGQQIIDSVDVTCGLSLGEYTALAFAGSFSFEDGLKLVKLRGEAMQDAADAAKGAMVSVIGLDSEKVQQLCDAANQEVSEAEKVQIANYLCPGNYAVSGGLKGIEVVESKAKSFKARMIVRLAVAGAFHTSFMEPALSRLEAALATTEIRTPRIPVISNVNAQPHTDPVTIKKTLARQVTSPVQWETTVKTLLAKGLKKSYELGPGKVITGIVKRLDKGADIENIGA

SEQ ID NO: 8818 - protein, 367 aa, Flaveria ramosissima
PSVSLNHQAHDSFPLKSSSSVSFGGLKHGFRRLNLEKSRVSMCVSVGSTTAVDDALFVDYKPTTAFLFPGQGAQAVGMGQEALKVPAAAELYNKANEILGFDILDVCINGPKEKLDSTVLSQPAIYVTSLAAVEILRARDGGQQIIDSVDVTCGLSLGEYTALAFAGAFSFEDGLKLVKLRGQAMQEAADAAKGAMVSIIGLDSDKVQQLCDAANEEVEEAEKVQIANFLCNGNYAVSGGIKGIEAVEAKAKSFKARMTVRLAVAGAFHTQFMNPALSQLESALSATQIKTPRIPVISNVDAQPHSDPETIKKILARQVTSPVQWETTVKTLLSRGLAKSYELGPGKVIAGIVKRMDKTSPIENIGA

SEQ ID NO: 8819 - protein, 398 aa, Eutrema halophilum
MRSLLHRTILRTPPALSLILRTLPSSAAATAMAAAASSLLLPSVSLNNLCSSSRNASSLCLPVKNISRSRVSMSVSAGSQTTVNDTLFADYKPTSAFLFPGQGAQAVGMGKEAQSVAAAEELYKKANDILGYDLLDICVNGPKEKLDSTVISQPAIYVTSLAAVELLRVREGGEQIINSVDVTCGLSLGEYTALAFAGAFSFEDGLKLVKLRGEAMQAAADAAKSAMVSIIGLDSEKVQHLCDAANQEVDEADKVQIANYLCPGNYAVSGGLKGIEAVEAKAKSFKARLTVRLAVAGAFHTSFMEPAVSRLEAALAATEIRSPRIPVISNVDAQPHADPDTIKKILARQVTSPVQWETTVKTLLSKGLKSSYELGPGKVIAGIFKRVDKSASVENISA

SEQ ID NO: 8820 - protein, 366 aa, Musa acuminata
MSSASTALIPLAPLHRFSSVNGARRSFLCHRNPWRSRVSMSVSVGSRATVGNDALFQDYKPSCAFLFPGQGAQTVGMGVEAQNVNAAAELFKKANDILGYDLLDVCANGPKEKLDSTVISQPAIYVTSLAAVEVLRARDGGQDIINSVDVTCGLSLGEYTALAFAGAFSFEDGLKLVKLRGEAMQDAADAAKSAMVSVIGLDSEKVQLLCDAANEEVDDQNKVQIANFLCPGNYAVSGGVKGVEAVEAKAKSFKARMTVRLAVAGAFHTNFMEPAVSRLEAALATTEIRTPRIPVISNVDAQPHSDPDTIKKILAQQVTTPVQWELTLKTLLNKGLKKSYELGPGKVIAGILKRMDKSADLENIGA

SEQ ID NO: 8821 - protein, 408 aa, Cichorium intybus
MHACFPPISHLVQLPRLLRPCCSFNLLSTMASSSLVLPSVSLNQKASFDVHDSYPLKSSSSLCFGGSRHGFRRLNLDKSRVSMSVSVGSTTAVSDALFADYKPTTAFLFPGQGAQAVGMGQEAQKVPAAAELYNKANEILGFDILDVCINGPKEKLDSTVLSQPAIYVTSLAAVEILRAREGGQQIIDSVDVTCGLSLGEYTALAFAGAFSFEDGLKLVKLRGQAMQEAADASKGAMVSIIGLDSDKVQQLCDAANEEVEEAEKVQIANYLCTGNYAVSGGVKGIEAVEAKAKSFKARMTVRLAVAGAFHTSFMSPALSKLESALAATQITTPRIPVISNVDAQPHADPDTIKKILARQVTSPVQWETTVKTLLSRGLEKSYELGPGKVIAGIVKRMDKTSPIENIIA

SEQ ID NO: 8822 - protein, 369 aa, Euphorbia peplus
MACTISLPSVSLKSNLSFASSSSDGSGIRRFGVKFPARSRVFMSVSTGSQISVVDDALFKDYKPQFAFLFPGQGAQAIGMGKEAQSVPAAADLYKKANDILGYDLLELCTSGPKEKLDSTVISQPAIYVTSLAAVELLRARDGGQQIIDSVDVTCGLSLGEYTALAFAGAFSFEDGLKLVKLRGEAMQKAADAARSAMVSIIGLDSDKVQQLCDAANEEVDEADRVQIANYLCPGNYAVSGGLKGIEAVEAKAKSFKARMAVRLAVAGAFHTSFMEPAVSRLEAALAATEIKSPRIPVISNVDAQPHADPAEIKKILARQVTSPVQWETTVKTLLNNGLKKSYELGPGKVIAGIVKRVNKGAEIENISA

SEQ ID NO: 8823 - protein, 407 aa, Lippia dulcis
MHFLLHHHNRFHLHLIRFNRPAKFSSRSASMSSSVVLPSISLTKTSFGASESSFRSSSCLGFRNDIRRASRWNVEKSRLFMSVAVGSEAAVVDDGLFKDYKPSTAFLFPGQGAQAVGVGVEAQKVPAAAELYKRANDILGFDLLDICINGPKEKLDSTVLSQPAIYVTSLAAIEVLRARDGGQQIIDSVDVTCGLSLGEYTALAFAGAFSFEDGLKLVKLRGEAMQDAADAAKGAMVSIVGLDSAKVQALCDAANEEVDEADKVQIANYLCTGNYAVSGGLKGIEAVEAKAKSFKARMAVRLAVAGAFHTSFMNPAVSRLEAALAATVMRSPRIPVISNVDAEPHADPATIKKILARQVTSPVQWETMVKTLLTRGLQKSYELGPGKVIAGIVKRMDKGAAIENIGA

SEQ ID NO: 8824 - protein, 451 aa, Solanum lycopersicum
MSQSLNPNPTYDVIILGASGFTGKYVIREALKFLNVPSSPLKNLAIAGRNNSKLSQALQWASRPNPPPEIPIITADTTDPSSLRDLASQTKIILNCVGPFRLYGEPVFEACADSGCDYLDISGEPEFMERMEVKYHDKAVENGSLLVSACGFDSIPAELGLMFNSRQWLPPAVPNSVVAYLSLESDKRIVGNLGTYESAVLGVANVDKLQELRRSRPKSPRPVIPGPRPPKGPLMDHLKEVGVWAVKLPSADAIVVRRTLSCLAENPHGLPGVNESTEQVERREAFWSSIKPAHFGVKIASKSPLGVVRFIIVGLFIGLFGKIGLGRWLLLKFPSLFSLGWFRKKGPTEDEVASATFKMWFVGHGFSDGSLASQGNRKPDTEIITRVMGPEIGYLTTPIILVQCALILLKERNNLPKGGVFPPGIVFGPTDLQDRLQHNGISFDVISKKTI

SEQ ID NO: 8825 - protein, 447 aa, Capsicum annuum
MSQNPTYDVIILGASGFTGKYVIREALKFLNVPSSPLKNLAIAGRNTSKLSQALQWASGPNPPPQIPILAADTTDPFSLRHLASQTKIILNCVGPFRLYGEPVAEACVDSGCDYLDISGEPEFMERMEVKYHDKAVENGSLVVSACGFDSVPAELGLMFNSRQWLSPAVPNSVEAYVSLESDKRIVGNFATYESAVLGVANADKLLELRRNRPKRPRPVIPGPRPPNGPLMDHQKEIGVWAVKLPSADAIVVRRTLSCLAENPNGLPGVNESTEHVERREAFWSSIKPAHFGVKIASKSVLGVVRFITVGVFIGLFAKIGIGRWLLLKFPSLFSLGWFRKKGPTEDEVASATFKMWFVGHGFSDGSLASQGNRKPDTEIITRVMGPEVGYLTTPIILVQCALILLKERHNLPKGGVLPPGIVFGPTDLQDMLQQNGISFDVISKNTV

SEQ ID NO: 8826 - protein, 491 aa, Capsicum annuum
MWTINATYKSNRTILPKILDHFGYYPTCYTIITNRAMSQKLSPNPTYDVIILGASGFTGKHVIREALKFLNVSSSPLKNLAIAGRNASRLSRALQWASGPNPPPEIPIIAADTNDPSSLRHLASRTKIILNCVGPFRLYGEPVVEACVDSGCDYLDICGEPEFMERMEVKYHDKAVENGSLVVSACGFDSVPAELGWMFSSRQWTPPAICSTIEAYISLESDKRIVGNLGTYESAVLSVANADKLQELRRSRPKKPRPVILGTSSKGPMINHLKEVGLWAVKLPSADATVVRRTLSCLAENLHGLPGVNESTEQIERREEFWSTIKPAHFGMKIASKYLLGVVRFITVGKFIALFGKTGIGRWLLLNFPSVFSLGFFRKKGPTEDEVASATFKMWFVGHGFTDGSLASQGNRKPDMQIITRVMGPEIGYLTTPSILVQCALILLKERDSLPKGGVFPPGIVFGPTDLQDRLQKNGISFDVISKKTVVHLTI

SEQ ID NO: 8827 - protein, 541 aa, Solanum lycopersicum
MVFYVEEFQNNVTDKRRRSIDIEVWRERKESREVYVEFFSPLKVTDGIWVISASFCQKMWTIVTAYKRNRTILPKILDYPTYFTISNRAISQKPSPNPSPTYDMIILGASGFTGKHVIGEALKFLNLPSSPLKNFAIAGRNTSKLSQALQWASGPNPPPEIPILTADTTDSASLRHLASRTKIILNCVGPFRLYGEPVVEACVDSGCDYLDICGEPEFMERMEVKHHDKAVENGSLVVSACGFDSIPAELGWMFNSRQWMPPAIFSTVEAYISLESDKRIVGNLGTYESAVLSVANADILQELRRSRPKKPRPEIPGTFPKGPLVNHLKRVGLWAVKLPSADATVVRRTLSCLAEDSHGLPGVNESTEQIERREAYWSAIKPAHFGMKIASKSLLGVVRFITVGKFIALFGKSDIGRWLLLNFPSVFSLGFFRKKGPTEDEVASASFKMWFVGQGFSDGSLASQRNRKPDMEIITRVMGPEIGYSTTPIILVQCALMLLKERGNLPKGGVFPPGIVFGPTDLQDRLQENGISFDVISKKIV

SEQ ID NO: 8828 - protein, 90 aa, Capsicum annuum
MKWQVLPLRCGLSDTGLAMAVLHHQETGRPDTEIITRVIGPETPIILVQCALILLKERHNLPKGRVLPPGIDCVWPNKPPRQDSTEWNVF

SEQ ID NO: 8829 - protein, 339 aa, Solanum phureja
PNPNPNPNPNAIPSPTYDVIILGASGFTGKYVIREALKFLNVPSSPLKNFAIAGRNTSKLSQALQWASGPNSPPEIPILIADTTDPASLRHLASQTKIILNCVGPFRLYGEPVVEACVDSGCDYLDICGEPEFMERMEVKYHDKAVVNGSLAVSACGFDYIPAELGWMFNSRQWMPPAICCKVEAYISLESDKRIVGNLGTYESAVLGVANADKLQELRRSRPKRPRPVIPGTFPNGPMVNHLKKVGLWAVKLPSADATVVWRTLSCLAEDSRGLPGVNESTEQIEKREAFWSTIKPAHFGMNITSNSLLGVVRFITVGKFIALFLSQKSSLLFLVKLV

SEQ ID NO: 8830 - protein, 367 aa, Nicotiana benthamiana
MVVKVSIFLLFLFLFTVSAVRPAPPLEGLLSNGNFEEQPKPKDLKKKTVLVGKYALPKWEINGLVEYISGGPQPGGMYFPVAHGVHAVRLGNDASISQTIPVKKGSLYALTFGASRTCAQDEVLRVSVPPQTGDLPLQTLYSSNGGDTYAWGFYATSNVVKVTFHNPGVQEDPACGPLLDAVAIKELFPPQPTRVNLVKNPGFEEGPHLLINSSHGVLLPPKQEDLTSPLPGWIIESLKAVKFLDSAHFNVPFGRAAVELLAGRESAIAQIIRTVPKKVYAFAFTVGDAKNGCHGDMMIEAFAAKETFKVPFKSQGKGSFKTVSFKFTAIADRTRITFYSSYYHTKINDYGSLCGPVVDEVKVTPVA

SEQ ID NO: 8831 - protein, 365 aa, Panax ginseng
MATFFSLFLACFLFFTGSAFAAVPLEGLLPNGNFEEPPKPADLQKTVLKGKYALPKWEINGLVEYIAGGPQPGGMYLPVAHGVHAVRLGNEASVSQTIPVKNGSLYALTFGASRTCAQNEVLRVSVPPQTGDLPLQTLYDSLGGDIYAWGFRATSNVAKVTFHNRGVQEDPSCGPLLDVVAIKELFPPRPTRVNLVKNGGFEEGPHLLINASHGVLLPPRIEDLTSPLPGWIIESLKAVKFIDAKHFNIPSGLAAIELVAGRESAIAQIIRTVPKKVYSLTFTVGDAKNGCHGSMMVEAFAAKEMFKVPFTSKGKGISKTESFKFTAISDRTRLTFFSSFYHTKKEDIGSLCGPVLDEVKVLHVA

SEQ ID NO: 8832 - protein, 365 aa, Panax ginseng
MATFISLFLACFLFFNGSAFAAVPLEGLLPNGNFEEPPKPADLQKTVLKGKYALPKWEINGLVEYIAGGPQPGGMYLPVAHGVHAVRLGNEASVSQTIPVKNGSLYALTFGASRTCAQNEVLRVSVPPQTGDLPLQTLYDSLGGDIYAWGFRATSNVAKVIFHNPGVQEDPSCGPLLDVVAIKELFPPRPTRVNLVKNGGFEEGPHLLINASHGVLLPPRIEDLTSPLPGWIIESLKAVKFIDAKHFNVPSGLAAIELVAGRESAIAQIIRTVPKKVYSLTFTVGDAKNGCHGSMMVEAFAAKEMFKVPFTSKGKGISKTESFKFTAISDRTRLTFFSSFYHTKKDDIGSLCGPVLDEVKVLHVA

SEQ ID NO: 8833 - protein, 365 aa, Panax ginseng
MATFISLFLACFLFFNGSAFAAVPLEGLLPNGNFEEPPKPADLQKTVLKGKYALPKWEINGLVEYIAGGPQPGGMYLPVAHGVHAVRLGNEASVSQTIPVKNGSLYALTFGASRTCAQNEVLRVSVPPQTGDLPLQTLYDSLGGDIYAWGFRATSNVAKVIFHNPGVQEDPSCGPLLDVVAIKELFPPRPTRVNLVKNGGFEEGPHLLINASHGVLLPPRIEDLTSPLPGWIIESLKAVKFIDAKHFNIPSGLAAIELVAGRESAIAQIIRTVPKKVYSLTFTVGDAKNGCHGSMMVEAFAAKEMFKVPFTSKGKGISKTESFKFTAISDRTRLTFFSSFYHTKKDDIGSLCGPVLDEVKVLHVA

SEQ ID NO: 8834 - protein, 367 aa, Amsonia hubrichtii
MAVNISLLLSLGLLFISSAFAAAAAPLEGLLANGNFEEKPKPTYLKKGVLQGKYALPKWEITGLVEYIQGGPQPGGMYFAVAHGDHAVRLGNEATISQTIPVKNGSLYALTFGASRTCAQDEVLRVSVPPQSGDLPLQTLYSSNGGDTYAWGFRATSNFAKIIFHNPGMQEDPACGPLLDAVAIKELFPPRPTRVNLVKNGDFEEGPHRLINSSHGVLLPPKQEDQTSPLPGWIIESLKAVKYIDSMHFNVPYGHAAVELLAGRESAIAQIIRTIPNKVYNCTFTVGDAKNGCHGSMMVEAFAAQQTLKAPFKSEGKGHFETVSFKFKAVSPRTRLTFFSSFYHTKINDFGTLCGPVLDQVRVFPVA

SEQ ID NO: 8835 - protein, 366 aa, Quercus alba
MSLNITLLLASFLLLFTSTALAATGLEGLVGNGNFEEQPKSTDIKKTVLIGKYALPKWEINGLVEYISGGPQPGGMYFAVAHGVHAVRLGNEASISQSIKVKPGSLYALTFGASRTCAQEEVLRISVPPQKGDLPLQTLYSSNGGDTYAWGFIATSNVANLTFHNPGVQEDPACGPLLDAVAIKELFPPRPTRDNLVKNPGFEEGPHRLINSTNGVLLPPKQEDLTSPLPGWMIESLKAVKFIDSKHFNVPFGLAAVELVAGRESAIAQVLRTVPNKFYNLTFTVGDAKNGCHGSMMVEAFAAKDTLKVPFKSEGKGKFKTASFKFKALSPRTRITFYSSFYHTRIDDFGSLCGPVLDQVRVLPVA

SEQ ID NO: 8836 - protein, 346 aa, Tabernaemontana elegans
AVPAPLEGLLPNGNFEERPKPTNLKKTVLIGKYALPKWEITGLVEYIHGGPQPGGMYFAVAHGVHAVRLGNEATISQTIPVKNGSLYALTFGASRTCAQDEVLRISVPPQSGDLPLQTLYSSNGGDTYGWGFRATSNFAKITFHNPGMQEDPACGPLLDAVAIKELFPPMPTRVNLVKNGDFEEGPHRLINSSHGVLLPPKQEDQTSPLPGWIIESLKAVKYIDSMHFNVPYGRAAVELLAGRESAIAQIIRTIPKKVYNCTFTVGDAKNGCHGSMMVEAFAGKQTLKAPFKSEGKGHFETVSFKFTALSFRTRLTFFSSFYHTRINDYGTLCGPVLDQVGVFPVA

SEQ ID NO: 8837 - protein, 368 aa, Castanea mollissima
MEMSLSITLLLASFFLLLTSAAFAATSLDGLVGNGNFEEQPKSTDLKKTVLIGKYALPKWEINGLVEYISGGPQPGGMYFAVAHGVHAVRLGNEASISQSIKVKPGSLYALTFGASRTCAQEEVLRISVPPQKGDLPLQTLYSSNGGDTYAWGFIATSNVANLTFHNPGVQEDPACGPLLDAVAIKELFPPRPTRDNLVKNPGFEEGPHRLINSTNGVLLPPKQEDLTSPLPGWMIESLKAVKFIDSKHFNVPFGLAAVELVAGRESAIAQVLRTVPNKFYNLTFTVGDAKNGCHGSMMVEAFAAKDTLKVPFKSEGKGRFKTASFKFKALSPRTRITFYSSFYHTRIDDFGSLCGPVLDQVRVLPIA

SEQ ID NO: 8838 - protein, 368 aa, Lippia dulcis
MVVKISCFLTLFLYTVSALAPPAPLEGLLANGNFEEKPNPKSLKKTVLKGKYALPKWEINGLVEYISGGPQPGGMFFAVAHGVHAVRLGNDASISQTIPVKNGSLYALTFGASRTCAQEEVLRVSVPPQTGDLPLQTLYSSNGGDTYAWGFRANSNSVKVIFLNPGKQEDPACGPLLDAVAIKELFPPRPSRVNLVKNNGFEEGPHMLFNSSHGVLLPPKQEDTTSPLPGWIIESLKAVKFIDSNHFNVPFGKAAVELLAGRESAIAQVIRTVPNKLYNLKFAVGDAKNDCHGSMMIEAFAAKSALKAPFKSEGKGKFMTFSFQFTATSARTRLTFFSSYYHTKVNDFGSLCGPVLDEVHVFPAAAKV

SEQ ID NO: 8839 - protein, 311 aa, Petunia hybrida
GINGLVEYISGGPQPGGMYFPVAHGVHAVRLGNDASISQTIPVKKGSLYALTFGASRTCAQDEVLRVSVPPQTGDLPLQTLYSSNGGDTYAWGFYATSNVVKVMFHNPGVQEDPACGPLLDAVAIKELFPPRPTRANLVKNAGFEEGPHLLINSSHGVLLPPKQEDLTSPLPGWIIESLKAVKFLDSAHFNVPFGRAAVELLAGRESAIAQIIRTVPKKVYTFAFTDGDAKNGCHGDMMVEAFAAKETFKVPFKSQGKGSFKTVSFKFTAIADRTRITFYSSFYHTKINDYGALCGPVVDEVKVTPVAKAL

SEQ ID NO: 8840 - protein, 330 aa, Setaria italica
MAAAAVPNGHPAAASSDDAAPPSSSSSLVFLGTGCSSAVPNARCLIQPPDPPCPVCSQSLSVPPELNPNYRCNTSLLIDYCQDEGAHKYIIIDVGKTFREQVLRWFVHHKIPCVDSILLTHEHADAILGLDDVRVVQPFSPTNDIDPTPIYLSQFAMDSISQKFPYLVKKKLKEGEEVRRVAQLDWRIIESDLQKPFTTSGLEFVPLPVIHGEDYICLGFLFGRKSKVAYISDVSRFPPSTEYAISKSGGGQLDLLILDCLYRTGSHNVHLCWDQTLDAVKRICPKRALLIGMTHEMDHHKDNQTLEEWSRREGIDVQLAHDGLRVYIDL

SEQ ID NO: 8841 - protein, 328 aa, Brachypodium distachyon
MAAAVPNGHPEGTPAPPPSYSSSSSLVFLGTGCSSAVPNARCLIQPPDPPCAVCSQSLSVPPELNPNYRCNTSLLIDYCQDEDVHKYIQIDVGKTFREQVLRWFVCHKIPRVDSIILTHEHADAILGLDDIRVVQPFSPTNDIDPTPIYLSQYAMDSIAMKFPYLVKKKLKEGEEVRRVAQLDWRIIESDLQKPFTASGLEFVPLPVIHGEDYICLGFLFGRKSKVAYISDVSRFPPSTEHAISKSGGGQLDLLILDCLYRTGSHNVHLCWDQTLDALKRICPKKALLIGLTHEMDHHKDNQTLEEWSRREGIDVQLARDGLRVYIDL

SEQ ID NO: 8842 - protein, 330 aa, Setaria italica
MAAAAVPNGHPAAASSDDAAPPSSSSSLVFLGTGCSSAVPNARCLIQPPDPPCPVCSQSLSIPPELNPNYRCNTSLLIDYCQDEGAHKYIIIDVGKTFREQVLRWFVHHKIPCVDSILLTHEHADAILGLDDVRVVQPFSPTNDIDPTPIYLSQFAMDSISQKFPYLVKKKLKEGEEVRRVAQLDWRIIESDLQKPFTTSGLEFVPLPVIHGEDYICLGFLFGRKSKVAYISDVSRFPPSTEYAISKSGGGQLDLLILDCLYRTGSHNVHLCWDQTLDAVKRICPKRALLIGMTHEMDHHKDNQTLEEWSRREGIDVQLAHDGLRVYIDL

SEQ ID NO: 8843 - protein, 328 aa, Zea mays
MAAAVPNGHTAAAGDDDAPPAASSSLVFLGTGCSSAVPNARCLIQPPDPPCPVCSQSLSVPPELNPNYRCNTSLLIDYCQDERAHKYIIIDVGKTFREQVLRWFVRHKIPCVDSILLTHEHADAILGLDDVRVVQPFSPTNDIDPTPIYLSQFAMDSICQKFPYLVKKKLKEGEEVRRVAQLEWKIIESDIQKPFTTSGLEFVPLPVIHGEDYICLGFLFGRKSKVAYISDVSRFPPSTEYAISKSGGGQLDLLILDCLYRTGSHNVHLCWDQTLDAVRRICPKRALLIGMTHEMDHHKDNQTLEEWSRREGIDVQLARDGLRVYIDL

SEQ ID NO: 8844 - protein, 330 aa, Avena sativa
MAASVPNGHPATADDGTPPNPPPSSSSLVFLGTGCSSAVPNARCLIQPPDPPCAVCSQSLSVPPELNPNYRCCTSLLIDYCQDEGAHKYIIIDVGKTFREQVLRWFVRHKIPCVDSILLTHEHADAILGLDDIRVVQPFSPTNDIDPTPIYLSQYAMDSISQKFPYLVKKKLKEGEEVRRVAQLDWRIIESDLQKPFTASGLEFVPLPVIHGEDYICLGFLFGRKTKVAYISDVSRFPPSTEDAISKSGGGQLDLLILDCLYRTGSHNVHLCWDQTLDALKRICPKKALLIGLTHEMDHHKDNKTLEEWSRREGIDVQLARDGLRVYIDL

SEQ ID NO: 8845 - protein, 330 aa, Festuca arundinacea
MAAAIPNGHPATACDGTPPSPPPSSSSLVFLGTGCSSAVPNARCLIQPPDPPCAVCSQSLSVPPELNPNYRCCTSLLIDYCQDEGAHKYIIIDVGKTFREQVLRWFVRHKIPCVDSIILTHEHADAILGLDDVRVVQPFSPTNDIDPTPIYLSQYAMDSISQKFPYLVKKKLKEGEEVRRVAQLDWRIIESDLQKPFTASGLEFVPLPVIHGEDYICLGFLFGRKSRVAYISDVSRFPPSTEDAISKSGGGQLDLLILDCLYRTGSHNVHLCWDQTLDALKRICPKKALLIGLTHEMDHYKDNQTLEEWSRREGIDVQLARDGLRVYMDL

SEQ ID NO: 8846 - protein, 326 aa, Sorghum bicolor
MAAAIPNGHTAGGDDAPPPASSSLVFLGTGCSSAVPNARCLIQPPDPPCSVCSQSLSVPPELNPNYRCNTSLLIDYCQDEGAHKYIIIDVGKTFREQVLRWFVRHKIPCVDSILLTHEHADAILGLDDVRVVQPFSPTNDIDPTPIYLSRFAMDSISQKFPYLVKKKLKEGEEIRRVAQLDWKIIESDIQKPFITSGLEFVPLPVIHGEDYICLGFLFGRKSKVAYISDVSRFPPSTEYAISKCGGGQLDLLILDCLYRTGSHNVHLCWDQTLDAVRRICPKRALLIGMTHEMDHHKDNQTLEEWSRRQGIDVQLARDGLRVYIDL

SEQ ID NO: 8847 - protein, 325 aa, Panicum virgatum
MAADAVPNGHAAADAPPPSSSSLVFLGTGCSSAVPNARCLIQPPDPPCPVCSQSLSVPPELNPNYRCNTSLLIDYCRDEGAHKYIIIDVGKTFREQVLRWFVRHKIPCVDSILLTHEHADAILGLDDIRVVQAFSPTNDIDPTPIYLSQFAMDSISLKFPYLVKKKLKEGEEVRRVAQLDWRIIESDLQKPFTTSGLEFVPLPVIHGEDYICLGFLFGRKSKVAYISDVSRFPPSTEYAISKSGGGQLDLLILDCLYRTGSHNVHLCWDQTLDAVKRICPKRALLIGMTHEMDHDKDNQTLEEWSRREGIYAQLARDGLRVYIDL

SEQ ID NO: 8848 - protein, 332 aa, Pseudoroegneria spicata
MAAAVPNGHPYAAGEDNPPPPPPSSSSSSLVFLGTGCSSAVPNARCLIQPSDPPCAVCSQSLTVPPELNPNYRCNTSLLIDYCQDEGVHKYIIIDVGKTFREQVLRWFVCHKIPCVDSIILTHEHADAILGLDDIRVVQPFSPTNDIDPTPIYLSQYAMDSISQKFPYLVKKKLKEGEEVRRVAQLDWRIIESDLQKPFTASGLQFVPLPVIHGEDYICLGFLFGRKSKVAYISDVSRFPPSTEDAISKSGGGQLDLLILDCLYRTGSHNVHLCWDQTLDAIKRICPKKALLIGLTHEMDHHKDNQALEEWSRREGIDVQLARDGLRVYIDL

SEQ ID NO: 8849 - protein, 325 aa, Panicum virgatum
MAAAAVPNGHAAADAPPPSSSSLVFLGTGCSSAVPNARCLIQPPDPPCHVCSQSLSIPPELNPNYRCNTSLLIDYCQDEGAHKYIIIDVGKTFREQVLRWFVRHKIPCVDSILLTHEHADAILGLDDIRVVQAFSPTNDIDPTPIYLSQFAMDSISLKFPYLAKKKLKEGEEVRRVAQLDWRIIESDLQIPFTTSGLEFVPLPVIHGEDYICLGFLFGRKSKVAYISDVSRFPPSTEYAISKSGGGQLDLLILDCLYRTGSHNVHLCWDQTLDAVKRICPKRALLIGMTHEMDHDKDNQTLEEWSRREGIDVQLARDGLRVYIDL

SEQ ID NO: 8850 - protein, 174 aa, Secale cereale
MDSISQKFPYLVKKKLKEGEEVRRVAQLDWRIIESDLQKPFTASGLQFVPLPVIHGEDYICLGFLFGRKSKVAYISDVSRFPPSTEDAISKSGGRQLDLLILDCLYRTGSHNVHLCWDQTLDAIKRICPKKALLIGLTHEMDHHKDNQTLEEWSRREGIDVQLARDGLRVYIDL

SEQ ID NO: 8851 - protein, 337 aa, Hordeum vulgare
MAAAAADVPNGHPSASGDGNPPPPPPPPSSSSSSLVFLGTGCSSAVPNARCLIQPSDPPCAVCSQSLSVPPELNPNYRCNTSLLIDYCQDEGAHKYIIIDVGKTFREQVLRWFVCHKIPCVDSIILTHEHADAILGLDDVRVVQPFSPSNDIDPTPIYLSQYAMDSISQKFPYLVKKKLKEGEEVRRVAQLDWRIIESDLQKPFTASGLQFVPLPVIHGEDYICLGFLFGIKSKVAYVSDVSRFPPSTEDAISKSGGGQLDLLILDCLYRTGSHNVHLCWDQTLDAIKRICPKKALLIGLTHEMDHHKDNQTLEEWSRREGIDVQLARDGLRVYIDL

SEQ ID NO: 8852 - protein, 309 aa, Triticum aestivum
SSSSSSLVFLGTGCSSAVPNARCLIQPSDPPCAVCSQSLSVPPELNPNYRCNTSLLIDYCQDEGAHKYIIIDVGKTFREQVLRWFVCHKIPCVDSIILTHEHADAILGLDDIRVVQPFSPTNDIDPTPIYLSQYAMDSISQKFPYLVKKKLKEGEEVRRVAQLDWRIIESDLQKPFTASGLQFVPLPVIHGEDYICLGFLFGRKSKVAYISDVSRFPPSTEDAISKSGGGQLDLLILDCLYRTGSHNVHLCWDQTLDAIKRICPKKALLIGLTHEMDHHKDNQTLEEWSRREGIDVQLARDGLRVYIDL

SEQ ID NO: 8853 - protein, 307 aa, Lolium multiflorum
SSSSLVFLGTGCSSAVPNARCLIQPPDPPCAVCSQSLSVPPELNPNYRCCTSLLIDYCQDEGAHKYIIIDVGKTFREQVLRWFVRHKIPCVDSIILTHEHADAILGLDDVRVVQPFSPTNDIDPTPIYLSQYAMDSISQKFPYLVKKKLKEGEEVRRVAQLDWRIIESDLQKPFTASGLEFVPLPVIHGEDYICLGFLFGRKSRVAYISDVSRFPPSTEDAISKSGGGQLDLLILDCLYRTGSHNVHLCWDQTLDALKRICPKKALLIGLTHEMDHYKDNQTLEEWSRREGIDVQLARDGLRVYMDL

SEQ ID NO: 8854 - protein, 771 aa, Triticum aestivum
MAWQLSALVMAITCLMLCRTSEQSSESELLQQLRKQLEYPRQLEVWNNPSGNPCYTQPTSVVTVTCEGDAVTELKIVGDRITKPPKFSGYPLPNVSLSEAFVIDSFVTTLTRLTTLRVVILVSLGLWGPLPDKIHRLSSLQVLDLSSNFLYGSIPPKLSAMSRLQTLTLDGNYFNGTVPDWFGSLSNLTVLRLQRNRLKGSIPASVGKATMLTELALAGNNISGEVPALGSLVKLEMLDLRDNELDGELPDMPTALVTVLLSKNSFKGEIPEKFGQLKRLQHLDLSFNFLEGSPPEELFDLPNISYLNLAANMLSGSLSSSLTCSSTLGFVDLSTNRITGDLPACLSANLNNRVVKFDGNCFSADPEHQHEANYCQQPHKGGRSGKDVGLVVTIVGIVLIVLVLSLLLMASNKRNCQRVTAEQQLLQKQMQDNSTPGMSSELLESARYISQAVKFGSQIMPTHRVFSLEELKEATKCFERSAFLGEGSIGKLYKGKLENGTVIAIRCLALHHRYSIRNLKLRLDLLAKLRHPNLVCLLGHCTDNAVDESSVKRVFLVYEYVPNGTLSSYLSGSTPEKTLKWCDRLHVLIGIARAVHFLHTGIIPGSLYNRLKTSNILLDEHHIAKLSDYGLSIITEEIYKHEAIGERQRYIQNNAEELETLQDDVCSFGCIILEALMGSKLHRKGDPFILSELVMSLSCQEEREHVLDPVVLGTSSQDSLSMVVSITIKCLSVESSTRPSIEEVLWNLQYAAQVQGTADGDLRSEVSSQAC

SEQ ID NO: 8855 - protein, 327 aa, Sorghum bicolor
MTSPPRVSMEITDDMLKSMEVGLAFRDYNGRISSMDFHSKATSYLVTASDDESIRLYDTQNAVCLKTINSKKYGVELVCFTDNPTIVLYSSKNGWDESLRLLSLNDNRFLRYFKGHLDRVVCISFCSEKENFLSGSLDRTVLLWDQRAEKSQGLLRVQGRPAVSYDDQGMVFAVAYGGHIRMFDARKFEKGPFEIFSVGNNDSEAHVIKFSSDGRRILLTTKAGRVHVLDSFHGNSIASYNVKPVVTNSTLEASFSPDGNHIISGSGDGSVYAWNVRSGKVARWGSTDNEPPLVRWAPGSLMFVTGSSELSCWVPDLSKLGSFTISK

SEQ ID NO: 8856 - protein, 327 aa, Zea mays
MTSPPRVSMEITDDMLKSMEVGLAFRDYNGRISSMDFHSKATNYLVTASDDESIRLYDTQNAVCLKTINSKKYGVELVCFTDNPNIVLYSSKNGWDESLRLLSLNDNRFLRYFKGHLDRVVCISFCSEKENFLSGSLDRTVLLWDQRAEKSQGLLRVQGRPAVSYDDQGMVFAVAYGGHIRMFDARKFEKGPFEIFSVGNNDSEAHVIKFSSDGRRILLTTKAGRVHVLDSFHGNSIASCNVKPVVTNSTLEASFSPDGNHIISGSGDGSVYAWNVRSGKVARWGSTDDEPPLVRWAPGSLMFVTGSSELSCWVPDLSKLGSFTISK

SEQ ID NO: 8857 - protein, 327 aa, Setaria italica
MTSPPRVSMEITDEMLKSMEVGLAFRDYNGRISSMDFHSKATNYLVTASDDESIRLYDTQNALCLKTINSKKYGVELVCFTDNPGIVLYSSKNGWDESLRLLSLNDNRFLRYFKGHLDRVVCISFCSEKENFLSGSIDRTVLLWDQRAEKSQGLLRVQGRPAVSYDDQGMVFAVAYGGHIRMFDARKFEKGPFEIFSIGNDDSEAHVIKFSSDGRRILVTTKAGRVHVLDSFHGSSIASYNVKPVVTNSTLEASFSPDGNHIISGSGDGSVYAWNVRSGKVARWGSTDNEPPLVRWAPGSLMFVTGSSELSCWVPDLSKLGSFTVTK

SEQ ID NO: 8858 - protein, 327 aa, Pennisetum glaucum
MTSPPRVSMEITDEMLKSMEVGLAFRDYNGRISSMDFHSKSTNYLVTASDDESIRLYDTQSALCLKTINSKKYGVELVCFTDNPGIVLYSSKNGWDESLRLLSLNDNRFLRYFKGHLDRVVCISFCSEKENFLSGSLDRTVLLWDQRAEKSQGLLRVQGRPAVSYDDQGMVFAVAYGGHIRMFDARKFEKGPFEIFSVGNDDSEAHVIKFSSDGRRILLTTKVGRVHVLDSFHGNSIGSYNVKPVVTNSTLEASFSPDGNHIISGSGDGSVYAWNVRSGKVARWGSTDNEPPLVRWAPGSLMFVTGSSELSCWVPDLSKLGSFTVTK

SEQ ID NO: 8859 - protein, 331 aa, Triticum aestivum
MPAGEKEERVTMEVTDEMLKTMEVGLAFRDYIGRISSMDFHSKATNYLVTASDDESIRLYDIQNAVCLKTINSKKYGVELVCFTTNPTLVLYSSKNGWDESLRLLSLNDNRFVRYFKGHLDRVVAMSLCYEKDSFLSGSLDRTVLLWDLRADKAQGLLRVQGRPAVSYDDQGLVFAVAYGGYVRMFDARKFEKGPFDIFSVGNDESEANMIKFSSDGRRLLLTTKAGCIHVLDSFHGNSLATYNVKPVVTNSTLEASFSPDGNHIISGSGDGSVFAWSVRSGKKVARWGSTDSEPPLVRWAPGSLMFLTGSSELSCWVPDLSKLGSFAVTK

SEQ ID NO: 8860 - protein, 330 aa, Brachypodium distachyon
MPRGEKEERVTMEVTDEVLKIMEVGLAFRDYNGRISSMDFHSRATNYLVTASDDESIRLYDIQNATCLKTINSKKYGVELVCFTTNPTLVLYSSKNGWDESLRLLSLNDNRFVRYFKGHLDRVVSMSLCYEKDNFISGSLDRTVLLWDLRADKAQGLLRVQGRPAVSFDNQGLVFAVAYGGYVRMFDARKFEKGPFDIFSVGNDDSEAHVIKFSSDGRRLLLTTKAGRIHVLDSFHGNNIATYSVKPVLGNSTLEASFSPDGNHIISGSGDGTVYAWSVRSGKVARWGSTDNEPPLVRWAPGSLMFLTGSSELSCWVPDLSKLGSFAVTK

SEQ ID NO: 8861 - protein, 331 aa, Secale cereale
MPAGEKEERVTMEVTDEMLKTMEVGLAFRDYIGRISSMDFHMKATNYLVTASDDESIRLYDIQNAVCLKTINSKKYGVELVCFTTNPTLVLYSSKNGWDESLRLLSLNDNRFVRYFKGHLDRVVAMSLCYEKDSFLSGSLDRTVLLWDLRADKAQGLLRVQGRPAVSYDDQGLVFAIAYGGYVRMFDARKFEKGPFDIFSVGNDESEANMIKFSSDGRRLLLTTKAGYIHVLDSFHGNNLATFNVKPALTNSTLEASFSPDGNHIISGSGDGSVYAWSVRSGKKVARWGSTDNEPPLVRWAPGSLMFLTGSSELSCWVPDLSKLGSFAVTK

SEQ ID NO: 8862 - protein, 331 aa, Secale cereale
MPAGEKEERVTMEVTDEMLKTMEVGLAFRDYIGRISSMDFHMKATNYLVTASDDESIRLYDIQNAVCLKTINSKKYGVELVCFTTNPTLVLYSSKNGWDESLRLLSLNDNRFVRYFKGHLDRVVAMSLCYEKDSFLSGSLDRTVLLWDLRADKAQGLLRVQGRPAVSYDDQGLVFAVAYGGYVRMFDARKFEKGPFDIFSVGNDESEANMIKFSSDGRRLLLTTKAGYIHVLDSFHGNNLATFNVKPALTNSTLEASFSPDGNHIISGSGDGSVYAWSVRSGKKVARWGSTDNEPPLVRWAPGSLMFLTGSSELSCWVPDLSKLGSFAVTK

SEQ ID NO: 8863 - protein, 331 aa, Hordeum vulgare
MPAGEKEERVTMEVTDEMLKTMEVGLAFRDYIGRISSMDFHSKSTNYLVTASDDESIRLYDIQNAVCLKTINSKKYGVELVCFTTNPTLVLYSSKNGWDESLRLLSLNDNRFVRYFKGHLDRVVAMSLCYEKDSFLSGSLDRTVLLWDLRADKAQGLLRVQGRPAVSYDDQGLVFAVAYGGYVRMFDARKFEKGPFDIFSVGNDESEANMIKFSSDGRRLLLTTKAGCIHVLDSFHGNNLATYNVKPAVTNSPLEASFSPDGNHIISGSGDGSVFAWSVRSGKKVARWGSTDNEPPLVRWAPGSLMFLTGSSELSCWVPDLSKLGSFAATK

SEQ ID NO: 8864 - protein, 292 aa, Sorghum bicolor
MRAVAAAASPSRLRALLLLLSPHLPARTPRPRFAMNPSSSSSSSSGGYHSRAAAFASPQPRGGGGRRRGGGGGGGRGGGDGSERIDALGRLLTRVLRHMAAELRLDMRTDGYVRVRDLLKLNLQTFAKVPLKSHTVDEIREAVRRDNKQRFSLLEEDGELLIRANQGHTVTTVTSESLLKPILSPDEVSVCVHGTYRKNLDSILQSGLKRMTRLHVHFSSGLPLDGGVISGIRQNVNILIHLDVSKALKDGMKLYISDNKVILTEGFDGVVPVKYFERIETWPGRAPIPFQR

SEQ ID NO: 8865 - protein, 285 aa, Secale cereale
MRALTAATISSPIRALLLLSSFPSTLRPLLTMNPSSSSSGYRSNAAAFASMHQPRGGRGGGRRPGGRGGGGGDGGNRIDALGRLLTRVLRHMAPELRLNMRSDGYVRVRDLLRLNLETFAKVPLNSHTVDEIREAVRRDNKQRFGLLEEDGELLIRANQGHTVTTVTSESLLKPILSADEVSVCVHGTYRKNVDSILKYGLKRMARLHVHFSSGLPSDGGVISGMRSGANILIYLNVRKALQDGMKLYISDNKVILTEGFDGVVPVKYFEKIETWPGRAPIPVQR

SEQ ID NO: 8866 - protein, 285 aa, Brachypodium distachyon
MRALTAAASSLRSLLFLHISSPPGPSLAMNRPESSSSTSGYRSQAAPFASPRGGGGGSRRPCGRGGGGGGGGGGNDRIDALGRLLTRVLRHMASELRLDMRSDGYVRVRDLLTLNLQTFAKVPLKSHTVDEIREAVRRDNKQRFGLLEEDGELLIRANQGHTVRTVTSESLLTPILSADEVSVCVHGTYRKNLDSILKSGLKRMERLHVHFSSGLPSDGEVISGMRRSANILIYLDVSKALQDGMKLYISENKVILTEGFDGVVPVKYFEKIETWPGRAPIPFQR

SEQ ID NO: 8867 - protein, 285 aa, Hordeum vulgare
MRALTAATISSPTRALLLLHLSFPSTLRLPLTMNPSSSSGYRSNAAASASTHQPRGGRGGARRPGGRGGGGGGGDGRDRIDALGRLLTRVLRHMAPELRLDMRSDGYVRVRDLLRLNLQTFAKVPLNSHTVDEIREAVRRDNKQRFGLLEEDGELLIRANQGHTVTTVTSESLLKPILSADEISVCVHGTYRKNVDSILKYGLKRMARLHVHFSSGLPSDGGVISGMRTSANILIYLNVRKALQDGMKLYISENKVILTEGFDGVIPVKYFEKIETWPGRAPIPF

SEQ ID NO: 8868 - protein, 676 aa, Brachypodium distachyon
MDQDVDDLAAASPLAAAARSLRAGVERSRAMGQAMARGAPRLEEIQAALPALEAAVRPIRAPRAELVAAGPHIDRAVGPAAAVLKVFDAVHGLEPSLLEAGEGGPGPAGDLPGYLAVLGRLEEALRFLSDNCGLAAQWLADIVEYLGDHDLADPRFLAEVGVALDELRKPSGYLDGGLLAAALDMLEGVFRRLLAEHSAPLAMQQHGATSSASISSSSRIPATAVRKLSLILDRLVANGRRDSCISMYADARGGVVSASVRALGLDYLRNPADDAQALGPGVELWGQHLEFVVRRLLESERQLCAKVFGQHKDVSSACFAEVAAQASVLDFLRFGRAVADVKKDPIKLLRLLEVFDSLNKLRLDFNRLFGGKVCADIQCQTRDLVKLLVDGAVEIFEELLVQVELQRHMPPPADGGVPRLVSFVVEYCNRLLSEKYRPVLAQVLTIHRSWRKEVFNDNMLVAAVLNIVKALEANFDVWSKGYGNVTLSYIFMMNTHWHFFKHLKATKLGELLGDVWLRDREQFKGYYLEMFMRSSWGPLSPLLNREGLILFSKGRATAKDLVKQRLKTFNARFSEMFHEQSAWIIPDKDLRAEACDLVLQAIVPAYRSYMQNYGPLVEQDVSASKYVKYTVDGLEKMLSTLFMPRPRRAGSFQIGHSNGRPSSVTAGFYRSASAVN

SEQ ID NO: 8869 - protein, 676 aa, Sorghum bicolor
MDHGGGEGRVVTASLAAARRTLRAGVDKSRALGHALARAGPRLEEIQTALPALEAAVRPIRAPLAELAAAGPHIDRAVGPAAAVLKVFDAVHGLEPPLLAPGAAGSGAAGDLPGYLAVLAQLEEAHRFLADNCGLAAQWLADIVEYLGDRDLADPRFLAELGVTLDELRTPPAGDLDGGLLAAALGILEAEFRRLLADHSAPLAMPQPGASAGSVAPSRVPAAAVHKLTLILDRLVANGRQDRCVAAYIDARGGVVSASLRALGLDYLHDPSQDAQALGPALELWGRHLEFLVRRLLESERQLCAKVFGQHKDAASACFAEVAAQARVLEFLRFGRAVADAKKDPIKLQRLLEVFDSLNKLRLDFNRLFGGKACAEIQSQTRDLVKLLIDGAVEIFEELIVQVELQRHMPPPVDGGVPRLVTFVVEYCNRLLSEQYRTVLGQVLTIHRSWRKEVFNDRMLVDVVLNIVKALEANFDVWSKAYDNATLSYLFMMNTHCHFFRHLKATKLGEVLGDVWLREHEQYKEYYLSMFIRESWGALSPLLNREGLILFSKGRATARDLVKQRLKTFNSSFDEMHCRQSSWVIPDKDLRERTCNLVVQTIVPTYRSYMQNYGPLVEQEGNASKYVRYTVDGLEKMLSALYMPRPRRAGSFQIKHSSGNIASAMTGLHRSASAVK

SEQ ID NO: 8870 - protein, 670 aa, Zea mays
MDHGGEGRVAAARRTLRAGVDKSRALGHSLARAGPRLEEIQAALLALEAAVRPIRAPHAELAAAGPHIDRAVSPAAAVLKVFDAVHGLEPPLLAPGAAGSGAAGDLPGYLAVLAQLEEAHRFLADNCGLAAQWLADIVEYLGDRDLADQRFLADLGVTLDELRTPPAGDLDGGLLAAALSMLEAEFRRLLADHSAPLAMPQTGAAAGSATPSRVPAVAVHKLTLILDRLVANGRQDSCVASYIDARGGVVSASLRALGLDYLRDPSQDAQALGPALDLWRRHLEFVVRRLLDSERQLCAKVFGQHKDVASACFAEVAAQAGVLDFLRFGRAVADAKKDPIKLQRLLEVFDSLNKLRLDFNRLFGGKACAEIQSQTRDLVKLLIDGAVEIFEELIVQVELQRHMPPPVDGGVPRLVTFVVEYCNRLLGEQYRPVLGQALTIHRSWRKEAFNDRMLVDAVLNIVKALEANFDVWSKAYDNATLSYLFMMNTHWHFFRHLKATKLGEVLGDVWLREHEQYKEYYLSMFIRESWGALSALLNREGLILFSKGRATARDLVKQRLKTFNSSFDEMHRRQSSWVIPDKDLRERTCNLVVQTIVPTYRSYMQNYGPLVEQEGNASKYVRYTVDGLEKMLSALYMPRPRRAGSFQIKHSSGKIASAMTGLHRSASAVK

SEQ ID NO: 8871 - protein, 798 aa, Secale cereale
MATLQDLGVSAFINILGAFVFLLLFAVLRIQPINDRVYFPKLYIAGKRAADHRGLRRAINLNLCTYFKFLSWVPGALRMTQTELIHHAGLDSAVYLRIYTLGLKIFLPVMVVALLVLIPVNVSGGTLLNLRKDVMFSDIDKLSISNVSPGSNRFFIHLLMAYVFTFWTCFMLYKEYSNVAFMRLHFLASQKRCADQFTVIVRNIPRVSSHSTSETVDEFFRRNHPDHYLGQQAVYNANRYAKLVKQKERLQNWLDYYQLKFERHPEKRPTGRTGCFGFCGRQVDQIDYYRARISELDKRIASERQRVLNDPKAVMPVSFVTFDSRWGAAVCAQTQQSKNPTQWLTNWAPEPRDVYWQNLAIPFFSLSIRKFLISIAVFALVFFYMIPIAFVQSLANLEGIERVAPFLRPVIEVKVVKSFLQGFLPGLALKLFLYILPTVLMIMSKVEGYVSLSSLERRTASKYYYFMLVNVFLGSIIAGTAFEQLDSFFHDPPSQIPRTIGVAVPMKATFFMTYIMVDGWAGIANEILRVKPLVIYHLKNMFIVKTERDRERAMDPRSIALGENLPSLQLYFLLGLVYAVVTPILLPFIIVFFAFAYLVYRHQIINVYNQEYESAAAFWPQVHSRIIASLLISHVTLFGLMSTMKAAYSTPLLIFLPLLTLWFHKYCKSRFEPAFRKYPLEEAMEKDVMEHASEPSLNLKTYLANAYLHPIFHMFEQEDQKEEATIEVRIDKSEQQQHVRSSHSQYEEEMSAQSHYHHEERSSSQYQYQHQYQYQHEETHMRSEQSPPHFVYHPGVEH

SEQ ID NO: 8872 - protein, 802 aa, Triticum aestivum
MATLQDLGVSAFINILGAFVFLLLFAVLRIQPINDRVYFPKLYIAGKRAADHRGARRAINLNLCTYFKFLSWVPGALRMTQTELIHHAGLDSAVYLRIYTLGLKIFLPVMVVALLVLIPVNVSGGTLLNLRKDVMFSDIDKLSISNVSPGSNRFFIHLLMAYVFTFWTCFMLYQEYSNVAFMRLHFLASQKRCADQFTVIVRNIPRVSSHSTSETVDEFFRRNHPDHYLGQQSVYNANRYAKLVKQKERLQNWLDYYQLKFERHPEKRPTGRTGCFGFCGRKVDQIDYYRARISELDKRIASERHRVLNDPKAVMPVSFVTFDSRWGAAVCAQTQQSKNPTQWLTNWAPEPRDVYWQNLAIPFFSLSIRKFLISIAVFALVFFYMIPIAFVQSLANLEGIERVAPFLRPVIEVKVVKSFLQGFLPGLALKLFLYILPTVLMIMSKVEGYVSLSSLERRTASKYYYFMLVNVFLGSIIAGTAFEQLDSFFHDPPSQIPRTIGVAVPMKATFFMTYIMVDGWAGIANEILRVKPLVIYHLKNMFIVKTERDRERAMDPRSIALGENLPSLQLYFLLGLVYAVVTPILLPFIIVFFAFAYLVYRHQIINVYNQEYESAAAFWPQVHSRIIASLLISHVTLFGLLSTMKAAYSTPLLIFLPLLTIWFHKYCKSRFEPAFRKYPLEEAMEKDRMEHASEPSLNLKTYLANAYLHPIFHMFEQEDQKEEATIEVRIDKSEHQQQQHVRSSHSQYEEETSAQTHYHHEERTSSQYQYQYQHQYQYQLEETHMRSEQSPPHFVYHPGVDH

SEQ ID NO: 8873 - protein, 809 aa, Setaria italica
MATLEDLGVSAFINILSAFVFLLLFAVLRIQPINDRVYFPKLYLAHKRTHDHSSRSAVRRFVNLNICTYITFLSWVPGALRVTEPELIAHAGLDSAVYLRIYTLGLKMFLPIAALALLVLVPVNVSGGTLLNLKKEVVFSDIDKLSISNVNPGSNRFFVHLLMAYVFTFWVCFMLYKEYSNVAFMRLHFLASQKRCADQFTVIVRNIPRISSHSTSETVDEFFRRNHPDHYLGQQPVYNANRYAKLVKKRDRLQNWLDYYQLKFERHPEKRPTRRTGCLGFCGREVDQIDYYQARISELERKMASERQKVLNDPKAIMPVSFVTFDSRWGAAVCAQTQQSKNPTQWLTDWAPEPRDVYWQNLAIPFFSLSIRRFLISVAVFALVFFYMIPITFVQSLANLEGLEKVAPFLKPVIEVKVVKSFLQGFVPGLALKIFLYILPTVLLIMSKVEGYISLSSLERRTASKYYYFMLVNVFLGSIIAGTAFEQLYTFLHKPATQIPMTIGVAIPMKATFFMTYIMVDGWAGIANEILRVKPLVIYHLKNMFIVKTERDRERAMDPGSIGLGENLPTLQLYFLLGLVYAVVTPILLPFIIIFFAFAFLVYRHQIINVYNQEYESAAAFWPQVHSRIIASLLISHLTLFGLMSTKEAAFSTPLLIFLPLLTIWFHKYCKSRFEPAFRKYPLEEAMEKDNMEHASEPNLNLKSFLANAYLHPIFHLFEEAAKEEETVEVRIDKAQKQQHHHRQEEETHVRSSSQYHEESHLRSTHETHYHHEESQYSRSTQYHEGIHVRSDMDSPSPPHFVYHYDIQP

SEQ ID NO: 8874 - protein, 808 aa, Sorghum bicolor
MATLQDLGVSAFINILSAFVFLLLFAVLRIQPVNDRVYFPKLYLAHKRQHDHTARSAVRRFVNLNICTYITFLSWVPGALRMSETELVAHAGLDSAVYLRIYKLGLKIFLPIATLALLVLIPVNVSGGTLLDLKKEVVFSDIDKLSISNVNPGSNRFFIHLLMAYVFTFWACFMLYKEYSNVAFMRLHFLASQKRCADHFTVIVRNIPRVSSHSTSETVDEFFRRNHPDHYLGQQPVYNANRYAKLVKQRERLQNWLDYYELKFERHPERRPTGRTGCLGFCGREVDQIDYYRARISELEKRMASERQKVLNDPKAVMPVSFVTFDSRWGAAVCAQTQQSKNPTQWLTDWAPEPRDVYWQNLAIPFFSLSIRRFLISVAVFALVFFYMIPIAFVQSLANLEGLEKVAPFLKPVIEVKVVKSFLQGFLPGLALKIFLYVLPTVLLIMSKVEGYVSLSSLERRTASKYYYFMLVNVFLGSIIAGTAFEQLHSFLHEPPTQIPRTIGVAIPMKATFFMTYIMVDGWAGIANEILRVKALVIYHLKNMFIVKTERDRERAMDPGSIRLGENLPSLQLYFLLGLVYAVVTPLLLPFIIVFFAFAFLVYRHQIINVYNQEYESAAAFWPQVHTRIIASLLISHVTLFGLMSTKKAAYSTPLLIFLPLLTIWFHKYCKSRFEPAFRKYPLEEAMAKDTMEHASEPNLNLKSFLANAYLHPIFHLFEQAEKEEEMVEVRVDKAEKQRHLHEEDETQVRTSSQYREETHFRSTHETHYHHEESHVSRSTQYHEGIHVRSDTDSPSPPHFVYHYDIQP

SEQ ID NO: 8875 - protein, 810 aa, Zea mays
MATLEDLGVSAFINILGAFVFLLLFAVLRIQPVNDRVYFPKLYLAHKRHQHDHAARSAFRRFVNLNLCTYVTFLSWVPGALRMSEPDLVAHAGLDSAVYLRIYTLGLKIFLPITTLALLVLIPVNVSGGTLLDLRKEVVFSDIDKLSISNVSPGSNRFFIHLLMAYVFTFWVCFMLYKEYSNVAFMRLHFLASQKRCADHFTVIVRNIPRVSSHSTSETVDEFFRRNHPDHYLGHQPVYNANRYAKLVKQKERLQNWLDYYELKFERHPERRPTRRTGCLGFCGREVDQIDYYRARISELERRMTSERQKILNDPKAVMPVSFVTFDSRWGAAVCAQTQQSKNPTQWLTDWAPEPRDVYWQNLAIPFFSLSIRRFLMSVAVFALVFFYMIPIAFVQSLANLEGLEKVAPFLKPVIEAHVVKSFLQGFLPGLALKIFLYILPTVLLIMSKVEGYVSLSSLERRTASKYYYFMLVNVFLGSIIAGTAFEQLYSFLHQPPTQIPRTIGVAIPMKATFFMTYVMVDGWAGIANEILRVKALVIYHLKNMFIVKTERDRDRAMDPGSIGLGENLPSLQLYFLLGLVYAVVTPLLLPFIIVFFAFAFLVYRHQIINVYNQEYESAAAFWPQVHSRIIASLLISHVTLFGLMSTKEAAYSTPLLIFLPLLTIWFHKYCKSRFEPAFRKYPLEEAMAKDTMEHASEPNLNLESFLANAYLHPIFRLFEEAGKEEETVEVRIDKAEKQQHRHEEDEAHARSSSQYREEETHFRSTHETHYHHEESHVSRSTQYHEGIHVRSDTDSPSPPHFVYHYDIQQ

SEQ ID NO: 8876 - protein, 689 aa, Brachypodium distachyon
MSGVQEQRYEELFGGFFFDEDALSEDFSLDGLDKELEEHKNYDVLVSILANGEKQRDMATMVEGNLGHIEQDLIQDYIEDNDSLVLLRDQIHDCDIILSEMGSLLSGFQVHIGSINSELRSLQEKSLDLGLRLKNRKLVETKLAEFVEEIVAPPGLVKVIIDGEVNDDYIRSLNILSKKLRFSEVDLMINASKALKDIKQELERLRKKALSKVSDYIIEIFSAMRKPGTNIQILQQNLLQKYRYLVLFLKEQGLETYNGVCAAYVDTMNKVLSAYFHVYVEALEGLKLDIGVSSDLIGYDTNMVDLITRGREHLRSHRFMFSLGERANILKHIDQPGLVPRISEANSLKYPYEVIFRSLQKLLMDTASSEYLFVEAFFGEESLFYRVFEGPFAVIDEHLNITLPNCHDAVCLMLMICITRKHQLVMSNRQLPCLETYLDKALLYLWPRFKTVFDMYLQSLYRCDVKMLSVDGTRPHHIVRCYVEFTASLVQLNAECGDGQLDMSLERLRLAVDDLLVRFAEKFATPKLQHLFLLNNYDMAISILKEAGEEAKKLQRYFEEKLECNLISFVDELLMEHFGDLIKFVKIHISEDLISYTEPPNIADVEPVVKNFAVKWKNALELMHNEVVTCCSNLLSGMAILKAAMAQLLNDYNRLSECVKMIPGGSSLNRNLVSITSISYEIRKYSRTL

SEQ ID NO: 8877 - protein, 309 aa, Sorghum bicolor
MATIAPRSHLLLLGLTRPQQPTALRACAAFSRSRGAPVPPRAAQPRRVFLGLGATFIDQVTRMASGGTSSRSFVAGARPRQGVSPVEQILKNVEWPDEFPFKPEDFSRFDESSDTLFYSVPRFVTHIDDQAIRALTEYYSEVLPPINTPGATILDMCSSWVSHYPPGYKQEKIVGMGMNEDELKKNSVLTEYVVQDLNVNPKLPFEDNTFDVITNVVSVDYLTKPIDVFKEMRRILKPSGLAIMSFSNRCFWTKAISIWTSTGDVDHAWIVGAYFHYAGGFEPPQAVDISPNPGRTDPMYAVCSRKKIG

SEQ ID NO: 8878 - protein, 307 aa, Zea mays
MATLAPRPHILLGLTRPQPIALRACAAFSRSRHAPVPPRAAQPRRVFLGLGAAFIDQATRMASGGTSSRSFVAGARPRQGVSPVEQILKNVEWPDEFPFKPEDFSRFDESSDTLFYSVPRFVTHIDDQAIQALTEYYSEVLPPSNTPGVAILDMCSSWVSHYPPGYRQEKIVGMGMNEDELKKNSVLTQYVVQDLNVNPKLPFEDNTFDVITNVVSVDYLTKPIDVFKEMRRILKPSGLAIMSFSNRCFWTKAISIWTSTGDADHAWIVGAYFHYVGGFEPPQALDISPNPGRTDPMYVVCSRKKIG

SEQ ID NO: 8879 - protein, 307 aa, Panicum virgatum
MATLAPRPRLLLALRRPQPRRLSARAAAPCARRAPVSPQAARPRRVFLGLGATVIDQVARMASGGTSSRSFVAGARPRQGVSPVEQILNNVEWPDEFPFKPEDFSRFDESSDTLFYSVPRFVTHIDDEAIRALTEYYSEVLPPSNTPGVSILDMCSSWVSHYPPGYRQEKIVGMGMNEDELKRNSVLTEYVVQDLNVNPKLPFEDNTFDVITNVVSVDYLTKPIDVFKEMRRILKPAGLAIMSFSNRCFWTKAISIWTSTGDADHAWIVGAYFHYAGGFEPPKAVDISPNPGRTDPMYVVYSRKKTA

SEQ ID NO: 8880 - protein, 307 aa, Setaria italica
MATLAPRPRLLLALRRPQPRRLRACAAAPCARRAPVPPQAARPRRVFLGLGATVIDQVARMASGGTSSRSFVAGARPRQGVSPVEQILKNVEWPDEFPFKPEDFSRFDESSDTLFYSVPRFVTHIDDQAIRALTEYYSEVLPPSNTPGVAILDMCSSWVSHYPPGYKQEKIVGMGLNEDELKRNSVLTEYVVQDLNVNPKLPFEDNTFDVITNVVSVDYLTKPIDVFKEMQRILKPAGLAIMSFSNRCFWTKAISIWTSTGDADHAWIVGAYFHYAGDFEPPQAVDISPSPGRTDPMYVVYSRKRIA

SEQ ID NO: 8881 - protein, 935 aa, Zea mays
MTIPSAEGFLQASSCLPCTATEEREVVDALTKEAEKNVKHGDLRYLVSQSWWMEWQGYVGLVNYGESGTEQFPQATNRPGEIDNSKLVLAERINGSEEPELQRTLREGEHYTLVPQEVWQRLYEWYKGGPEIPRKVIFDNPTDKTYVVDVYPLCLKLIDARDDSEKVFRISRKAKVHELYSMVCSLMSVEQSEIVIWDYYRRTKGKELTNQNDTLEEAQLSMDQEILLEMKLGGGSSGFSARSTNDELALIPLEPSTSSFSIAGGPTFSNGFSSGIGSSFSQDNSFSPLLRDGEDGYNSLSNGTKDDTHGLSGLHNLGNTCFMNSAIQSLVHTPPLVQYFLEDYTCEINKENPLGLQGELAIAFGELLRKLWSSGRTSIAPRAFKSKLSRFAPQFSGYNQHDSQELLAFLLDGLHEDLNRVKEKPYIEAKDADGRPDDEFAEECWNYHKARNDSIIVDKFQGQYKSTLVCPVCNKISVTFDPFMYLSLPLPSTVTRMITVTVFSGTGDVLPMPYTVTVQKNGNCRDLTKALADVCCLKNSETLLLAEVYERRIYRYLTNPIEGLHIIKDEDILVAYRLPVGHEKLLRLEILHSRADRFLVEPQFNINRKLIGCPIVTCIPNDSTAKSDIYAAVSSVLVPFVRAKAHSPDVSAVKLNGNGPSLDGIVLTDNGTTSEEGLSTSRSREDDNAADNELLPFQLSLTDEKGSTRNAIDMDSNRVLGLVIRVLMDWGEKEHGMYNIDHMDVLPEVFKPGFMSKKTRQEAVNLFSCLDAFLKEEPLGPDDMWYCPGCKEHRQASKKLDLWRLPEILVVHLKRFSYSRYMKNKLDTFVNFPIHDLNMSKYVKPTSRGDQHPVYELYAVINHYGGLGGGHYSAYAKLVEEDNWYHFDDSHVSSVNEDEIRRSAAYVLFYRRVGGSSTAANGGPVDIEMVDSLET

SEQ ID NO: 8882 - protein, 933 aa, Setaria italica
MTIPSAEGFLQASSCLPCTAEEERELVAALTREAEENVRDGDLRYLVSQSWWMEWQRYVGLVSDEENDTEQLPQAMNRPGEIDNSKLISAETINGSEEPELQRTLREGEDYTLVPQGVWRRLYGWYKGGPEIPRKVILDSQPNKVYIVDVYPLCLKLIDGRDNSERNIRISRKAKINELYSMVCSIMSVEQSEIVIWDYYQKLKSKKLANFNETLDEAQITMDQEILLEMKLDESRTGFNTRSTNNELALIPLGPSTSSFSIAGGPTYSNGFSSGIGSSFSQDNSFGPLLRDSTDGYNSFSNGTKDDTHGLSGLHNLGNTCFMNSAIQSLVHTPPLVEYFLEDYTREINTENPLGLQGELAIAFGELLRKLWSSGRTSVPPRAFKSKLSRFAPQFSGYNQHDSQELLGFLLDGLHEDLNRVKKKPYIEAKDADGRPDDEFAEECWNYHKARNDSIIVDKFQGQYKSTLVCPVCNKISVTFDPFMYLSLPLPSTVTRMITVTVFSGTGDALPMPFTVTIQKNGNCRDLTKALTDACCLKSSETLLLAEVYDHRIYRYLTNPIEGLYTIKDEDILVAYRLPVGHEKLLRLEILHRRADRFGADPQFNINRKLIGCPLVTCIPNDSTGKSDIYAAVSDVLVPFVRAKAHGPDVSAVKLSGNGPSLDGIVLTDNGTTCEEGLSTSSGDDNAVDDDLLPFQLSLTDEKGIARNAINTDSNRVLGIVMRVLMDWSDREREMYNTDYMDELPEVFKPGFLSKKTRQEAVNLFSCLDAFLKEEPLGPDDMWYCPGCKEHRQASKKLDLWRLPEILVVHLKRFSYSRYMKNKLDTFVNFPIHDLNMSKYVKHTSRGNLQPMYELYAVINHYGGLGGGHYSAYAKLVEEDNWYHFDDSHVSSVSEDDIRTSAAYVLFYRRVGGSSAVANSVPVDIEMVDSLET

SEQ ID NO: 8883 - protein, 933 aa, Setaria italica
MTIPSAEGFLQASSCLPCTAEEERELVAALTREAEENVRDGDLRYLVSQSWWMEWQRYVGLVSDEENDTEQLPQAMNRPGEIDNSKLISAETINGSEEPELQRTLREGEDYTLVPQGVWRRLYGWYKGGPEIPRKVILDSQPNKVYIVDVYPLCLKLIDGRDNSERNIRISRKAKINELYSMVCSIMSVEQSEIVIWDYYQKLKSKKLANFNETLDEAQITMDQEILLEMKLDESRTGFNTRSTNNELALIPLGPSTSSFSIAGGPTYSNGFSSGIGSSFSQDNSFGPLLRDSTDGYNSFSNGTKDDTHGLSGLHNLGNTCFMNSAIQSLVHTPPLVEYFLEDYTREINTENPLGLQGELAIAFGELLRKLWSSGRTSVPPRAFKSKLSRFAPQFSGYNQHDSQELLGFLLDGLHEDLNRVKKKPYIEAKDADGRPDDEFAEECWNYHKARNDSIIVDKFQGQYKSTLVCPVCNKISVTFDPFMYLSLPLPSTVTRMITVTVFSGTGDALPMPFTVTIQKNGNCRDLTKALTDACCLKSSETLLLAEVYDHRIYRYLTNPIEGLYTIKDEDILVAYRLPVGHEKLLRLEILHRRADRFGADPQFNINRKLIGCPLVTCIPNDSTGKSDIYAAVSDVLVPFVRAKAHGPDVSAVKLSGNGPSLDGIVLTDNGTTCEEGLSTSSGDDNAVDDDLLPFQLSLTDEKGIARNAINTDSNRVLGIVMRVLMDWSDREREMYNTDYMDELPEVFKPGFLSKKTRQEAVNLFSCLDAFLKEEPLGPDDMWYCPGCKEHRQASKKLDLWRLPEILVVHLKRFSYSRYMKNKLDTFVNFPIHDLNMSKYVKHTSRGNLQPMYELYAVINHYGGLGGGHYSAYAKLVEEDNWYHFDDSHVSSVSEDDIRTSAAYVLFYQRVGGSSAVANSVPVDIEMVDSLET

SEQ ID NO: 8884 - protein, 101 aa, Echinochloa colona
MTIPSAEGFLQASSCLPCTAEEERDIVAALTREAEENVKDGDLRYLVSQSWWTEWQRYVGLVSYDENDTEQLPQATNRPGEIDNSKLVRQRQSMVMKSGSF

SEQ ID NO: 8885 - protein, 205 aa, Saccharum officinarum
MAEEKAAAVGGLGGAGAADAAPAVEAAAARVRPVETLLRAAPLGLCVAAMTVMLRDQQSNEYGTVAYSDLGGFKYLVYANGICAAYSLVSAFYTAVPRPATVSRSWVVFLLDQVFTYLILAAGAAAAELLYLAYNGDKEVTWSEACGVFGSFCHQARTSVAITFGTVLCFILLSLISSYRVFSAYEAPPSSALGSKGVEIAAYPR

SEQ ID NO: 8886 - protein, 209 aa, Setaria italica
MSKMAEEKAVGGAAGAADAAQQQQLAAGEAAAARVRPVETLLRAAPLGLCVAAMAIMLKDQQTNEYGTVAYSDLGGFKYLVYANGLCAAYSLVTAFYTAVPRPATVSRSWVVFLLDQVFTYLILAAGAAAAELLYLAYNGDKEVTWSEACGVFGVFCRKARTSVAITFGSVLCFILLSLISSYRLFSAYEAPPSSALGNKGVEIAAYPR

SEQ ID NO: 8887 - protein, 209 aa, Panicum virgatum
MSKMAEEKAVGGAGAADAAQQQQQLAAGEAAAARVRPVETLLRAAPLGLCVAAMAVMLKDQQTNEYGTVAYSDLGGFKYLVYANGLCAAYSLVTAFYTAVPRPATVSRSWVVFLLDQVFTYLILAAGAAAAELLYLAYNGDKEVTWSEACGVFGSFCRQARTSVGITFGSVVCFILLSVISSYRLFSTYEAPPSSALGNKGVEIAAYPR

SEQ ID NO: 8888 - protein, 211 aa, Pennisetum glaucum
MSKMAEEKALGGAAAAVDAAQQQQQQLAAGEAAAARVRPMETLLRAAPLGLCVAAMAIMLKDQQTNEYGTVAYSDLGGFKYLVYANGLCAAYSLVTAFYTAVPRPATVSRSWVVFLLDQVFTYLILAAGAAAAELLYLAYNGDKEVTWSEACGVFGGFCRQARTSVVITFVSVLCFILLSLISSYRLFSAYEAPPSSALGNKGVEIAAYPR

SEQ ID NO: 8889 - protein, 210 aa, Cenchrus ciliaris
MSKMAEEKAVGGAAVAADAAQQQQQLAAGEAAAARVRPVETLLRAAPLGLCVAAMVIMLKDQQTNEYGTVAYSDLGGFKYLVYANGLCAAYSLVTAFYTAVPRPATLSRSWVVFLLDQVFTYLILAAGAAAAELLYLAYNGDKEVTWSEACGVFGGFCRQARTSVTITFASVLCFILLSLVSSYRLFSAYEAPPSSALGNKGVEIAAYPR

SEQ ID NO: 8890 - protein, 209 aa, Zea mays
MSKTAGVGRLGGAGAADAAQQQQLAAGDAAVARAARPIETLLRAAPLVLCVAAMTLMLRDQQSNEYGTVAYSDLGGFKYLVYANGLCAAYSLASAFYTAVPRPATVSRSWVVFLLDQVFTYLILAAGAAAAELLYLAYNGDKEVTWSEACGVFGSFCRQARTSVAITFGAVLCFILLSLLSSYRLFSAYEAPPPSALGSKGVEIAAYPR

SEQ ID NO: 8891 - protein, 190 aa, Echinochloa colona
AQQQQLAAGEAAAARVRPVETLLRAAPLGLCVAAMTVMLKDQQSNEYGTVAYSDLGGFKYLVYANGLCAAYSLLSAFYTAVPRPATVSRSWIVFLLDQVFTYLILAAGAAAAELLYLAYNGDKEVTWSEACGVFGSFCRQARTSVAITFASVLCFILLSLISSYRLFSAYETPPSSALGNKGVEIAAYPR

SEQ ID NO: 8892 - protein, 207 aa, Secale cereale
MSKMADEKVISAPATGGGEDGLIAGDLSAAEARVRPLETLLRAAPLGLCVAAMAVMLRDTQTNEYGTVSYSDLGGFKYLVYANGLCAAYSLVSAFYTAVPRPATLSRSWIVFLLDQVFTYLILAAGAASAELLYLAYNGDKEVTWSEACGVFGGFCRQARTSVAITFGSVVCYILLSLISSYRLFSAYDAPMPSLGNKGVEIAAFPR

SEQ ID NO: 8893 - protein, 213 aa, Triticum aestivum
MSKMADEKVISAPATGGGEDGLIAGDLSAAEARVRPLETLLRAAPLGLCVAAMAVMLRDTQTNEYGTVSYSDLGGFKYLVYANGLCAAYSLVSAFYTAVPRPATLSRSWIVFLLDQVFTYLILGGRRGVGRAALPGVQRRQGGDVERGVRRVRRLLQAGPDVGGHHLRLRRLLHPPLPHLVLPPLQRLRRTHALARQQGRRDRCLPALSREDP

SEQ ID NO: 8894 - protein, 207 aa, Avena sativa
MSKMADEKVMGPPANGGGEDGMLAGELSSAEGRVRPLETLLRAAPLGLCVAAMAVMLRDTQTNEYGTVSYSDLGGFKYLVYANGLCAAYSLVSAFYTAVPRPATLARSWIVFLLDQVFTYLILAAGAASAELLYLAYNGDKEVTWSEACGVFGGFCRQARTSVAITFGSVLCYILLSLISSYRLFSAYDAPVPSHGSKGVEIAAFPR

SEQ ID NO: 8895 - protein, 207 aa, Avena sativa
MSKMADEKVMGPPANGRGEDGMLAGELSSAEGRVRPLETLLRAAPLGLCVAAMAVMLRDTQTNEYGTVSYSDLGGFKYLVYANGLCAAYSLVSAFYTAVPRPATLARSWIVFLLDQVFTYLILAAGAASAELLYLAYNGDKEVTWSEACGVFGGFCRQARTSVAITFGSVLCYILLSLISSYRLFSAYDAPVPSHGSKGVEIAAFPR

SEQ ID NO: 8896 - protein, 207 aa, Hordeum vulgare
MSKMTDEKVISAPATGGGEDGLIAGDLSAAEARVRPLETLLRAAPLGLCVAAMAVMLRDTQTNEYGTVSYSDLGGFKYLVYANGLCAAYSLVSAFYTAVPRPATLSRSWIVFLLDQVFTYLILAAGAASAELLYLAYNGDKEVTWSEACGVFGGFCRQARTSVAITFGSVVCYILLSLISSYRLFSAYDAPMPSLGNKGVEIAAFPR

SEQ ID NO: 8897 - protein, 207 aa, Leymus cinereus x Leymus triticoides
MSKMADEKVISAPATGGGEDGLIAGDLSAADARVRPLETLLRAAPLGLCVAAMAVMLRNTQTNEYGTVSYSDLGGFKYLVYANGLCAAYSLVSAFYTAVPRPATLSRSWIVFLLDQVFTYLILAAGAASAELLYLAYNGDKEVTWSEACGVFGGFCRQARTSVAITFGSVVCYILLSLISSYRLFSAYDAPMPSLGNKGVEIAAFPR

SEQ ID NO: 8898 - protein, 205 aa, Lolium multiflorum
MSKMADEKVMGAPASGGGVEDAGELSPAEARVRPLETLLRAAPLGLCVAAMAVMLRDTQTNEYGTVSYSDLGGFKYLVYANGLCAAYSLVSAFYTAVPRPATLSRSWIVFLLDQVFTYLILAAGAASAELLYLAYNGDKEVTWSEACGVFGGFCRQAKTSVAITFGSVLCYIVLSLISSYRLFSAYDAPVPSHGNKGVEIAAFPR

SEQ ID NO: 8899 - protein, 207 aa, Pseudoroegneria spicata
MSKMADEKVISAPATGGGEDGLIAGDLSATEARVRPLETLLRAAPLGLCVAAMAVMLRDTQTNEYGTVSYSDLGGFKYLVYANGLCAAYSLVSAFYTAVPRPATLSRSWIVFLLDQVFTYLILAAGAASSELLYLAYNGDKEVTWSEACGVFGGFCRQARTSVAITFGSVVCYILLSLISSYRLFSAYDAPMPSLGNKGVEIAAFPR

SEQ ID NO: 8900 - protein, 178 aa, Cenchrus ciliaris
AARVRPMETLLRAAPLGLCVAAMAIMLKDQQTNEYGTVAYSDLGGFKYLVYANGLCAAYSLVTAFYTAVPRPATVSRSWVVFLLDQVFTYLILAAGAAAAELLYLAYNGDKEVTWSEACGVFGGFCHQARTSVAITFGSVLCFILLSLISSYRLFSAYEAPPSSALGNKGVEIAAYPR

SEQ ID NO: 8901 - protein, 201 aa, Brachypodium distachyon
MADEKVMAAPESAGVGEDAGEQTVAEARVRPVETLLRAVPLGLCVAAMAVMLRDTQTNEYGTVSYSDLGGFRYLVYANGLCAAYSLVSAFYTAVPRPATLCRSWIVFLLDQVFTYLILAAGAASAELLYLAYNGDKEVTWSEACGVFGGFCRQARTSVGITFGSVLCYILLSLISSYRLFSAYDAPLPAGSKGIEIAAFPR

SEQ ID NO: 8902 - protein, 209 aa, Oryza sativa
MSKMAEEKVLAAPATVDGGMQSSGDLQASSAAAARVRPVETLLRAAPLGLCVAAMAIMLRNSVTNEYGTVSYSDLGGFKYLVYANGLCAAYSLASAFYIAVPRPATLSRSWVVFLLDQVFTYLILAAGAASAELLYLAYNGDKEVTWSEACGVFGGFCRQARTSVAITFASVACYILLSLISSYRLFSAYDPPQPSLGNKGVEIAAFPR

SEQ ID NO: 8903 - protein, 101 aa, Saccharum officinarum
MMRLLTGGSGSGSGFRFVPRSVDALGAPTSTVIAEGQERGCYWVHAWTVGADGVITQLREYFNTDLTVTRLAAVAAFAKCVWQSRRPDSATNSLPGLLLAL

SEQ ID NO: 8904 - protein, 95 aa, Saccharum officinarum
MMRLLTGGSGGFRFVPRSVDALGAPTSTVIAEGQERGCYWVHAWTVGADGVITQLREYFNTDLTVTRLAASAKCVWQSRRPDSATNSLPGLLLAL

SEQ ID NO: 8905 - protein, 97 aa, Zea mays
MMRLLTTTTSSFRFVPRSVDALAASSGTVIAEGHERGCYWVHAWTVGPDGVITQLREYFNTDLTVTRLAAAVAAKCVWQSRRPDSATNSLPGLLLAL

SEQ ID NO: 8906 - protein, 417 aa, Pennisetum glaucum
MLQTWPVRSPRPVASKVAADTPLLTGQRVLDALFPSVLGGTCAIPGAFGCGKTVISQALSKYSNSQAVVYVGCGERGNEMAEVLMDFPQLTMTLPDGREESVMKRTTLVANTSNMPVAAREASIYTGITIAEYFRDMGYNVSMMADSTSRWAEALREISGRLAEMPADSGYPAYLAARLASFYERAGKVKCLGSPDRTGSVTIVGAVSPPGGDFSDPVTSATLSIVQVFWGLDKKLAQRKHFPSVNWLISYSKYSQALESFYEKFDQDFIDIRTKAREVLQREDDLNEIVQLVGKDALAESDKITLETAKLLREDYLAQNAFTPYDKYCPFYKSVWMMRNIIHFNTLANQAVERAAGTDGQKITYSVIKHRLGDLFYRLVSQKFEDPAEGEDALVAKFKKLYDDLTAGFRNLEDEAR

SEQ ID NO: 8907 - protein, 399 aa, Zea mays
MNGEVECSVCHAKVPVPPPVSKAYDSHRSTVSSRQRALNVLLVSGDCVLAGLQPILVYISKVDGKFKFSPISVNFLTEITKIMFTIVMLFIQARRLKVGDKPLFTVSIFMQAARNNVLLSVPAFLYAINNYLKFIMQLYFNPASVKMLSNLKVLVIAVLLKMIMRRRFSVIQWEALALLLIGISVNQLKSLPEGSSALGLPVAAGAYLYTLFFVTVPALASVYNEKALKSQFDTSIYLQNLFLYGYGAIFNFIGLVVTAIIQGPSSFNILEGHSKATMFLICNNAAQGILSSFFFKYADTILKKYSSTIATIFTGVASAVLFGHTLTINFVLGISIVIISMHQYLSNQIKDEVPSSKVEMAEAHDHSRKEPSYVNVPDSGASESKHRHGSDERQPLLPV

SEQ ID NO: 8908 - protein, 400 aa, Setaria italica
MNGEVECSVCHAKVPVPPAVSKAYDSHRSTVSSRQRALNVLLVSGDCVLAGLQPILVYMSKVDGKFKFSPISVNFLTEITKIIFAIIMLFIQARRLKMGDKPLLTVSTFMQAARNNVLLAVPAFLYAINNYLKFIMQLYFNPASVKMLSNLKVLVIAVLLKIIMKRRFSTIQWEALALLLIGISVNQLKSLPEGSSALGLPVAAGAYLYTFFFVTVPALASVYNEKALKSQFDTSIYLQNLFLYGYGAIFNFLGLVITAIIQGPSSFNILEGHSKATMFLICNNAAQGILSSFFFKYADTILKKYSSTIATIFTGVASAVLFGHTLTINFVLGISIVIISMHQYLSNQIKDEVPSSKIEMAEAHDHSRVKESVYVNVTDSVASEAKHRHGSDERQPLLPV

SEQ ID NO: 8909 - protein, 400 aa, Panicum virgatum
MNGEVECSVCHAKVPVPAAVSKAYDSHRSTVSSRQRALNVLLVSGDCVLAGLQPILVYMSKVDGKFKFSPISVNFLTEITKIIFAIIMLSIQARRLKVGDKSLLTVSTFMQAARNNVLLAVPAFLYATNNYLKFIMQLYFNPASVKMLSNLKVLVIAVLLKIIMKRRFSTIQWEALALLLIGISVNQLKSLPEGSRALGLPVAAGAYLYTLFFVTVPALASVYNEKALKSQFDTSIYLQNLFLYGYGAIFNFLGLVITVIIQGPSSFNILEGHSKATMFLICNNAAQGILSSFFFKYADTILKKYSSTIATIFTGVASAVLFGHTLTINFVLGISIVIISMHQYLSNQIKDEVPSSKVEMAQVHDHSRVTESICINVTDSVASEAKHRHGSDERQPLLPV

SEQ ID NO: 8910 - protein, 399 aa, Brachypodium distachyon
MNGEVECSVCHAKVAVPAAVSKAYDSHRSTVSSRQRALNVLLVSGDCILAGLQPILVYMCKVDGKFKFSPVSVNFLTEITKVIFAIIMLFIQARRLKVGEKPLLTVSTFVQAARNNVLLAVPAFLYAINNYLKFTMQLYFNPATVKMLGNLKVLIIAVLLKVILRRRFSTIQWEALALLLIGISVNQLKSLPEGSTALGLPVAAGAYMYTLFFITVPALASVYNEKALKSQFDTSIYLQNLFLYGYGAIFNFLGLVITAIIQGPSSFHILEGHSKATMFLICNNAAQGILSSFFFKYADTILKKYSSTIATIFTGVASAVLFGHTLTINFVLGISIVIISMHQYLSNQIKDQVPSSKVEMADAEDHSGLKESVYVKVDSVAGEAKHRHGSEERQPLLPV

SEQ ID NO: 8911 - protein, 402 aa, Oryza sativa
MSGEVECRVCHAKVQVPMAAAAVSKAYDIHRSSVSSRQRALNVLLVSGDCVLAGLQPILVYMCKVDGKFKFSPVSVNFLTEITKIIFAIIMLCIQARRLKVGEKPFLTVSTFMQAARNNVLLAVPALFYAINNYMKFVMQLYFNPATVKMLGNLKVLVIAVLLKVIMRRRFSTIQWEALALLLIGISVNQLKSLPEGSSTLGLPVAAGAYLYTLFFVTVPALASVYNEKALKSQFDTSIYLQNLFLYGYGAIFNFLGLVITAIIQGPSSFNILEGHSKATMFLICNNAAQGILSSFFFKYADTILKKYSSTIATIFTGVASAVLFGHTLTINFVLAISIVIISMHQYLSNQIKDEVPSSKIEMGDAHEHRSKESVVVNVSDSIATEAKHRHGTDERQPLLPV

SEQ ID NO: 8912 - protein, 399 aa, Hordeum vulgare
MSGEVECSVCHAKVAVPAAAVSKAYDSHRSTVSSRQRALNVLLVSGDCVLAGLQPILVYMCKVDGKFKFSPVSVNFLTEITKVIFAIIMLFFQARRVKVGEKPLLTVSTFVQAARNNVLLAVPAFLYAINNYLKFIMQLYFNPATVKMLGNLKVLIIAVLLKVLLRRRFSTIQWEALALLLIGISVNQLKSLPEGSTALGLPVAAGAYMYTLFFITVPALASVYNEKALKSQFDTSIYLQNLFLYGYGAIFNFLGLVITALIQGPRSFHILEGHSKATMFLICNNAAQGILSSFFFKYADTILKKYSSTIATIFTGIASAILFGHTLTINFVLGISIVIISMHQYLANQIKDQVPSSKIEMSDAEDDRLEESVIVKVDTVASEAKHRHGSDERQPLLPV

SEQ ID NO: 8913 - protein, 400 aa, Secale cereale
MSGEVECSVCHAKVAVPAAAVSKAYDSHRSTVSSRQRALNVLLVSGDCVLAGLQPILVYMCKVDGKFKFSPVSVNFLTEITKVIFAIIMLFFQARRVKVGEKPLLTVSTFVQAARNNVLLAVPAFLYAINNYLKFTMQLYFNPATVKMLGNLKVLIIAVLLKVLLRRRFSTIQWEALALLLIGISVNQLKSLPEGSTALGLPVAAGAYLYTLFFITVPALASVYNEKALKSQFDTSIYLQNLFLYGYGAIFNFLGLVVTALIQGPRSFHILEGHSKATMFLICNNAAQGILSSFFFKYADTILKKYSSTIATIFTGIASAILFGHTLTINFVLGISIVIISMHQYLANQIKDQVPSSKIEMSDAEDDSRLEESVIVKVDTVASEAKHRHGSDERQPLLPV

SEQ ID NO: 8914 - protein, 399 aa, Secale cereale
MSGEVECSVCHAKVAVPAAAVSKAYDSHRSTVSSRQRALNVLLVSGDCVLAGLQPILVYMCKVDGKFKFSPVSVNFLTEITKVIFAIIMLFFQARRVKVGEKPLLTVSTFVQAARNNVLLAVPAFLYAINNYLKFTMQLYFNPATVKMLGNLKVLIIAVLLKVLLRRRFSTIQWEALALLLIGISVNQLKSLPEGSTALGLPVAAGAYLYTLFFITVPALASVYNEKALKSQFDTSIYLQNLFLYGYGAIFNFLGLVVTALIQGPRSFHILEGHSKATMFLICNNAAQGILSSFFFKYADTILKKYSSTIATIFTGIASAILFGHTLTINFVLGISIVIISMHQYLANQIKDQVPSSKIEMSDAEDDRLEESVIVKVDTAASEAKHRHGSDERQPLLPV

SEQ ID NO: 8915 - protein, 335 aa, Saccharum officinarum
MNGEVECSVCHAKVPVPPAVSKAYDSHRSTVSSRQRALNVLLVSGDCVLAGLQPILVYMSKVDGKFKFSPISVNFLTEITKIIFAIVMLFIQARGLKVGDKPLFTVSIFMQAARNNVLLAVPAFLYAINNYLKFIMQLYFNPASVKMLSNLKVLVIAVLLKMIMRRRFSIIQWEALALLLIGISVNQLKSLPEGSSALGLPVAAGAYLYTLFFVTVPALASVYNEKALKSQFDTSIYLQNLFLYGYGAIFNFLGLMITAIIQGPSSFNILEGHSKATMFLICNNAAQGILSSFFFKYADTILKKYSSTIATIFTGVASAVLFGHTLTINLLLEFQ

SEQ ID NO: 8916 - protein, 360 aa, Triticum aestivum
NVLLVSGDCVLAGLQPILVYMCKVDGKFKFSPVSVNFLTEITKVIFAIIMLFFQARRVKVGEKPLLTVSTFVQAARNNVLLAVPAFLYAINNYLKFTMQLYFNPATVKMLGNLKVLIIAVLLKVLLRRRFSTIQWEALALLLIGISVNQLKSLPEGSTALGLPVAAGAYLYTLFFITVPALASVYNEKALKSQFDTSIYLQNLFLYGYGAIFNFLGLVITALVQGPRSFHILEGHSKATMFLICNNAAQGILSSFFFKYADTILKKYSSTIATIFTGVASAILFGHTLTINFVLGISIVIISMHQYLANQIKDQVPSSKIEMSDAEDDRLEESVIVKVDTVASEAKHRHGSDERQPLLPV

SEQ ID NO: 8917 - protein, 318 aa, Saccharum officinarum
ATSAPPSPASDPEQQQQQEPSSWEEAPLIPGLPDDAALNCLLRLPVSAHDACRLVCRRWRVLLADKAQFFAQRRQLGLRTPWLFTLAFHRCTGKIQWKVLDLGHLTWHAIPAMPCRDRACPRGFGCVAIPGAGDGGDGALLVCGGLVSDMDCPLHLVLKYDIYKNRWTVMTRMLTARSFFAGGVIDGRVYVAGGYSADQFELNSAEVLDPEKGVWQPIASMGMNMASSDSAVIGGRLYVTEGCAWPFFSSPRGQVYDPKIDRWEAMPVGMREGWTGLSVVIEGCLFVISEYERMKVKCMIRRRIHGTQSAALGCPSGL

SEQ ID NO: 8918 - protein, 406 aa, Panicum virgatum
MRHVRVSSHQAPVHKLGHAQMALTPKFRLATAAPAPPSPTEAQQPAWETPLIPGLPDDAALGCLLRLPVEAHAACRLVCRRWRRHLADKARFFAQRRALGLRTPWLFTLAFHRCTGKIQWKVLDLGHLTWHAIPTMPCRDRACPRGFGCVAIPSDGTLLVCGGLVSDMDCPLHLVLKYDIYRNRWTVMTRMLAARSFFAGGVIDGRVYVAGGYSTNQFELNSAEVLDPDKGVWQPIASMGINMASSDSAVISGRLYVTEGCAWPFFSSPRGQVYDPKIDRWEAMPVGMREGWTGQSVVIDGHLFVISEYERMKVKIYDPQTDSWDSVSGPPMPERIMKPFSVSCLDSKIVVVGRGLHVAIGYVEKQPAAGGNSGSRSSSYSICWQDVDVPKEFSDLTPSSSQILHA

SEQ ID NO: 8919 - protein, 408 aa, Panicum virgatum
MRRVRVSSDQAPVRKLGDAQMALTPKFRLATAAVPAPPEGPQQQQLPAWETPLIPGLPDDAALGCLLRLPVEAHAACRLVCRRWRHLLADKARFFAQRRALGLRAPWLFTLAFHRCTGKIQWKVLDLGHLTWHAIPAMPCRDRACPRGFGCVAIPSDGTLLVCGGLVSDMDCPLHLVLKYDIYRNRWTVMTRMLAARSFFAGGVIDGRVYVAGGYSTNQFELNSAEVLDPDKCVWQPIASMGINMASSDSAVISGRLYVTEGCAWPFFSSPRGQVYDPKFDRWEAMPVGMREGWTGQSVVIDGHLFVISEYERMKIKIYDPQTDSWESVSGPPMPERIMKPFSVSCLDSKIVVVGRGLHVAIGHVEKQPAAGANSGSRSASYSICWQDVDVPKEFSDLTPSSSQILHA

SEQ ID NO: 8920 - protein, 408 aa, Setaria italica
MRRVRVSSHNAPVHKLGDAQMALTPKFRLATTNTPAPPPPPEDLQQPAWDTPLIPGLPDDAALTCLLRLPVAAHGACRLVCRRWHHLLADKARFFSQRRALGLRSPWLFTLAFHRCTGKIQWKVLDLGHLAWHAIPAMPCRDRACPRGFGCVAVPGDGALLVCGGLVSDMDCPLHLVLRYDVYRNRWTVVTRMLAARSFFAGGVIDGRVYVAGGYSTNQFELNSAEVLDPDKGVWQPIASMGINMASSDSAVISGRLYVTEGCAWPFFSSPRGQIYDPKINQWEAMPVGMREGWTGQSVVIDGRLFVISEYERMKVKIYDPETDSWDSVSGPPMPERIMKPFSVSCLDSRIVVVGRGLHVAIGYVDKQPAGGGNSGNRSSSYSVCWQDVDVPKEFSDLTPSSSQILHA

SEQ ID NO: 8921 - protein, 402 aa, Hordeum vulgare
MRRVRVSSHQSPVQKLGDSHMKLTPKFRLAATASPSSEPEQPPWETPLMPGLPDDAALNCLLRLPVEAHDACRLVCRRWRHLLADKARFFTQRKAMGLRSPWLFTLAFHRCTGKIQWKVLDLDCLTWHTIPSMPCRDRACPRGFGCIAIPGDGALLVCGGLVSDMDCPLHLVLRYDVYKNRWTVMTRMLSARSFFAGGVIDGRVYVAGGYSTDQFELNSAEVLDPVKGVWQPVASMGTNMASSDSAVIGGRLYVTEGCAWPFFSSPRGQVYDPKIDRWEAMPVGMREGWTGLSVVIDGRLFVISEYERMKVKVYDPEMDSWDPVNGPPMPERIMKPLSVSCLDSKIVVVGRGLHVVIGHIKKQSAGNAGGSSSCNYLIRWQDVEVPRAFSDLTPSSSQILHA

SEQ ID NO: 8922 - protein, 406 aa, Oryza sativa
MRRVRVSSHQSPVHKLGDSQMKLTPKFRLATTSALPSSMPASDLEQASWETPLIPGLPDDAALNCLLRLPVETHEACRLVCRRWHHLLADKARFFMQRKVMGFRSPLLFTLAFHRCTGKIQWKVLDLNYLTWHTIPAMPCRDRACPRGFGCVAIPSDGTLLVCGGLVSDMDCPLHLVLKYDVYKNRWTVMTRMLAARSFFAGGVIDGRVYVAGGYSTDQFELNSAEVLDPVKGVWQPVASMGMNMASSDSAVISGRLYVTEGCAWPFFSSPRGQVYDPKIDRWEVMPVGMREGWTGLSVVIDKHLFVISEYERMKVKVYDPETDSWDSVKGPPMPERIMKPFSVSCLENKIVVVGRGLHVAIGHVKKQPGSHPDSRSSSYLIQWQDVDVPREFGDLTPSNSQILYA

SEQ ID NO: 8923 - protein, 409 aa, Brachypodium distachyon
MRRVRVSSHQSPVHKLGDSQMKLTPKFRLAAAASALPSPTPSSDFEPSSWETPLIPGLPDDAALNCLLRLPVEAHEACRLVCRRWHHLLADKARFFTQRKAMGFRSPWLFTLAFHRCTGKIQWKVLDLNHLTWHTIPTMPCRDRACPRGFGCVAIPSDGTLLVCGGLVSDMDCPLHLVLKYDIYKNRWTVMTRMLSARSFFAGGVIDGQVYVAGGYSTDQFELNSAEVLDPVKGVWQPVASMGMNMASSDSAVISGRLYVTEGCAWPFFSSPRGQVYDPKIDRWEAMSVGMREGWTGLSVVIDERLFVISEYERMKVKVYDQETDSWDSVNGPPMPERIMKPLSVSCLDSKIVVVGRGLQVAIGHVKRQPGSGSGANNTSSSYLICWQDVDVPRTFSDLTPSSSQILHA

SEQ ID NO: 8924 - protein, 409 aa, Pennisetum glaucum
MRRVRVSSHHAPVHKLGDAQMALSPKFRLATTNTPAPPPAAPEDPQQPAWDTPLIPGLPDDAALSCLLRLPVAAHAACRLVCRRWHHLLADKARFFSQRRALGLRSPWLFTLAYHRCTGKIQWKVLDLGHLAWHAIPAMPCRDRACPRGFGCVAVPGDGALLVCGGLVSDMDCPLHLVLRYDVYRNRWTVVTRMLAARSFFAGGVIDGRVYVAGGYSTNQFELNSAEVLDPDKGVWQPIASMGINMASSDSAVISGRLYVTEGCAWPFFSSPRGQIYDPKIDQWEAMPVGMREGWTGQSVVIDGRLFVISEYERMKVKIYDPETDSWDSVSGPPMPEQIMKPFSISCLDSKIIVVGRGLHVAIGHIEKQPSGGCHSGSRSSIYSISWQDVDVPKEFSDLTPSSSQILHA

SEQ ID NO: 8925 - protein, 410 aa, Zea mays
MRRVRVSSHQAPVHKLGDGQMKLTPRFRLAATPASSSGPQQASWEAAEALIPGLPDDAALNCLLRLAVESHGACRLVCRRWRHLLADKARFFAQRRALGLRAPWLFTLAFHRCTGEIQWKVLDLGQRSWHAIPAMPCRDRACPRGFGCVAVPAAGDGGDALVVCGGLVSDMDCPLHLVLRYDVCRNRWAVMARMLAARSFFAGGVIDGRVYVAGGYSADQFELSSAEVLDPAGAGAWRPVASMGANMASADSAVLGGRLYVTEGCAWPFFSAPRGQVYDPRADRWEAMPAGMREGWTGLSVVVAGRLFVVSEYERMKVKVYDPETDSWDTVGGAPMPERIMKPFSVSCVDSRIVVVGRGLHVAIGHVREEPAGGGPGSRGAPGYSVCWQDVDAPKEFSDLTPSSSQILHA

SEQ ID NO: 8926 - protein, 436 aa, Zea mays
MQNLTARRCQVAELLRSVHVLPANGVAWRSPATRTAASGLLPHMPNRDVEASPDDYDPTVDAAHREGLHDALGHGGAADRVPRVRLRVVHLDLHPLVLRDDEQASRDDDAQPRPPFPHPRRHRLPPVRPRVVHLAPRRREEGPRAPLGHVQPAAEHGGVGRRHVGPHAGDRPPRAGASGVEHLGGAQLELVRAVPSRDVHAAVDDAAGEEGPRRQHPRHHGPPVPAHVVPEHEVQRAVHVGDQPAADHERVPAVAGSRDGHAAEPARAGAVAARHGRDGVPAALPQVQHLPLDLARAAVERQREQPRRAQPQRPPLREEPGLVCQEMAPAPAHQPARAVGLHGQPQQAVQRRVVGEPRDQRLRRLPRRLLRTRRRSRGRRQAEPRRQLHLAVAELVDGRLVRGHPHATHAPPGRPSAAGGNRAEKRTSTATCWLAG

SEQ ID NO: 8927 - protein, 394 aa, Secale cereale
MRRVRVSSHHSPVQKLGDSHMKLTPKFRLAATTSDEPEQPPWETPLMPGLPDDAALNCLLRLPVEAHGACRLVCRRWRHLLADKARFFTQRRAMGLRSPLLFTLAFHRCTGKIQWKVLDLDRLAWHAIPAMPCRDRACPRGFGCIAVPGDAAALLVCGGLVSDMDCPLHLVLRYDVCGNRWTTMARMLSARSFFAGGVIDGRVYVAGGYSTDQFELNSAEVLDPANGVWQPIASMGTNMASSDSAVVGGRLYVTEGCAWPFFSSPRGQVYDPKADRWEAMPAGMREGWTGLSVVIDGRLFVISEYERMKVKVYDPETDSWDPVSGPPMPERMMKPLSVSCLDSRIVVVGRGLHVVIGHVKKQSAGDDYLVRWQDVEVPTAFSDLTPSSSQILHA

SEQ ID NO: 8928 - protein, 398 aa, Secale cereale
MRRVRVSSHHSPVQKLGDSHMKLTPKFRLAGTTSPPSSSEPEQPPWETPLIPGLPDDAALNCLLRLPVEAHGACRLVCRRWRHLLADKARFFTQRKAMGLRSPLLFTLAFHRCTGKIQWKVLDLDRLAWHAIPAMPCRDRACPRGFGCIAVPGDAAALLVCGGLVSDMDCPLHLVLRYDVCGNRWTVMARMLSARSFFAGGVIDGRVYVAGGYSTDQFELNSAEVLDPANGVWQPIASMGTNMASSDSAVVGGRLYVTEGCAWPFFSSPRGQVYDPKADRWEAMPAGMREGWTGLSVVIDGRLFVISEYERMKVKVYDPETDSWDAVSGPPMPERMMKPLSVSCLDSRIVVVGRGLHVVIGHVKKQSAGDDYLVRWQDVEVPRAFSDLTPSSSQILHA

SEQ ID NO: 8929 - protein, 408 aa, Avena sativa
MRRVRVSSHQSPVQKLGDSQMKLTPKFRLATASALPPPTPSADFDNCSWETPLIPGLPDDAALNCLLRLPVEAHDMCRLVCRRWHHLLADKARFFTQRKAMGFRSPWLFTLAFHRCTGKIQWKVLDLDCLTWHTIPTMPCRDRACPRGFGCIAIPSDGTLLVCGGLVSDMDCPLHLVLKYDVYKNRWTVMTRMLSARSFFGGGVIDGRVYVAGGYSTDQFELNSAEVLDPVKGVWQSVASMGTNMASSDSAVIKGRLYVTEGCAWPFFSSPRGQVYDPKIDRWEAMPVGMREGWTGLSVVIDERLFVISEYERMKVKVYDAEMDSWDSVNGPPMPERIMKPLSVSCLDSKIVVVGRGLQVAIGHIKKQSGSGSSSNHRASSYLIRWQDVDVPRAFSDLTPSSSQILHA

SEQ ID NO: 8930 - protein, 398 aa, Triticum aestivum
MRRVRVSSHHSPVQKLGDSDMKLTPRFRLAGTTSPSSTEPEQQPPWETPLIPGLPDDAALNCLLRLPVEAHGACRLVCRRWRHLLADKARFFTHRKAMGLRSPWLFTLAFHRCTGKIQWKVLDLDSLAWHAIPGMPCRDRACPRGFGCIAVPGEDAAHLLVCGGLVSDMDCPLHLVLKYDVCKNRWTVVPRMLSARSFFAGGVIDGRVYVAGGYSTDQFELDSAEVLDPVNGVWQPIASMGANMASSDSAVIGGRLYVTEGCAWPFFSSPRGQVYDPKADRWEAMPAGMREGWTGQSVVIDGRLFVISEYERMKVKVYDPEMDSWDPVDGPPMPERIMKPLSVSCLESKIVVVGRGLHVVIGHVKKQSSCDYLVRWQDVEVPRAFSDLTPSSSQILHA

SEQ ID NO: 8931 - protein, 414 aa, Zea mays
MENHNPLHSQIAEVKMDISASASVASGNKFCKGGACDFSDSSNSSKDAKERSTSMRKLIIAVILCIIFMTVEVVGGIKANSLAILTDAAHLLSDVAAFAISLFSLWAAGWEATPQQSYGFFRIEILGALVSIQLIWLLAGILVYEAIVRLINESGDVQGSLMFAVSAFGLFVNIIMAVLLGHDHGHGHGHSHGHPHDHGHGDSDDGHSHHEEPEQGHVHHHEHSHGSSITVTTHHHHHSGTGQHHDAEEPLIKHEADCEGTQSAAKKPRRNINVHSAYLHVLGDSIQSIGVMIGGAIIWYKPEWKIIDLICTLIFSVVVLFTTIRMLRNILEVLMESTPREIDATRLERGLCEMEGVVAVHELHIWAITVGKVLLACHVTVAREADADEILDKVIGYIKTEYNISHVTIQVERE

SEQ ID NO: 8932 - protein, 417 aa, Panicum virgatum
MESHSSSHPQIAEVKMDISPSASGAAGNKICRGAACDFSDSSNSSKDAKERSASMRKLIIAVILCIVFMTVEVVGGIKANSLAILTDAAHLLSDVAAFAISLFSLWAAGWEATPQQSYGFFRIEILGALVSIQLIWLLAGILVYEAIVRLINESGEVQGSLMFAVSAFGLFVNIIMAVLLGHDHGHGHGHGHGHSHDHSHGDSDDDHSHHEEQEQGHVHRHEHSHGSSITVTTHHHHHPSTGQHHDAEEPLLKHEASCEGTQSAAKPAKKPRRNINVHSAYLHVLGDSIQSIGVMIGGAIIWYKPEWKIIDLICTLIFSVVVLFTTIRMLRNILEVLMESTPREIDATRLEMGLCEMDGVVAVHELHIWAITVGKVLLACHVTIAREADADQILDKVIGYIKTEYNISHVTIQIERE

SEQ ID NO: 8933 - protein, 418 aa, Setaria italica
MESHNSSHHQIAEVKMDISPSASGAAGNKICRGAACDFSDASNTSKDAKERFASMRKLIIAVILCIIFMTVEVVGGIKANSLAILTDAAHLLSDVAAFAISLFSLWAAGWEATPQQSYGFFRIEILGALVSIQLIWLLAGILVYEAIVRLINESDEVQGSLMFAVSAFGLFVNIIMAVLLGHDHGHGHGHSHGHGHSHDHGHGDSDDHSHHEEQEQGHVHRHEHSHGSSITVTTHHHHHPSTGQHHDAEEPLLKHEAGCEGTQSAAKAAKKPRRNINVHSAYLHVIGDSIQSVGVMIGGALIWYKPEWKIIDLICTLIFSVVVLFTTIRMLRNILEVLMESTPREIDATRLERGLCEMDGVVAVHELHIWAITVGKVLLACHVTIAREADADQILDKVIGYIKTEYNISHVTIQIERE

SEQ ID NO: 8934 - protein, 421 aa, Pennisetum glaucum
MESHNSSHHQIAEVKMDISSSASGAAGNKICRGAACDFSDASNTSKDAKERLASMRKLIIAVILCIIFMTVEVVGGIKANSLAILTDAAHLLSDVAAFAISLFSLWAAGWEATPQQSYGFFRIEILGALVSIQLIWLLAGILVYEAIVRLINESGEVQGSLMFAVSAFGLFVNIIMAVLLGHDHGHGHGHSHGHGHGHSHDHGDGDSDDDHSHHEEQEQGHVHRHEHSHGTSITVTTHHHHHPSTGQHHDVEEPLLKDEAGCEGTQSAAKTAKKSRRNINVHSAYLHVIGDSIQSVGVMVGGALIWYKPEWKIIDLICTLIFSVIVLFTTIKMLRNILEVLMESTPREIDATRLERGLCEMDGVVAVHELHIWAITVGKVLLACHVTIAREADADQILDKVIGYIKTEYNISHVTIQIERE

SEQ ID NO: 8935 - protein, 414 aa, Panicum virgatum
MESHSSSHPQIAEVKMDISPSASGAAGNKICRGAACDFSDSSNSSKDAKERSASMRKLIIAVILCIIFMTVEVVGGIKANSLAILTDAAHLLSDVAAFAISLFSLWAAGWEATPQQSYGFFRIEILGALVSIQLIWLLAGILVYEAIVRLINESGEVQGSLMFAVSAFGLFVNIIMAVLLGHDHGHGHGHSHGHGHGHSHDHSHGDSDDDHEEQEQGHVHRHEHSHGSSITVTTHHHHHPSTGQHRDAEEPLLKHEGTQSAAKSAKKQRRNINVHSAYLHVLGDSIQSVGVMIGGAIIWYKPEWKIIDLICTLIFSVIVLFTTIRMLRNILEVLMESTPREIDATRLEMGLCEMDGVVAVHELHIWAITVGKVLLACHVTIAREADADQILDKVIGYIKTEYNISHVTIQIERE

SEQ ID NO: 8936 - protein, 410 aa, Zea mays
MESHNPSHSQIAEVTMDIAASASGAAGSKFCKGAACDFSDASNSSKDARERSASMRKLIVAVVLCVVFMAVEVVGGIKANSLAILTDAAHLLSDVAAFAISLFSLWAAGWEATPRQSYGFFRVEILGALVSIQLIWLLAGILVYEAVVRLVGESGDVRGSLMFAVSAFGLVVNVLMAVLLGHDHGHGHGHSHDHGHVHGDSDDGHSHHDDEEQEQGRVHHHEHGHGGAITVTTHHHHHHHDHDVEEALIKHEGTQSAGRAGKKPRRNINVHSAYLHVLGDSVQSVGVMVGGAIIWYKPEWKVIDLICTLVFSVVVLFTTIRMLRSILEVLMESTPREIDATRLESGLCGMEGVVAVHELHIWAITVGKVLLACHVTIARDADADEILDKVIGYIKTEYNISHVTIQVERE

SEQ ID NO: 8937 - protein, 418 aa, Oryza sativa
MDSHNSAPPQIAEVRMDISSSTSVAAGNKVCRGAACDFSDSSNSSKDARERMASMRKLIIAVILCIIFMAVEVVGGIKANSLAILTDAAHLLSDVAAFAISLFSLWAAGWEATPQQSYGFFRIEILGALVSIQLIWLLAGILVYEAIVRLINESGEVQGSLMFAVSAFGLFVNIIMAVLLGHDHGHGHGHGHGHGHSHDHDHGGSDHDHHHHEDQEHGHVHHHEDGHGNSITVNLHHHPGTGHHHHDAEEPLLKSDAGCDSTQSGAKDAKKARRNINVHSAYLHVLGDSIQSIGVMIGGAIIWYKPEWKIIDLICTLIFSVIVLFTTIKMLRNILEVLMESTPREIDATSLENGLRDMDGVVAVHELHIWAITVGKVLLACHVTITQDADADQMLDKVIGYIKSEYNISHVTIQIERE

SEQ ID NO: 8938 - protein, 421 aa, Secale cereale
MDSHNSAPPHVPEVTMDISSASGAAGNKVCRGAACDFSDASNTSKDSKERSASMKKLLIAVILCVIFMAVEVVGGIKANSLAILTDAAHLLSDVAAFAISLFSLWAAGWEATPQQSYGFFRIEILGALVSIQLIWLLAGILVYEAIMRLINESGEVQGSLMFAVSAFGLFVNIIMAVLLGHDHGHGGHGHSHGHGHGHSHDHDHGNSEDDHSHHGDHEQGHVHHHEHSHGTSITVTTNHHSHSSTGQHQDVEQPLLKHDGGCESAQPGAKPAKKPRRNINVHSAYLHVIGDSIQSIGVMIGGALIWYKPEWKIIDLICTLIFSVIVLFTTIRMIRNILEVLMESTPREIDATRLESGLREMEGVIAVHELHIWAITVGKVLLACHVTITQDADADKMLDKVIGYIKAEYNISHVTIQIERE

SEQ ID NO: 8939 - protein, 421 aa, Triticum aestivum
MDSHNSTSPHVPEVTMDISSASGAAGNKACRGAACDFSDASNTSKDSKERSASMKKLLIAVILCVIFMAVEVVGGIKANSLAILTDAAHLLSDVAAFAISLFSLWAAGWEATPQQSYGFFRIEILGALVSIQLIWLLAGILVYEAIMRLINESGEVQGSLMFAVSAFGLFVNIIMAVLLGHDHGHGGHGHSHGHGHGHSHDHDHGNSEDDHSHHGDHEQGHVHHHEHSHGTSITVTTNHHSHSSTGQHQDVEQPLLKHDGDCESAQPGAKPAKKPRRNINVHSAYLHVIGDSIQSIGVMIGGALIWYKPEWKIIDLICTLIFSVIVLFTTIKMIRNILEVLMESTPREIDATRLESGLREMEGVIAVHELHIWAITVGKVLLACHVTITQDADADKMLDKVIGYIKAEYNISHVTIQIERE

SEQ ID NO: 8940 - protein, 420 aa, Avena sativa
MDSHNHSPSHVPEVTMDISSASGAAGSKACRGAACDFSHTSNTSKDAKERSASMRKLLIAVILCVIFMAVEVVGGIKANSLAILTDAAHLLSDVAAFAISLFSLWAAGWEATPQQSYGFFRIEILGALLSIQLIWLLAGILVYEAINRLLTESGEVQGSLMFAVSAFGLFVNIIMAVLLGHDHGHGGHGHSHGHDHGHSHDHDHGHSEDDHSHHEDHEQGHVRHEHSHGTSITVTTHQHSHSSSGIHHDAEEPLLKHDGDCESAQPGAKAAKKPSRNINVHSAYLHVIGDSIQSIGVMIGGGLIWYKPEWKIIDLICTLIFSVIVLFTTVKMIRNILEVLMESTPREIDATRLESGLREMEGVVAVHELHIWAITVGKVLLACHVTITQDADADQMLDKVIGYIKAEYNISHVTIQIERE

SEQ ID NO: 8941 - protein, 420 aa, Avena sativa
MDSHNHSPSHVPEVTMDISSASGAAGSKACRGAACDFSHTSNTSKDAKERSASMRKLLIAVILCVIFMAVEVVGGIKANSLAILTDAAHLLSDVAAFAISLFSLWAAGWEATPQQSYGFFRIEILGALLSIQLIWLLAGILVYEAINRLLTESGEVQGSLMFAVSAFGLFVNIIMAVLLGHDHGHGGHGHSHGHDHGHSHDHDHGHSEDDHSHHEDHEQGHVRHEHSHGTSITVTTHQHSHSSSGIHNDAEEPLLKHDGDCESAQPGAKAAKKPSRNINVHSAYLHVIGDSIQSIGVMIGGGLIWYKPEWKIIDLICTLIFSVIVLFTTVKMIRNILEVLMESTPREIDATRLESGLREMEGVVAVHELHIWAITVGKVLLACHVTITQDADADQMLDKVIGYIKAEYNISHVTIQIERE

SEQ ID NO: 8942 - protein, 308 aa, Avena sativa
MDSHNHSPLHVPEVTMDISSASGAAGNKACRGAACDFSDTSNTSKDAKERSASMRKLLIAVILCVIFMAVEVVGGIKANSLAILTDAAHLLSDVAAFAISLFSLWAAGWEATPQQSYGFFRIEILGALLSIQLIWLLAGILVYEAINRLLTESGEVQGSLMFAVSAFGLFVNIIMAVLLGHDHGHGGHGHSHGHDHGHSHDHDHGHSEDDHSHHEDHEQGHVRHEHSHGTSITVTTHQHSHSSSGIHNDAEEPLLKHDGDCESAQPGAKAAKKPSRNINVHSAYLHVIGEFHPEHWRNDWRGSHLVQA

SEQ ID NO: 8943 - protein, 421 aa, Avena sativa
MDSHNHSPSHVPEVTMDISSASGAAAGNKACRGAACDFSDTSNTSKDAKERSASMRKLLIAVILCVIFMAVEVVGGIKANSLAILTDAAHLLSDVAAFAISLFSLWAAGWEATPQQSYGFFRIEILGALLSIQLIWLLAGILVYEAINRLLTESGEVQGSLMFAVSAFGLFVNIIMAVLLGHDHGHGGHGHSHGHDHGHSHDHDHGHSEDDHSHHEDHEQGHVRHEHSHGTSITVTTHQHSHSNSGIHNDAEEPLLKHDGDCESAQTDAKAAKKPRRNINVHSAYLHVIGDSIQSIGVMIGGGLIWYKPEWKIIDLICTLIFSVIVLFTTVKMIRNILEVLMESTPREIDATRLESGLREMEGVVAVHELHIWAITVGKVLLACHVTITQDADADQMLDKVIGYIKAEYNISHVTIQIERE

SEQ ID NO: 8944 - protein, 413 aa, Brachypodium distachyon
MDSHNSPPPHIPEVTMDISSASGAAGNKMCRGGACDFSDSSNTSKDAKDRSTSIRKLLIAVILCVIFMAVEVVGGIKANSLSILTDAAHLLSDVAAFAISLFSLWAAGWEATPQQSYGFFRIEILGAMVSIQLIWLLAGILVYEAIMRLLNESGEVQGSLMFAVSAFGLFVNIIMAVLLGHDHGHGGHGHSHGHSHGHDNSEVDHLSHHGDHEEGHVHHHEHSHGTSITVTTRQHSHSSTGQHQDAEEPLLKHDGDCESAHPGAKKPRRNINVHSAYLHVIGDSIQSVGVMIGGALIWYKPEWKIIDLICTLIFSVIVLFTTIRMIRNILEVLMESTPREIDATRLENGLRGMEGVIAVHELHIWAITVGKVLLACHVTITQEANADQMLDKVIGYIKAEYNISHVTIQIERE

SEQ ID NO: 8945 - protein, 421 aa, Avena sativa
MDSHNHSPSHVPEVIMDISSASGAAAGNKACRGAACDFSDTSNTSKDAKERSASMRKLLIAVILCVIFMAVEVVGGIKANSLAILTDAAHLLSDVAAFAISLFSLWAAGWEATPQQSYGFFRIEILGALLSIQLIWLLAGILVYEAINRLLTESGEVQGSLMFAVSAFGLFVNIIMAVLLGHDHGHGGHGHSHGHDHGHSHDHDHGHSEDDHSHHEDHEQGHVRHEHSHGTSITVTTHQHSHSSSGIHHDAEEPLLKHDGDCESAQPGAKAAKKPSRNINVHSAYLHVIGDSIQSIGVMIGGGLIWYKPEWKIIDLICTLIFSVIVLFTTVKMIRNILEVLMESTPREIDATRLESGLREMEGVIAVHELHIWAITVGKVLLACHVTITQDADADQMLDKVIGYIKAEYNISHVTIQIERE

SEQ ID NO: 8946 - protein, 421 aa, Avena sativa
MDSHNHSPSHVPEVIMDISSASGAAAGNKACRGAACDFSDTSNTSKDAKERSASMRKLLIAVILCVIFMAVEVVGGIKANSLAILTDAAHLLSDVAAFAISLFSLWAAGWEATPQQSYGFFRIEILGALLSIQLIWLLAGILVYEAINRLLTESGEVQGSLMFAVSAFGLFVNIIMAVLLGHDHGHGGHGHSHGHDHGHSHDHDHGHSEDDHSHHEDHEQGHVRHEHSHGTSITVTTHQHSHSSSGIHNDAEEPLLKHDGDCESAQPGAKAAKKPSRNINVHSAYLHVIGDSIQSIGVMIGGGLIWYKPEWKIIDLICTLIFSVIVLFTTVKMIRNILEVLMESTPREIDATRLESGLREMEGVIAVHELHIWAITVGKVLLACHVTITQDADADQMLDKVIGYIKAEYNISHVTIQIERE

SEQ ID NO: 8947 - protein, 421 aa, Avena sativa
MDSHNHSPSHVPEVTMDISSASGAAAGNKACRGAACDFSHTSNTSKDAKERSASMRKLLIAVILCVIFMAVEVVGGIKANSLAILTDAAHLLSDVAAFAISLFSLWAAGWEATPQQSYGFFRIEILGALLSIQLIWLLAGILVYEAINRLLTESGEVQGSLMFAVSAFGLFVNIIMAVLLGHDHGHGGHGHSHGHDHGHSHDHDHGHSEDDHSHHEDHEQGHVRHEHSHGTSITVTTHQHSHSSSGIHNDAEEPLLKHDGDCESAQPGAKAAKKPSRNINVHSAYLHVIGDSIQSIGVMIGGGLIWYKPEWKIIDLICTLIFSVIVLFTTVKMIRNILEVLMESTPREIDATRLESGLREMEGVVAVHELHIWAITVGKVLLACHVTITQDADADQMLDKVIGYIKAEYNISHVTIQIERE

SEQ ID NO: 8948 - protein, 419 aa, Brachypodium distachyon
MDGHDSAVPHIPEVTLDITPASGAAGNKMCRGAACDFSDSNNTSKDAQERSASMRKLLIAVILCVIFMAVEVVGGIKANSLAILTDAAHLLSDVAAFAISLFSLWAAGWEATPQQSYGFFRIEILGALVSIQLIWLLAGILVYEAIMRLITESGEVQGSLMFAVSAFGLFVNIIMAVLLGHDHGHGGHGHSHGHSHGHSHDHDHDNSGDHHTHHGDHEEGHVHHHEHSHGSSITITTRQHSHSSTGQHQGAEEPLLKHDGDCESAQPGGKAAKKRNINVHSAYLHVIGDSIQSVGVMIGGALIWYKPEWKIIDLICTLIFSVIVLFTTIKMIRNILEVLMESTPREIDATRLENGLREMEGVIAVHELHIWAITVGKVLLACHVTITQEANADQMLDKVIGYIKAEYNISHVTIQIERE

SEQ ID NO: 8949 - protein, 420 aa, Avena sativa
MDSHNHSPLHVPEVTMDISSASGAAGNKACRGAACDFSDTSNTSKDAKERSASMRKLLIAVILCVIFMAVEVVGGIKANSLAILTDAAHLLSDVAAFAISLFSLWAAGWEATPQQSYGFFRIEILGALLSIQLIWLLAGILVYEAINRLLTESGEVQGSLMFAVSAFGLFVNIIMAVLLGHDHGHGGHGHSHGHDHGHSHDHDHGHSEDDHSHHEDHEQGHVRHEHSHGTSITVTTHQHSHSSSGLHNDAEEPLLKHDGDCESAQTDAKAAKKPRRNINVHSAYLHVIGDSIQSIGVMIGGGLIWYKPEWKIIDLICTLIFSVIVLFTTVKMIRNILEVLMESTPRRDRCHQARECLREMEGVIAVHELHIWAITVGKVLLACHVTITQDADADQMLDKVIGYIKAEYNISHVTIQIERE

SEQ ID NO: 8950 - protein, 78 aa, Secale cereale
MDSHTSSPHHEVTMDISSASASKMCRGASCDFADSANTSKDAKERSASMRKLLIAVILCVIFMAVEVVGGIKATALRS

SEQ ID NO: 8951 - protein, 456 aa, Setaria italica
MGTKNLSRKHPASMATASATLLLSLALLASAAASSPSSDADAISRFQEYLRIDTAQPAPDYAAAVAFLRGQASEAGLEARTLELVAGKPLLLLRWPGRRSSLPSILLNSHTDVVPSEPHKWDHPPFSAALDEASGRIYARGSQDMKCVGMQYLEAIRRLRSAGFVPDRNIYIIFVPDEEIGGHEGVELFVSSKEFKEMNVGLVLDEGLASPGEEYRVFYAERSPWWLTIKAKGAPGHGAKLYDGSAMENLMKSVEVIRRFRTSQFDLVKSGEKAEGDVVSVNFAYLKAGTPTPTGFVMNLQPSEAEVGLDIRIPPSAHVEALERRLVEEWAPSSRNLTFEFKQKMSVLDNFGKPAITPADSTNPWWLLLEEAVKSAGGKLGKPEIFPASTDARYFRQIGLPAFGFSPMANTPILLHDHNEFLRKDEYLKGIGIYESIIRALATHKDGGKDNDRAEL

SEQ ID NO: 8952 - protein, 444 aa, Pennisetum glaucum
MATASTTLLLCLAFLASAAAASPSSDADAISRFQEYLRIDTAQPAPDYAAAVAFLRDQASEAGLGARTLELVAGKPLLLLLWPGRRPSLPSILLNSHTDVVPSEPHKWDHPPFSAAVDEASGRIYARGSQDMKCVGMQYLEAIRRLRAGGFVPDRNIYITFVPDEEIGGHDGVEAFVASKEFKDLNVGLVLDEGLPSPGEGYRVFYAERSPWWLTIKATGAPGHGAKLYDGSAMENLMKSVEAIRRFRTSQFDLVKSGEKAEGDVVSVNFAYLKAGTQTPTGFVMNLQPSEAEVGLDIRMPPDVHTEALERRLVEEWAPSSRNMTFEFKQKGSVLDDFGKPAFTPADNSNPWWRVFEEAVKKAGGKLGKPEVFPASTDARYFRKIGLPAFGFSPMENTPVLLHDHNEFLTKDEYLKGIGIYESVIRELATHKQDARDDESRAEL

SEQ ID NO: 8953 - protein, 446 aa, Zea mays
MATASTTLLLSLAFLAFAWAASPSPSPDAEAISRFQEYLRIDTAQPAPDYAAAVAFLRKQAADAGLEARTLELVAGKPLLLLRWPGRRPSLPSILLNSHTDVVPSEPNKWDHPPFSAALDEPSGRIYARGSQDMKCVGMQYLEAIRRLRSAGFVPDRNIYITFVPDEEIGGHGGVEPFVSSKEFKDMNVALVLDEGLASPGEEYRVFYAERSPWWLTIKATGAPGHGAKLYDGSAMENLMKSVEAIRRFRTSQFDLVKSGEKAEGDVVSVNFAYLKAGTPTPTGFVMNLQPSEAEVGLDIRIPPSAHVEALERRLVEEWAPPSRNLTFEFKQKMSVLDNFGKPAMTAADSTNPWWTLLEEAVKSADGKLGKAEIFPASTDARYFRKIGLPAFGFSPMANTPILLHDHNEFLSKDEYLKGIGIYESIIRALATHEDGGKDDESRAEL

SEQ ID NO: 8954 - protein, 444 aa, Panicum virgatum
MATASATLLLSLALLASAAAASPSSGAGAISRFQEYLRIDTAQPAPDYAAAVAFLRGQASEAGLEARTLELAAGKPLLLLRWPGRRPSLPSILLNSHTDVVPSERQKWDHPPFSAALDEASGRIYARGSQDMKCVGMQYLEAIRRLRSAGFVPDRNIYITFVPDEEIGGHGGVELFVSSKEFKEMNVGLVLDEGLASPGDEYRVFYAERSPWWLTIKAKGAPGHGAKLYDGSAMENLMKSVEAIRRFRTSQFDLVKSGEKAEGDVVSVNFAYLKAGTPTPTGFVMNLQPSEAEVGLDIRIPPSAHVEALERRLVEEWAPSSRNLTFEFKQKMSVLDNFGKPAMTPADSTNPWWLLLEEAVKSAGGKLGKPEIFPASTDARYFRQIGLPAFGFSPMANTPILLHDHNEFLHKDEYLKGIGIYEYIIKALATHKDSVKDDESRAEL

SEQ ID NO: 8955 - protein, 444 aa, Panicum virgatum
MATAPTALLLSLTLLASAAAASPSSDADAISRFQEYLRIDTAQPAPDYAAAVAFLRGQASEAGLEARTLELAAGKPLLLLRWPGRRPSLPSILLNSHTDVVPSEPQKWDHPPFSAALDEASGRIYARGSQDMKCVGMQYLEAIRCLRSAGFVPDRNIYITFVPDEEIGGHEGVELFVSSKEFKEMNVGLVLDEGLASPGEEYRVFYAERSPWWLTIKAKGAPGHGAKLYDGSAMENLIKSMEAIRRFRTSQFNLVKSGEKAEGDVVSVNFAYLKAGTPTPTGFVMNLQPSEAEVGLDIRIPPSAHVEALERRLVEEWAPSSRNLTCEFKQKMSVLDNFGKPAMTPADSTNPWWLLLEEAVKSAGGKLGKPEIFPASTDARYFRQIGLPAFGFSPMANTPILLHDHNEFLHKDEYLKGIGIYESIIRALATHKDGAKDDESRAEL

SEQ ID NO: 8956 - protein, 439 aa, Echinochloa colona
MAMASTTLLLSLALLASAASASSSSDADAISRFQEYLRIDTAQPSPDYAAAVAFLRDQAAAAGLEARTLELVAGKPLLILRWPGRRPSLPSILLNSHTDVVPSEPHKWDHPPFSAALDEASGRIYARGSQDMKCVGMQYLEAILRLRSAGFVPDRNIYLTFVPDEEIGGHEGVELFVSSKEFKEMNVGLVLDEGLASPGEEYRVFYAERSPWWLTIKAKGAPGHGAKLYDGSAMENLMKSVEAIRRFRTSQFDLVKSGEKAEGDVVSVNFAYLKAGTPTPTGFVMNLQPSEAEVGLDIRIPPSAHVEALERRLVEEWAPSSRNLTFEFKQKMSVLDNFGKPAMTPVDSTNPWWLLLEEAIKSAGGKLGKPEIFPASTDARYFRQIGLPAFGFSPMANTPILLHDHNEFLRKDEYLKGIGVYESIIRVLTTQKDGAKDEL

SEQ ID NO: 8957 - protein, 457 aa, Oryza sativa
MASKKSSTQASPMAAAAASLLLGLLLVLPVPAVSSSDAEEAVVSRFREYLRIDTAQPAPDYAAAVAFLRGQAGAAGLEARTLELVAGKPLLLLRWPGRRPSLPSLLLNSHTDVVPSEPHKWDHPPFSAALDEASGRIYARGSQDMKCVGMQYLEAIRRLRSAGFIPDRNIYLTFVPDEEIGGHEGIEAFVASKEFKDMNVGLVLDEGLASPGEEYRVFYGERSPWWLTIKAKGAPGHGAKLYDGSAMENLMKSVEAIRRFRTSQFDLVKSGAKAEGDVVSVNFAYLKAGTPTPTGFVMNLQPSEAEIGLDIRLPPSVHTEALEKRLAEEWAPSSRNLTFEFKQKTSVLDNFGKPAVTPADSSNVWWALFEEAVKRAGGKLGKPEIFPASTDARYFRVLGIPAFGFSPMTNTPILLHDHNEFLSKDEYLKGIGIYESIIRTLATLKDSNVDYESRAEL

SEQ ID NO: 8958 - protein, 444 aa, Hordeum vulgare
MAGLTKIFLPLLLLLSVAAAASPSSDAEAVSRFQEYLRIDTAQPTPDYAAAVAFLRDQAAPAGLEARTLEFAAGKPLLLLRWPGRRPSLPSILLNSHTDVVPSEPKKWEHAPLSATLDEASGRIYARGSQDMKCVGMQYLEAIRRLRNAGFVPDRNIYIIFVPDEEIGGHEGVELFVASKEFKELNVGLVLDEGLASPGEEYRVFYAERSPWWLTIKAKGAPGHGAKLYDGSAMENLMKSVEALRRFRTAQFDLVKSGEKAEGDVVSVNFAYLKAGTPTPTGFVMNLQPSEAEVGIDIRIPPSVHTEALEKRLAEEWAPCSRNLTFEFKQKGSVLDKFGKPAMTIADSSNPWWPVFEESVKRAGGKLGKPEIFPASTDARYFREIGIPAFGFSPMANTPVLLHDHNEFLSKDEYLKGIGIYESIIKALATHKDDGIDEESRAEL

SEQ ID NO: 8959 - protein, 444 aa, Triticum aestivum
MAGLTKILLPLLLLLSVAAAASPSSDAEAVSRFQEYLRIDTAQPTPDYAAAVAFLRDQAAAVGLEARTLEFAAGKPLLLLRWPGRRPSLPSILLNSHTDVVPSEPKKWEHAPLSATLDEASGRIYARGSQDMKCVGMQYLEAIRRLRNAGFVPDRNIYIIFVPDEEIGGHEGVELFVASKEFKELNVGLVLDEGLASPREEYRVFYAERSPWWLTIKAKGAPGHGAKLYDGSAMENLMKSVEALRRFRTAQFDLVKSGEKAEGDVVSVNFAYLKAGTPTPTGFVMNLQPSEAEVGIDIRIPPSVHTEALEKRLAEEWAPSSRNLTFEFKQKGSVLDKLGKPAMTIADSSNPWWPVFEESVKRAGGKLGKPEIFPASTDARYFREIGIPAFGFSPMANTPVLLHDHNEFLSKDEYLKGIGIYESIIKALATHKDDGIDEESRAEL

SEQ ID NO: 8960 - protein, 445 aa, Brachypodium distachyon
MAGFTGTLLPLLLLLSAAAAAAASPAPSDAVSRFQEYLRIDTAQPAPDYAAAVAFLRDQAAAAGLEARTLEPAAGKPLLVLRWLGRRPSLPSILLNSHTDVVPSEPKKWEHAPFSAALDEASGRIYARGSQDMKCVGMQYLEAIRRLRDAGFVPDRNIYITFVPDEEIGGHEGVELFVTSKEFKEMNVGLVLDEGLASPGEEYRVFYAERSPWWLIIKAKGAPGHGAKLYDGSAMENLMKSVEAIRRFRTSQFDLVKSGEKSEGDVVSVNFAYLKAGTPTPTGFVMNLQPSEAEIGIDIRMPPNVHIEALERRLAEEWAPSSRNLTFEFKQKGTVFDNFGKPAMTLADSSNPWWPVFEEAVKRAGGKLSKPEIFPASTDARYFRQIGIPAFGFSPMANTPILLHDHNEFLSKDEYLKGIEIYKSIIKALATHKGDEVDEESRAEL

SEQ ID NO: 8961 - protein, 430 aa, Lolium multiflorum
LFSAAAASPSSDAEAVSRFQEYLRIDTAQPAPDYAAAVAFLRDQAAAAGLEARTLEPAAGKPLLLLRWPGRRPALPSILLNSHTDVVPSEPKKWEHGPFSAALDEASGRIYARGSQDMKCVGMQYLEAIRRLRDAGFVPDRNIYITFVPDEEIGGHEGVEPFVASKEFKELNVGLVLDEGLASPGEEYRVFYAERSPWWLTIKAKGAPGHGAKLYDGSAMENLMKSVEAIRRFRTAQFDLVKSGEKAEGDVVSVNFAYLKAGTPTPTGFVMNLQPSEAEVGIDIRIPPSVHTEALERRLVEEWAPASRNLSFEFKQKGSVLDNFGKPAMTTADSSNPWWPVFEEAVKRAGGKLGKPEIFPASTDARYFRELGIPAFGFSPMANTPILLHDHNEFLSKDEYLKGIGIYEYIIKALATHKDDTIDSESRAEL

SEQ ID NO: 8962 - protein, 463 aa, Secale cereale
TLIATTSSGGARARCGSLPWLDSPRFFLPLLLLLSVAAAASPSSDVEAVSRFQEYLRIDTAQPTPDYAAAVSFLRDQAAAVGLEARTLELAAGKPLLLLRWPGRRPSLPSILLNSHTDVVPSEPKKWEHAPLSATLDEASGRIYARGSQDMKCVGMQYLEAIRHLRNAGFVPDRNIYIIFVPDEEIGGHEGVELFVASKEFKELNVGLVLDEGLASPGEEYRVFYAERSPWWLTIKAKGAPGHGAKLYDGSAMENLMKSVEALRRFRTAQFDLVKSGEKAEGDVVSVNFAYLKAGTPTPTGFVMNLQPSEAEVGIDIRIPPSVHTEALEKRLAEEWAPSSRNLTFEFKQKGSVLDKLGKPAMTIADSSNPWWPVFEESVKRAGGKLGKPEIFPASTDARYFREIGIPAFGFSPMANTQVLLHDHNEFLSKDEYLKGIGIYESIIKALATHKDDGIDEESRAEL

SEQ ID NO: 8963 - protein, 311 aa, Saccharum officinarum
MACSTASLAATLLAFALMFRACLAGRRLTALVQEPAITMKYHKGALLSGPIAVNFIWYGDFSAPQRAVITDFVSSLSAAPAAAQPEPSVATWFKTARKYYASSKVRFPALRLGSHVIDQNCSLGKRLTERDLLRLAAKGSPSRAINLVLTAADVAVDGFCMSRCGTHGASPRSRSGRFAYVWVGNPASQCPGQCAWPFHQPVYGPQSAPLTPPNGDVGVDGMVISLASMIVGTVTNPFGNGFYQEGSADAPLEAATACAGVYGKGAYPGYAGSLLVDQASGASFNANGAHGRKYLVPALVDPDTSSCATLG

SEQ ID NO: 8964 - protein, 314 aa, Zea mays
MACYNTASLAATLLAFALTFQACLAGRRLTALVQEPAITMRYHKGALLSGPIAVNFIWYGDFSAPQRAAITDFVSSLTAAAPAAAQPEPSVATWFKTARKYYASSKVPFPALRLGSHAVDRNCSLGRRLTERDLLRLAARGAPSRAINLVLTAADVAVDGFCESRCGTHGASPRSRSGRFAYVWVGNPASQCPGQCAWPFHQPVYGPQAAPLTPPNGDVGVDGMVISLASMLVGTVTNPFGNGFYYQEGSADAPLEAATACAGVYGKGAYPGYAGSLLVDQASGASFNANGAHGRKYLVPALVDLDTSSCATLV

SEQ ID NO: 8965 - protein, 314 aa, Echinochloa colona
MACSTASLAATLLALALMFQACLAGRRLTALVQEPAITMRYHKGALLSGRIAVNFIWYGNFSAPQRAVITDFVSSLSASPAAAAQAQPEPSVATWFKTARKYYANSKARFPALRLGSHVLDSSYSLGKRLTDGDLLKLAAKGSPSRAINVVLTADDVAVDGFCMSRCGTHGASPRSRSGRFAYVWVGNPASQCPGQCAWPFHQPTYGPQAAPLTAPNGDVGVDGMVISLASMIVGTVTNPFGNGFYQEGSADAPLEAATACAGVYGKGAYPGYAGSLLVDQASGASFNANGAHGRKYLVPALVDPDTSSCATLG

SEQ ID NO: 8966 - protein, 312 aa, Setaria italica
MACSTASLAATLLAFALLFQACLAGRRLTALVQEPAITMKYHRGALLSGRIAVNFIWYGNFSAPQRAVITDFVSSLSAPPAAAGQPEPSVATWFKTARKYYANSKARFPALYVGTHVLDSSYSLGKRLTDGDLLKLAAKGAPSRAINVVLTADDVAVDGFCMSRCGTHGASPRSRSGRFAYVWVGNPASQCPGQCAWPFHQPVYGPQAAPLTPPNGDVGADGMVISLASMIVGTVTNPFGNGFYQEGSADAPLEAATACAGVYGKGAYPGYAGSLLVDQASGASFNANGAHGRRYLVPALVDPDTSSCATLG

SEQ ID NO: 8967 - protein, 311 aa, Panicum virgatum
MACSTASLAATLLAFALLFQACLAGRRLTALVQEPAITMKYHKGALLSGRIAVNFIWYGNFSAPQRAVITDFVSSLSAAPAAGQPEPSVATWFGTARKYYASSKARFPALRVGSHVLDASYSLGKRLTDGDLLKLAARGAPSRAINVVLTADDVAVDGFCMSRCGTHGASPRSRSGRFAYVWVGNPATQCPGQCAWPFHQPVYGPQAAPLTPPNGDVGADGMVISLASMIVGTVTNPFGNGFYQEGSADAPLEAATACAGVYGKGAYPGYTGSLLVDQASGASFNANGAHGRRYLVPALVDPDTSSCATLG

SEQ ID NO: 8968 - protein, 315 aa, Zea mays
MACSTASLAATLLAFALMFQACVAGRRRLTALVQEPAITMKYHKAALLSGPIAVNFIWYGDFTAPQRAVITDFVSSLSAAPRAAAQSQPEPSVSTWFKTARKYYDTSKARFPALRLGSHAVDRNCSLGRRLTERDLLRLAARGAPSRAINLVLTAADVAVDGFCASRCGTHGASPRSRAGRFAYVWVGNPASQCPGQCAWPFHQPVYGPQAPPLTPPNADVGVDGMVISLASMIVGTVTNPFGNGFYQEGSADAPLEAATACAGVYGKGAYPGYAGALLVDPASGASFNANGAHGRKYLVPALVDPDTSSCATLG

SEQ ID NO: 8969 - protein, 311 aa, Oryza sativa
MAASSAAFAACLLACALLFQMCVASRKLTALVQDQPITMTYHKGALLSGRIAVNLIWYGNFSAPQRAVITDFVSSLSTPPSPQPQPEPSVASWFKTAQKYYANSKARFPALSLGQHVLDQSYSLGKRLGEKDLVRLAARGSPSRAINVVLTADDVAVDGFCMSRCGTHGASPRSRAGRFAYVWVGNPATQCPGQCAWPYHQPVYGPQAAPLTPPNGDVGVDGMVISLASMIVGTVTNPFGNGFFQGDADAPLEAATACAGVYGKGAYPGYAGSLLVDPASGASYNANGAHGRKYLVPALVDPDTSACSTVG

SEQ ID NO: 8970 - protein, 311 aa, Triticum aestivum
MASFGSMAVALVVCAMLLQTCAATRRLQALVQEQPITMKYHKGALLSGRIAVNLVWYGNFSAPQRAIVTDFVSSLASASPAPAPQPEPSVATWFKTAQKYYASSKARFPALALGSHVFDRSYSLGRRLRERDLVRLAARGGPSRAINVVLTADDVAVDGFCMSRCGSHGASPRSRAGRFAYVWVGNPATQCAGQCAWPFHQPQYGPQTAPLAPPNGDVGVDGMVVSLASMIVGTVTNPFGNGFFQGPAEAPLEAATACAGVYGKGAYPGYAGSLLVDPATGASFNANGAHGRKYLVPALVDPDTSACSTLG

SEQ ID NO: 8971 - protein, 310 aa, Leymus cinereus x Leymus triticoides
MASFSSMAVALLVCAMLLQTCLATRRLTALVQDQPITIKYHKGALLSGRIAVNLVWYGNFSAPQRAIITDFVSSLSASPAPQPQPEPSVATWFKTAHKYYASSKARFPALALGSHVFDQSYSLGRRLREKDLVRLAARGGPSRAINVVLTADDVTVDGFCMSRCGSHGASARSRAGRFAYVWVGNPATQCPGQCAWPFHQPQYGPQTAPLAPPNGDVGVDGMVVSLASMVVGTVTNPFGNGFFQGPAEAPLEAATACAGVYGKGAYPGYAGSLLVDPATGASFNANGAHGRKYLVPALVDPDTSACSTLG

SEQ ID NO: 8972 - protein, 315 aa, Hordeum vulgare
MAASFSSSVAVAVAVMVCAMLVQTCVATRRLTALVQDPPITMKYHKGALLSGRIAVNLVWYGNFSAPQRAIVTDFVSSLSSASPAAAPQPEPSVATWFKTAQKYYASSKARFPALALGSHVLDQSYSLGKRLRERDLVRLAARGGASRAINVVLTADDVAVDGFCTSRCGSHGASPRSRAGRFAYVWVGNPASQCAGHCAWPFHQPQYGPQTAPLAPPNGDVGVDGMVVSLASMIVGTVTNPFGNGFFQGPAEAPLEAATACAGVYGKGAYPGYAGSLLVDPATGASFNANGAHGRKYLVPALVDPDTSACSTLG

SEQ ID NO: 8973 - protein, 310 aa, Pseudoroegneria spicata
MASFSSSVAVALLVCAMLLQTCVATRRLQALVQDQPITMKYHKGALLSGHIAVNLVWYGNFSAPQRAIVTDFVSSLSSASPAPQPEPSVATWFKTAQKYYASSKARFPALALGHHVFDQSYSLGKRLRERDLVRLAARGGPSRAINVVLTADDVAVDGFCMSRCGSHGASARSRAGRFAYVWVGNPATQCAGQCAWPFHQPQYGPQTAPLAPPNGDVGVDGMVVSLASMIVGTVTNPFGNGFFQGPAEAPLEAATACAGVYGKGAYPGYAGSLLVDPATGGSFNANGAHGRKYLVPALVDPDTSACSTLG

SEQ ID NO: 8974 - protein, 309 aa, Secale cereale
MASLSSMAVALLVCAMLLQTCVATRRLTALVQEQPITMKYHKGALLSGRITVNLVWYGNFSAPQRAIVTDFVSSLTSAASPAQPEPSVATWFKTAQKYYASSKARFPALALGSHVLDQSYSLGRRLREKDLVRLAARGGPSRAINVVLTADDVAVDGFCMSRCGSHGASARSRAGRFAYVWVGNPATQCAGQCAWPFHQPQYGPQTAPLAPPNGDVGVDGMVVSLASMIVGTVTNPFGNGFFQGPAEAPLEAATACAGVYGKGAYPGYAGSLLVDPATGASFNANGAHGRKYLVPALVDPDTSACSTLG

SEQ ID NO: 8975 - protein, 393 aa, Saccharum officinarum
MGELIPGLPEEVARECLVRVGFDQLPVVRRISRQWKSEVESPDYHRQRRAEGLARPVLALVQAQPTAPPADDGAGGPVDKHSTAAGSGGPANSYRMVLLDPVEGRWAPLPPLPWPSESLPLFCQVAAVDGGGGQGQGRKRLVVVGGWHPETWAPTDAVFVYDFLTGAWRRGAPMPGPRRSFFACAAVGGAVYVAGGHDDEKNALRSALAYDPEADAWAQLPDMAEERDEPRGLCAAAGGSSRFLVVGGYPTQAQGRFVGSAECFDPATSTWAPVDLMIEDGVCPRTCCAAPGPGPSERMYMLSRDGNLVARDGAASASAWRPVAQVPEDARTAATVSAIPDGRVVVIGSGCHGGDQTVYVLREEPGKGASSWTRAPAPPEFSGHVQASCFLEI

SEQ ID NO: 8976 - protein, 385 aa, Panicum virgatum
MGELIPGLPEEVARECLVRVGFDQLPVVRRISRQWKSELESPDYHRLRRAEGLARPVLALVQASPAPPADGDAGTAADKQRSSAAGPANSYRMVLLDPEEGRWAPLPAPPGPAGSLPLFCQVAAVGGGGQGRKRLVVVGGWDPETWAPVDAVLVYDFLTGAWRRGAPMPGPRRSFFACAAVGGAVYVAGRPRRGEERAAVGAGVRPGARRVVVAPRHGGGARRAARALRRRQVPRRRRVPDAGAGPLRRLRGGLRPGGVGLGARRGRPARGRRVPEDLLRGAGAGGAPVHAPRRAPRGARRCRAGRGVAAGGAGARGRAHRGDRLRHPRRPRGGDRLRVPRRRQERVRAPRGGRQGRVLGARGGAARVRRARAGLLLPRNLMKCT

SEQ ID NO: 8977 - protein, 195 aa, Zea mays
MAAAARAIICELAPQKVSSTASGPAAPKKRDAGTKVVLQPRLCTLRSYGAGSGVVTRRILAGEEDGSGAADSGGSAALPFFASLADYIESSRKSQDFETISGRLAMVAFAAAVAVETATGSSLFKKLDTMEIEEAAGVCVAVVASAAAFAWASSARNRIGQMFTLGCNAFVDSLIDNIVEALFSESELQDWSDDI

SEQ ID NO: 8978 - protein, 190 aa, Zea mays
MAAAARAIICELAPQKVSSTAPKKRDAGTKVVLQPRLCTLRSYGAGSGVVTRRILTGEEDGSGAADSGGSSASPFFASLANYIESSRKSQDFETISGRLAMVAFAAAVAVETTTGSSLFKKLDTMEIEEAAGVCVAVVACAAAFAWASRARNRIGQMFTLGCNAFVDSLIDNIVEALFSEGELQDWSDDM

SEQ ID NO: 8979 - protein, 196 aa, Setaria italica
MAAAARAIVCELAPQKVAAAAAVPAPPKKRDAGKVVLQPRLCTLRSYGAGSGVVTRRILAGEEDGSGAADSAGGSGAASPFFASLADYIESSRKSQDFETISGRLAMVAFAAAVAVELTTGSSLFKKLDAMEIEEAAGVCVAVVACAAAFAWASSARNRIGQMFTLGCNAFVDSLIDNIVEALFSEGEPQDWSDDI

SEQ ID NO: 8980 - protein, 192 aa, Panicum virgatum
MAAAARAIICELAPEKVASSVPAPPKKRDAGKAVLQPRLCTLRSYGAGSGVVTRRILTGAEEGSGAADSGGSAASPFFASLADYIESSRKSQDFETISGRLAMVAFAAAVAVELTTGSSLFKKLDTMEIEEAAGLCVAVVACAAAFAWASSARTRIGQMFTLGCNAFVDSLIDNIVEALFSESELQDWSDDI

SEQ ID NO: 8981 - protein, 191 aa, Echinochloa colona
MAAAARAIVCELVPQKAAAVPAPAKRRDAGKVVLQPRLCTLRSYGAGSGVVTRRILAGEEEGSGVADSGGSAASPFFASLADYIESSRKSQDFETISGRLAMVAFAAAVAVELTTGSSLFKKLDTMEIEEAAGVCVAVVAGAAAFAWASSARNRIGQMFTLGCNAFVDSLIDNIVEALFSEGELQDWSDDI

SEQ ID NO: 8982 - protein, 169 aa, Pennisetum glaucum
MDAGAGAGSGNASGGAGASACCYYAMLGIRKNASATDIRTAYRRLAMKWHPDRWASDPGAAGEAKRRFQRIQEAYSVLSDKGKKAMYDAGLFDPLDDDDQDFSDFMQEMLVMMDNVKNEKPDTLEDLQKMLEDIVKGDDGSRGGGGRVPPDGARRARVAPYPQQQAQRR

SEQ ID NO: 8983 - protein, 112 aa, Panicum virgatum
MAAAARAIICELAPEKVASVPAPPKKRDAGKAVLQPRLCTLRSYGAGSGVVTRRILTGAEDGSGAADSGGSAASPFFASLADYIESSARARTSRPSPAASPWWLSWRPWRWS

SEQ ID NO: 8984 - protein, 368 aa, Zea mays
MAPQSRLLPPLLQVLRRCRASRSHFSTAPSLVSPPSKAVVYDEHGLPEQVLRLVDVPPAEIGDRDVCVRMMAAPINPSDINRIEGVYPVRPPLPAAVGGYEGVGQVHALGPAVTARLSPGDWVIPSPPSFGTWQTYITKHENVWHKVRSDVPMEYAATITVNPLTALRMLQDFVKLNPGDAIVQNGATSIVGQCVIQLAKVHGIHTINIIRDRPGSEEAKNKLKQLGADEVFTETQLDMKNVKSLLGALPEPALGFNCVGGNAASLILKLLKQGGTMVTYGGMSKRPVTVPTSYFIFKDLSLRGFWLQKWLNSDKTEDCRRMIDYLLGLVHEGKLKYEMESISFGEFSLALEKALGKHGSQPKQVIKF

SEQ ID NO: 8985 - protein, 368 aa, Panicum virgatum
MAPPSRLLPPMLQILRRRCASRCHFSTAPSLVSPPSKAVLYDEHGAPDQVLRVVDVPPVHLGDRDVCVRMLAAPINPSDINRIEGVYPVRPPLPGAVAGYEGVGQVHALGPAVTAPLSPGDWVIPSPPSFGTWQTYIVKHESVWHKVRSDVPMEYAATVTVNPLTALSMLQDFVKLNPGDAIVQNGATSIVGQCVIQLAKVHGIHTINIIRDRPGSEEAKDKLKLLGADEVFMESQLGMKNVKSLLGALPEPALGFNCVGGNAASLLLKFLRQGGTMVTYGGMSKRPVTIPTSYFIFKDISLRGFWLQRWMNSDKAEDCRTMIDYLLGLVHEGKLKYEMEAIPFGEFSLALEKALGKHGSQPKQVMRF

SEQ ID NO: 8986 - protein, 366 aa, Setaria italica
MAPPSRLLPATLQILRRRCASRFSTASSLVSPPSKAVLYDEHGAPDQVLRVADVPPVHLGDRDVCVRMLAAPINPSDINRIEGVYPIRPPLPGAVGGCEGVGQVHALGPAVTAPLSPGDWVIPSPSSFGTWQTYIVKNESVWHKVRSDVPMEYAATVTVNPLTALRMLRDFVQLNPGDAIVQNGATSIVGQCVIQLAKVHGIHTINIIRDRPGSEEAKGKLKQLGADEVFTESQLDMKNLKSLLGAFPEPALGFNCVGGNAASLVLKFLRQGGTMVTYGGMSKRPVTVPTSYFIFKDISMRGFWLQKWMNSDKAEDCRTMIDYLLGLVHEGKLKYEMESIPFSEFSLALEKALGKHGSQPKQVVRF

SEQ ID NO: 8987 - protein, 366 aa, Pennisetum glaucum
MAPPSRLLPATLQILRRRCASRFSTASSLASPPSKAVLYDEHGAPDQVLRVADVPPVHLGDRDVCVRMLAAPINPSDINRIEGVYPIRPPLPGAVGGYEGVGQVHALGPAVTAPLSPGDWVIPSPASFGTWQTYIVKHESVWHKVRSDVPMEYAATVTVNPLTALRMLQDFVQLNPGDAIVQNGATSIVGQCVIQLAKVHGINTINIIRDRPGSEEAKYKLKQLGADEVFTESQLDMKNLKSLLGALPEPALGFNCVGGNAASLVLKFLRQGGTMVTYGGMSKRPVTAPTSYFIFKDISLRGFWLQKWMNSDKAEDCRAMIDYLLGLVHEGKLKYEMESIPFDEFSLALEKALGKHGSQPKQVVRF

SEQ ID NO: 8988 - protein, 366 aa, Setaria italica
MAPPSRLLPATLQILRRRCASRFSTASSIVSPPSKAVLYDEHGAPDQVLRVADVPPVHLGDRDVCVRMLAAPINPSDINRIEGVYPIRPPLPGAVGGCEGVGQVHALGPAVTAPLSPGDWVIPSPSSFGTWQTYIVKNESMWHKVRSDVPMEYAATVTVNPLTALRMLRDFVQLNPGDAIVQNGATSIVGQCVIQLAKVHGIHTINIIRDRPGSEEAKGKLKQLGADEVFTESQLDMKNLKSLLGALPEPALGFNCVGGNAASLVLKFLRQGGTMVTYGGMSKRPVTAPTSYFIFKDISMRGFWLQKWMNSDKAEDCRTMIDYLLGLVHEGKLKYEMESIPFSEFSLALEKALGKHGSQPKQVVRF

SEQ ID NO: 8989 - protein, 361 aa, Panicum virgatum
MAPPSRLLPPTLQILRLRCHLSTVVSPPSKAVLYDEHGAPEQVLRVADAPPVHLGDRDVCVRMLAAPINPSDINRIEGVYPVRPPLPGAVGGYEGVGQVHALGPAVTAPLSPGDWVIPSPPSFGTWQTYIVKHQSVWHKVRSDVPMEYAATATVNPLTALRMLQEFVKLNPGDAIVQNGATSIVGQCVIQLAKLHGIHTINIIRDRPGSEEAKDKLKQLGADEVFMESQLDMKNVKSLLGALPEPALGFNCVGGNAASLLLKFLRQGGTMVTYGGMSKRPVTVPTSYFIFKDISLRGFWLQRWMNSDKAEDCRTMIDYLLGLVHEGKLKYEMELIPFGEFSLALEKALGKHGSQPKQVMRF

SEQ ID NO: 8990 - protein, 366 aa, Triticum aestivum
MASALRLLPSTATRLRFRPRLPLSTAASLFSPPSKAVLYDQHGPPDQVLRVEDVPPVELGERGVCVKMLAAPINPSDINRVQGVYPVRPPLPAAVAGYEGVGQVHAVGPAVTRPLSPGDWVIPSPPSFGTWQTYIVKPEDVWHKVRDDVPVEYAATVTVNPLTALRMLQDFVKLKPGDAIVQNGSTSIVGQCVIQLAKVQGIRTINIIRDRPGSEEAKEKLKQLGADEVFTESQLDVKNVKSLLGALPEPALGFNCVGGNAASLILKLLRQGGTMVTYGGMSKKPVTVSTSSFIFKDLSLRGFWLQKWMNSDKSEECRTMIDYLLGLVHEGKLKYEMELTPFSEFNMALDKALGKHGSQPKQVLRF

SEQ ID NO: 8991 - protein, 363 aa, Pseudoroegneria spicata
ALRLLPSTATRLRFRPRLPFSTAASLFSPPSKAVLYDQHGPPDQVLRVEDVPPVELGERGVCVKMLAAPINPSDINRVQGVYPVRPPLPAAVAGYEGVAQVHAVGPAVTRPLSPGDWVIPSPPSFGTWQTYIVKPEDVWHKVRDDVPVEYAATVTVNPLTALRMLQDFVKLKPGDAIVQNGSTSIVGQCVIQLAKVQGIRTINIIRDRPGSEEAKEKLKQLGADEVFTESQLDVKNVKSLLGALPEPALGFNCVGGNAASLILKLLRQGGTMVTYGGMSKKPVTVSTSSFIFKDLSLRGFWLQKWMNSDKSEECRTMIDYLLGLVQEGKLKYEMELTPFSEFDLALAKALGKHGSQPKQVLRF

SEQ ID NO: 8992 - protein, 366 aa, Secale cereale
MASALRLLPSTATRLRFRPRLPLSTAASLFSPPSKAVLYDQHGPPDQVLRVEDVPPVELGERGVCVKMLAAPINPSDINRVQGVYPVRPPLPAAVAGYEGIGQVHAVGPAVTRPLSPGDWVIPSPPSFGTWQTYIVKPEDVWHKVRDDVPVEYAATVTVNPLTALRMLQDFVKLKPGDAIVQNGSTSIVGQCVIQLAKVQGVRTINIIRDRPGSEEAKEKLKQLGADEVFTESQLDVKNVKSLLGALPEPALGFNCVGGNAASLILKLLRQGGTMVTYGGMSKKPVTVSTSSFIFKDLSLRGFWLQKWMNSDKSEECRTMIDYLLGLVQEGKLKYEMELTPFSEFDLALDKALGKHGSQPKQVLRF

SEQ ID NO: 8993 - protein, 366 aa, Hordeum vulgare
MASALRLLPSTATRLRFRPHLPFSTAASLFSPPSKAVLYDQHGPPDQVLRVEDVPPVELGERGVCVKMLAAPINPSDINRVQGVYPVRPPLPAAVAGYEGVGQVHAVGPAVTRPLSPGDWVIPSPPSFGTWQTYIVKPEDVWHKARDDVPVEYAATVTVNPLTALRMLQDFVKLKPGDAIVQNGSTSIVGQCVIQLAKVQGIRTINIIRDRPESEEAKEKLKQLGADEVFIESQLDVKNVKGLLGALPEPALGFNCVGGNAASLILKLLRQGGTMVTYGGMSKKPVTVSTSSFIFKDLSLRGFWLQKWMNSDKSEECRTMIDYLLGLVQEGNLKYEMELTPFSEFDLALDKALGKHGSQPKQVLRF

SEQ ID NO: 8994 - protein, 362 aa, Brachypodium distachyon
MAPPTARLLLRTPRLSLSTAAASLFSPPSKAVLYDQHGPPDQVLRVADVPPVELGERDVCVKMLAAPINPSDINRVQGVYPVRPPVPPAAVAGYEGVAQVHALGPAVTRPLSPGDWVIPSPPSFGTWQTYIVKPEHVWHKVRDDVPVEYAATVTVNPLTALRMLQDFVKLSPGDAVVQNGATSIVGQCVIQLAKVQGIRTINIIRDRPGSEEAKEKLKQLGADEVFTEGQLDVKNVKSLLGALPEPALGFNCVGGNAAALILKLLRQGGTMVTYGGMSKRPVTVSTSSFIFKDLSLRGFWLQKWMSSDKADDCRRLIDYLLGLVQEGKLKYEMELSPFDDFGLALDKALGKHGSQPKQVLRF

SEQ ID NO: 8995 - protein, 919 aa, Zea mays
MPASVAVYPAKMACCLQLHHLRRPSPAPLPARVLFLLSTPRLRPVRASPGPSPPNSFAGWSSDSDSADDGADKSTLGFGRAGGLLGPGLAAFFFLAGITFAAVSIRSSGTHAAGKLQNLPTETAATESYPDYHSHKEDGATREASLPTDWDEEDYDNLDKKEDTDEFLTPLQSNEVPGVPAEGEVGHLLQNTEPVTDGDHVVGEEANQFDNLIASDGNQDPPPPLPILDAAGPSEEIPDVEETSDPKMDLPENQHFDETLTSDAMVLDSDVVPIQDISEGAIAAAFHPEDKGVEQNPQTLDKDELSPSGLPDYMEHVSADGMHPLGSNELSMATRTSETGDGEETIVEDLYKGESELENQNKQLESTPPDQYFSSPGIPAPSVVSTALQVPAGPIVVPASVDPTQENAIAALQILKVIESSAQAGELCTRREYARWLVAASNCLSRNTFSKVYPAMYIDNVTELAFDDVTPEDPDFPFIQGLAEAGLISSKLSRSDMNIPEDVHDNHILFSPESPLSRQDLVSWKMALDKRQLPEVDRNCLFKLSGYIDIDKINTAAWPALAADLDAGDQSITALAFGFTRLFQPNKPVTKGQAALAFSAGDSGEVVLEEVARIEAEKIAEAAVNAHAALVAQVEKDLNASFERELKEERERVETLEKVAEEARVELDRLRAEREEEKNILVRGRAAVESEMEVLLKLRSEVEEQLQNVLSKKVEVSFEKSRIEKLQKEIESDNSAVVQLQYELEVERKALSMARAWAEEEAKKAREHARALEEARNQWERQGIRVVVEGELKDDASAGVTWANAGKENAVDESINQAEALLEKLKTMSGEMEVRSRGAVERVMQHVRSFIAILKQQAADARQWCTEFGACAASRANEVSAQVKGSVSAFGATLGDKSKRAMEECKDGLERISHRFKTD

SEQ ID NO: 8996 - protein, 589 aa, Setaria italica
MESCLHGVVVVSLGLWVFPSSCSDFSVSPDPLPHLPAPRRSPLAAAAAAHGSHPAAGTHPSVWCWVQFLCRNESRRAADWELGRGDEGGMQQLQPKQMHWVRADSSDFGGDRPAPRSGHTAVSIGKSKVVVFGGFADKRFLSDVSVYDVENKLWYTPECTINGSDGQAGPSPRAFHVAVVIDCNMFIFGGRSGGKRLGDFWMLDTDLWQWSEMTGFGDLPSPREFAAASAIGNRKIVMYGGWDGKKWLSDVYIMDTMSLEWTELAVTGSVPPPRCGHSATMIEKRLLIFGGRGGAGLIMGDLWALKGVTEEDNETPGWTQLKLPGQSPSPRCGHSVTSGGPYLLLFGGHGTGGWLSRYDVYYNECIILDRVSVQWKRLPTSNEPPPPRAYHSMTSIGSQFLLFGGFDGKNTFGDLWWLVPEDDPIAKRGLAPNIDSNSRPSTTTGDAQQPNLKESQAVVSPIIELAKRLGIPLSEEVSISSVDEMDDKELVELSSRLAGQSLPASDQVASIQVLRDHWKSSPASSLQLQELGPLLRDYQRLILRRYSGNQSAAFHEMEALRFFHLKSASQLRMDDIPILLREYGRLLST

SEQ ID NO: 8997 - protein, 501 aa, Pennisetum glaucum
MQQLLQPKQMHWVRADSSDFGGEPPAPRSGHTAVSIGKSKVVVFGGFADKRFLSDVSVYDVENKLWYTPECTINGSDGQAGPSPRAFHVAVVIDCNMFIFGGRSGGKRLGDFWMLDTDLWQWSEMTGFGDLPSPREFSAASAIGNRKIVMYGGWDGKKWLSDVYIMDTMSLEWTELAVTGSMPPPRCGHSATMIEKRLLIFGGRGGAGPIMGDLWALKGVTEEDNETPGWTQLKLPGQTPSPRCGHSVTSGGPYLLLFGGHGTGGWLSRYDVYYNECIILDRVSVQWKRLPTSNEPPPPRAYHSMTSIGSRFLLFGGFDGKNTFGDLWWLVPEDDPIAKRDLAPIIDSNSKPSTMTRDAQQSNLKESQAVGSPIIELAKRLGIPLSEEVSTSFVDEVDDKELVELSSRLAGQSLPASDQVASIQVLRDHWRSSPASSLQLQELGPLLRDYQRLILQRYSGDPLVAFHEMEALRFFHLKSASQLRVDDIPILLSEYGRLLST

SEQ ID NO: 8998 - protein, 492 aa, Setaria italica
MHWVRADSSDFGGDRPAPRSGHTAVSIGKSKVVVFGGFADKRFLSDVSVYDVENKLWYTPECTINGSDGQAGPSPRAFHVAVVIDCNMFIFGGRSGGKRLGDFWMLDTDLWQWSEMTGFGDLPSPREFAAASAIGNRKIVMYGGWDGKKWLSDVYIMDTMSLEWTELAVTGSVPPPRCGHSATMIEKRLLIFGGRGGAGLIMGDLWALKGVTEEDNETPGWTQLKLPGQSPSPRCGHSVTSGGPYLLLFGGHGTGGWLSRYDVYYNECIILDRVSVQWKRLPTSNEPPPPRAYHSMTSIGSQFLLFGGFDGKNTFGDLWWLVPEDDPIAKRGLAPNIDSNSRPSTTTGDAQQPNLKESQAVVSPIIELAKRLGIPLSEEVSISSVDEMDDKELVELSSRLAGQSLPASDQVASIQVLRDHWKSSPASSLQLQELGPLLRDYQRLILRRYSGNQSAAFHEMEALRFFHLKSASQLRMDDIPILLREYGRLLST

SEQ ID NO: 8999 - protein, 1634 aa, Brachypodium distachyon
MEQAPSVEVESILFGFYSEEEIKRVSVTRITKADRLDAKNCPVPGGLLDLAMGPINATDTCNTCGQLSGLCPGHFGHIELSKPLFNPLLFGTLRDLLRSTCFSCHRFRLHSEQVRRYTRELELVARGDVARAKNLQDSGVAEEDVEMDEDSSVDQSSPSDRENKTWTSIQLKEAHAIIFKLLKKQVKKCANCDMRSPKVTCQIFGWLKIQDTKGSSVRRKAITDFNLEGDSHRHDSSENGVSGLSDDIIKGSSNQITGLSDDRIKEIPLLATEVESILKDLWENEARFCMLLCDFQQNLSVSEKRRGYEMFFLKSLLVTPNRFRPSTSSSLGIMEHPQNVLLGKVQEANLAVQHDKAHPNHMDIITRWRDLQTSVNLFYDSSKGFGNGDGDGNGIRQLLDKKGGVIRQKMMGKRVNHSCRTVISPDPFLAVNEIGIPPQAALKMTYPENVMPCNAKKLQEAINNGCGIHPGATHYKVNKNMYKLQDDRSKRRAIAKMLPASRGSISQPGKDPKCEFESKVVYRHLQDGDIVLVNRQPTLHKPSMMAHFVRVLPGEKTIRMHYANCSTYNADFDGDEMNVHFPQDEISRAEAMNIVDANKQYIGPRSGDAVRGLIQDHIVSAVLLTKLDTFISREEYSQLVYGSCVSSTRSPCQSGKRVSVMKDGDILELLPPAILKPKPLWTGKQVITTILNHLTKGHPPFTVEKKGKIPVKYLIPKERHGDKDNAKDSEQVLYIHDNELIKGMIDKDQFGNYGIVHTVYELYGAETAGRLLSIFSRLFTLFLQLHGFTCGIDDLLLFQESDKQRTETLMTSEKCSEEVHRKFTCAGDYDEDPLKLQMEVEKVVRRIGESATDTLDKMMLSALNGLQSEVNRRLFPYGLQKPFPRNCLTLMTATGAKGGEVNMTQITSLLGSQDLEGARVPRMISGKSLPCFPPWDTSSRAGGFVSDRFLTGLRPQEYYFHCMAGRNGLIDTAVKTSRSGYLQRCLVKSLESLFVAYDHTVRNVDGSIVQFRYGEDGVDVHKSNFLDKFQDKDMFKELADNRKAVLDRLGRYTGDHMSLQSNYITELPEALTDRATKFLSKDKGRCRHDIKEDELMNLLKAKYLASLVDPGEAVGVILAQSLGEPSTQMTLNTFHFAGRSDVNVTLGMPRIQEILMKASANIATPVMMCPLLEDVTWDDAERLAAKLRGVRLVDIVEGIEVCTVPFYNNNGYVSSLYKLQIKLFPPERYPPQSELTVDECQTALRTVFVDSMEFAIEKHLKLLYRVSGIQETRVKDTESSLSEGPEESEGRPIDGEESGASDGDNENEDDLGTDGEKRKRQENDEMEYDGEDDVEKEDGMNSDPEEETKYELDNDDDLVESGGESEVNDEGHVSDSSNKVGKLEGKLAAGKLKKEVNKTVENLEEQKQAQKGVKRTKLSRTVHVESTGLNFEVHYLLLHNEPHILLSQIAQKTLRSLFVKGSHNNKIDQCKVVWPEKKGDFRGLKTAGVNFDVFWGLQDYLDICKVASNDIHAILRTYGVEAARATIIKEVKAVFEPFGINVNRRHLSLVAEFMTSGGDYRAMSSMGMAQFCTSPFGKMTFEQATRFITEAAFYGEADNLNGPSATISLGKPAKTGTGCFGLLQNFCLEETAVM

SEQ ID NO: 9000 - protein, 494 aa, Triticum aestivum
MHWARAVPSDFGGQAPAPRSGHTAVAIGGSKVVVFGGFADKRFLADIAVYDVENRLWYTPECSGSGPDGQPGPSPRAFHVAVVIDCNMFIFGGRSGGKRLGDFWMLDTDIWQWSEMTGFGDLPSPREFAAASAIGNRKIVMYGGWDGKKWLSDVYVMDTMSLEWTELAVTGSAPPPRCGHSATMIEKRLLIFGGRGGTGPIMGDLWALKGITEEDNETPGWTQLKLPGQSPSARCGHSVTSGGPYLLLFGGHGTGGWLSRYDVYYNECVILDRVSVQWKRLPTSNEPPPPRAYHSMTCIGPRFLLFGGFDGKNTFGDLWWLVPEDDPIAKRDLVPDVGSDSNHSTVTGDAQQSALKESESQSGESPMLELAKQLGIPLSVEPSASFVDEINDKELVELSSRLIGESLPTTDQLACIQALRDHWRSSPSSSIQLQELGPLLRDYQRLIIRRFVENPSPTFLEREDRRLFHLKNASQLRMDDIPILLGEYRTLLST

SEQ ID NO: 9001 - protein, 493 aa, Avena sativa
MHWARADSSDFGGQAPAPRSGHTAVGIGKSKVVVFGGFADKRFLGDIAVYDVENRLWYTPECTGSGPDGHAGPSPRAFHVAVVIDCNMFIFGGRSGGKRLGDFWMLDTDIWQWSEMTGFGDLPSPREFAAASAIGNRKIVMYGGWDGKKWLSDVYVMDTMSLEWTELAVAGSAPPPRCGHSVTMIEKRLLVFGGRGGTGPIMGDLWALKGVTEEDNEAPGWTQLKLPGQSPSARCGHSVTSGGPYLLLFGGHGTGGWLSRYDVYYNECVILDRVSVQWKRLPTSNEPPPPRAYHSMTCIGPRFLLFGGFDGKNTFGDLWWLVPEDDPIAKRDLVPNVDSESNQSTVTSDAQQSALKDSHQSGESPMLDLAKRLGIPLSLEPPASFVDEINDKELMELSSRLVGESLPTTDQPACIQALRDHWRSSPSSSIQLRELGPLLRDYQRLIIRRYVENPSPAFLEREDRRLFHLKNASQLRMDDVPILLSEYRNLLST

SEQ ID NO: 9002 - protein, 494 aa, Secale cereale
MHWARAVPSDFGGQAPAPRSGHTAVAIGGSKVVVFGGFADKRFLADTAVYDVENRLWYTPECSGSGPDGQPGPSPRAFHVAVVIDCNMFIFGGRSGGKRLGDFWMLDTDIWQWSEMTGFGDLPSPREFAAASAIGNRKIVMHGGWDGKKWLSDVYVMDTMSLEWTELAVTGSAPPPRCGHSATMIEKRLLIFGGRGGTGPIMGDLWALKGITEEDNETPGWTQLKLPGQSPSARCGHSVTSGGPYLLLFGGHGTGGWLSRYDVYYNECVILDRVSVQWKRLPTSNEPPPPRAYHSMTCIGPRFLLFGGFDGKNTFGDLWWLVPEDDPIAKRDLVPDVGSDSNHSTVTGDAQQSALKESESQSDESPMLELAKRLGIPLSVEPSASFVDEISDRELVELSSRLIGESLPTTDQLACIQALRDHWRSSPSSSIQLQELGPLLRDYQRLIIRRFVENPSPTFLEREDRRLFHLKNASQLRMDDIPVLLGEYRTLLST

SEQ ID NO: 9003 - protein, 492 aa, Oryza sativa
MHWARADSSDFGGQIPAPRSGHTAVSIGKSKVVVFGGFADKRFLSDIAVYDVENRIWYTPECNGSGSDGQAGPSPRAFHVAIVIDCNMFIFGGRSGGKRLGDFWMLDTDIWQWSELTGFGDLPSPREFAAASAIGNRKIVMYGGWDGKKWLSDVYIMDTMSLEWTELSVTGSVPPPRCGHSATMIEKRLLVFGGRGGAGPIMGDLWALKGVTEEDNETPGWTQLKLPGQSPSPRCGHSVTSGGPYLLLFGGHGTGGWLSRYDVYYNECIILDRVSVQWKLLATSNEPPPPRAYHSMTCIGSRFLLFGGFDGKNTFGDLWWLVPEGDPIAKRDLVPNVDSDSKPSNVTGGAQHSASQESQAGESPMIDLAKRLGISLSLEASASFVDEINDKELIELSSMLFGESPPTGDQHACIQALRDHWTSIPANSIQLQELGPLLRDYQRLILRRYLENSFTSFYEKEVHRFFHLKNASELRMDDIPILLMEYGKLLST

SEQ ID NO: 9004 - protein, 494 aa, Triticum aestivum
MHWARAVPSDFGGQAPAPRSGHTAVAIGGSKVVVFGGFADKRFLADIAVYDVENRLWYTPECSGSGPDGQPGPSPRAFHVAVVIDCNMFIFGGRSGGKRLGDFWMLDTDIWQWSEMTGFGDLPSPREFAAASAIGNRKIVMYGGWDGKKWLSDVYVMDTMSLEWTELAVTGSAPPPRCGHSATMIEKRLLIFGGRGGTGPIMGDLWALKGITEEDNETPGWTQLKLPGQSPSARCGHSVTSGGPYLLLFGGHGTGGWLSRYDVYYNECVILDRVSVQWKRLPTSNEPPPPRAYHSMTCIGPRFLLFGGFDGKNTFGDLWWLVPEDDPIAKRDLVPDVGSDSNHSTVTGDAQQSAVKESESQSDESPMLELAKRLGIPLSIEPSASFVDEINDRELVELSSRLIGESLPTTDQLACIQALRDHWRSSPSSSIQLQELGPLLRDYQRIIIRRFVENPSPTFLEREDHRLFHLKNASQLRMDDIPILLGEYRTLLST

SEQ ID NO: 9005 - protein, 494 aa, Brachypodium distachyon
MHWARADASDFGGEIPAPRSGHTAVGIGKSKVVVFGGFADKRFLADIAVYDVENRLWYTPECTGSGSDGQAGVGPSPRAFHIAVVIDCNMFIFGGRSGGKRLGDFWMLDTDIWQWSEMTGFGDLPSPREFAAASAIGNRKIVMYGGWDGKKWLSDVYVMDTMSLEWTELSVAGSAPPPRCGHSATMIEKRLLIFGGRGGTGPIMGDLWALKGVTEEDNETPGWTQLKLPGHSPSARCGHSVTSGGPYLLLFGGHGTGGWLSRYDVYYNDCIVLDRVSVQWKRLPTSNEPPPPRAYHSMTCIGPRFLLFGGFDGKNTFGDLWWLVPEDDPIAKRDLVPKVGSDSNHSTVTGDAQQSALKEPQSGESPTLDLAKRLGIPLSLETSANFVDEIHDKELMELSSRFIGESLPTSDQLACIEALRDHWRSSPSSSIQLQELGPLLRDYQRLIIRCYVENPTPTFLEKEDRRLFHLKNASQLRMDDIPILLSEYRTLLST

SEQ ID NO: 9006 - protein, 491 aa, Lolium multiflorum
MHWARADASDFGGQPPVPRSGHTAVGIGNSKVVVFGGFADKRFLGDIAVYDVENRLWYTPECTGSGPDGQPGPSPRAFHVAVVIDCNMFVFGGRSGGKRLGDFWMLDTDIWQWSEMTGFGDLPSPREFAAASAIGNRKIVMYGGWDGKKWLSDVYVMDTMSLEWTELAVAGSAPPPRCGHSATMIEKRLLVFGGRGGTGPIMGDLWALKGVTEEDNEAPGWTQLKLPGQSPSARCGHSVTSGGPYLLLFGGHGTGGWLSRYDVYYNECVILDRVSVQWKRLPTSNEPPPPRAYHSMTCIGSRFLLFGGFDGKNTFGDLWWLVPEDDPIAKRDLVPNVESDSNLSTVTSDAQQAVKESQSGESPMVDLAKRLGIPLSMEPPASFVDEINDKELMELSTRLIGESLPTTDQLACIQALRDHWRSSPSSSIQLQELGPLLRDYQRLIIRRYVENPSPRFLKREDHRLFHLKNASQLRMDDIPVLLSEYRTLLST

SEQ ID NO: 9007 - protein, 80 aa, Zea mays
  Sequence also found in Organisms: Triticum aestivum
MALSRRMAAPVLVLMLLLVATELGTTKVAEARHCLSQSHRFKGLCMSSNNCANVCQTENFPGGECKAEGATRKCFCKKIC

SEQ ID NO: 9008 - protein, 80 aa, Saccharum officinarum
MALSRRMAAPVLVLVLLLVATELGTTTVAEARYCLSQSHRFKGLCMSSSNCANVCQTENFPGGECKADGATRKCFCKKIC

SEQ ID NO: 9009 - protein, 80 aa, Echinochloa colona
MALSRRMAAPVLVFLLLLVATEMGPPAVAEARHCLSQSHHFKGLCVSSSNCFNVCRTENFPGGECKAEGATRKCFCKKIC

SEQ ID NO: 9010 - protein, 80 aa, Echinochloa colona
MALSRRMAAPVLVFLLLLVATEMGPPAVAEARHCLSQSHHFKGLCVSTSNCANVCRTENFPGGECKTEGATRKCFCKKIC

SEQ ID NO: 9011 - protein, 80 aa, Panicum virgatum
MALSRRMAAPVLVFLLLLVATEMGPATVAEARHCLSQSHHFKGLCVSSSNCANVCRTENFPGGECKTEGATRKCFCKRIC

SEQ ID NO: 9012 - protein, 80 aa, Echinochloa colona
MALSRRMAASVLVFMLLLVATEMGPVTVAEARHCLSQSHHFKGLCVSTSNCANVCRTENFPGGECKTEGATRKCFCKKIC

SEQ ID NO: 9013 - protein, 80 aa, Panicum virgatum
MALSHRMAAPVLVFLLLLVATEMGPATVAEARHCLSQSHHFKGLCVSSSNCANVCKTENFPGGECKTEGATRKCFCKRIC

SEQ ID NO: 9014 - protein, 646 aa, Setaria italica
MATYYSSPGSERDSQNMYSRDPGNASYPMPSALGNLLYLNNSTSGPYTEFSGILHPQQNCMEMPDPGHPSVMSQDSSARESDMLGSHQGQRSFGPVKDMKNEMLMHMMDGSQSSTADLIHDDAHNGAQLDFGVLNNHSSSNIPSVQGQGLSLSLNTQILAPSLPYWSVKPDMLSPHSYHDSLRVDDMRMKSMQSEASRAIRNSRYLKAAQELLDEVVNVWKNIKQKAQKEQVEAGKTDGKETEGGAKSEGSNPQESAANAAPELSTAEKQELQNKMAKLMAMLDEVDRKYKHYYHQMQSVVSSFDVVAGPGAAKPYTAVALQTISRHFRCLKDAINDQINVIRKKLGEEENSSGKEGKLTRLRYIDQQLRQQRAFQQYGMIPQNAWRPQRGLPENSVTILRAWLFEHFLHPYPKDSEKMMLARQTGLTRSQISNWFINARVRLWKPMIEDMYKDEIGDIEQDSNSSSDNAPRSKGKMASSEDKEDLKSSTPRVCESSQLSESRASIGTMNIGGAPVGFQNEPNPDDSFMNLMLKDQRSNEADGGLLLHNAVAHHQDENARFMAYHLAELGRYGNGNVSLTLGLQHSSSSLSVPNAQQSFPGVGDDDIYNATAPLGVSVASSDYESMNQMDQRQRFEQSPLLHDFVA

SEQ ID NO: 9015 - protein, 647 aa, Oryza sativa
MATYYSSPGSERDSQTMYSRDPGSASYPMSSALGNLLYLNNPSSGPYTEFSGILQPQQNCMEMPGPGHASAMSQDPSSRESDMLASHQGQRSFSHVKDMKNEMLMHMMDGAQGSGSELIHDDAHTGSQLEFGVLNNHNSSSVPSMQSQGLSLSLNTQIMAPSLPYWSIKPDMLTPQSYHDNLRGEDMRMKNLQSEASRAIRNSRYLKAAQELLDEVVSVWKSIKQKAQKEKVESGKADGKETDGGPKSEGVSSNPQESGANAAPELSTAEKQELQNKMAKLMAMLDEVDRKYKHYYHQMQTVVSSFDVVAGPGSAKPYTAVALQTISRHFRCLKDAINDQINVIRKKLGEEENSSGKEGKLTRLRYIDQQLRQQRAFQQYGMIPQNAWRPQRGLPENSVTILRAWLFEHFLHPYPKDSEKLMLARQTGLTRSQISNWFINARVRLWKPMIEDMYKEEIGDLEQDSNSSSDNAPRSKDKMASSEDKEDLKNSRARICETSQLSESRTSIGAMNVGGAPVGFQNEPNPDDSFMNLMLKDQRSNEVDGGLLLHNTVAQHSDENARFMAYHLAELGRYGNGNVSLTLGLQHSSSNLVPNAQPGFPGVNEDDIYNATAPLGVTVASSDYDSMNQMDQRQRFEHSPLLHDFVA

SEQ ID NO: 9016 - protein, 650 aa, Brachypodium distachyon
MATYYSSPGSERESQDMYSRDQGSASYPMSSALGNLLYLNNPSSGPYTEFSGILQSQQNCMEMPGHGHHSAMSQDSSVRESDMLASHHGQRSFGHVKDMKNEMLMHIMDGGQSGGAELIHDDSHNGAQFEFGVLNNHGSSNVPSGQGQGQGLSLSLNTQIMAPSLPYWSIKPDMLTPNSYHESLRVDDIRMKTMQSEASRAIRHSRYLKAAQEVLDEVVNVWKNIKQKAQKEQAEPEKADGKETDGGPKSEGVSSNPQESGANAAPELSTAEKQELQNKMAKLMAMLDEVDRKYKHYYHQMQNVVSSFDVVAGPGSAKPYTAVALQTISRHFRCLKDAINEQINVIRKKLGEEENSSGKEGKLTRLRYIDQQLRQQRAFQQYGMIPQNAWRPQRGLPENSVTVLRAWLFEHFLHPYPKDSEKLMLARQTGLTRSQISNWFINARVRLWKPMIEDMYKEETGDLEQDSNSSSDNVPRSKNKVACSEENEDLKNARARVCETSQLSESRASIGAMNAGGAPVGFQHEANPDDSFMNLMMKDQRSGEADGGLLLHNAMAQHSDESARFMAYHLAELGRYGNGNVSLTLGLQHSGSSLSVPNAQANFPGVTDDDMYNTAAPLGVSIASSDYESMNQMDQRQRFEQSPLLHDFVA

SEQ ID NO: 9017 - protein, 650 aa, Triticum aestivum
MATYYSSPGSERESQDMYSRDPGGASYPMSSALGNLLYLNNPSSGPYTEFSGILQTQQNFMEMPGHGHHSAMSQDSSARESQDMLASHHGQRSFGHVKDMKNEMLMHMMDGAQSGGAELIHDDPHNGAQFEFGVLNNHDSSDVPVGQGQGQGQGLSLSLNTQILAPSLPYWSIKPDMLTPNSYQESLRIDDIRMKNMQSEASRAIRHSRYLKAAQEVLDEVVNVWKNIKQKAQKEQAEPGKADGKETDGGPKSEGASQESGANAAPELSTAEKQELQNKMAKLMAMLDEVDRKYKHYYHQMQNVVASFDMVAGPGSAKPYTAVALQTISRHFRCLKDAINDQINVIRKKLGEEENSSSKEGKLTRLRYIDQQLRQQRAFQQYGMIPQNAWRPQRGLPENSVTVLRAWLFEHFLHPYPKDSEKLMLARQTGLTRSQISNWFINARVRLWKPMIEDMYKEETGDLEQDSNSSSDNVSRSKNKVASSEENEDLKNARARVCETSQLSESRASMGTMNVGGAPVSFQNEANPDDSFMNLMMKDQRSGEADGGLLLHNAVAQHSDENARFMAYHLAELGRYGNGNVSLTLGLQHSGSGLSVPNAQANFPGVSDDDIYNAGAPLGVSIASSDYESLNQMDQRQRFEQSPLLHDFVA

SEQ ID NO: 9018 - protein, 650 aa, Triticum aestivum
MATYYSSPGSERESQDMYSRDPGGASYPMSSALGNLLYLNNPSSGPYTEFSGILQTQQNFMEMPGHGHHSAMSQDSSARESQDMLASHHGQRSFGHVKDMKNEMLMHMMDGAQSGGAELIHDDPHNGAQFEFGVLNNHDSSDVPVGQGQGQGQGLSLSLNTQILAPSLPYWSIKPDMLTPNSYQESLRIDDIRMKNMQSEASRAIRHSRYLKAAQEVLDEVVNVWKNIKQKAQKEQAEPGKADGKETDGGPKSEGASQESGANAAPELSTAEKQELQNKMAKLMAMLDEVDRKYKHYYHQMQNVVASFDMVAGPGSAKPYTAVALQTISRHFRCLKDAINDQINVIRKKLGEEENSSSKEGKLTRLRYIDQQLRQQRAFQQYGMIPQNAWRPQRGLPENSVTVLRAWLFEHFLHPYPKDSEKLMLARQTGLTRSQISNWFINARVRLWKPMIEDMYKEETGDLEQDSNSSSDNVSRSKNKVASSEENEDLKNARARVCETSQLSDSRASIGTMNVGGAPVSFQNEANPDDSFMNLMMKDQRSGEADGGLLLHNAVAQHSDENARFMAYHLAELGRYGNGNVSLTLGLQHSGSGLSVPNAQANFPGVSDDDIYNAGAPLGVSIASSDYESLNQMDQRQRFEQSPLLHDFVA

SEQ ID NO: 9019 - protein, 646 aa, Avena sativa
MATYYSSPGNERESHDMYSRDPGSGSYPMSSALGNLLYLNNPSPGPYTEFSGILQSQQNCMEMPGHHGHHSGMSHDSSVRESDMLARSFGHVKDMKNEMLMHMMDGAQQSGTGAELIHDDAHNGGQFEFGVLNNHGSPNVPSGQGQGLSLSLNTQILAPSLPYWSIKPDMLTPSSYHDSLRVDDIRMKNMQSEASRAIRHSRYLKAAQEVLDEVVNVWKNIKQKAQKEQAEPGKADGKETDGGPKSEGPQESGANAVPELSTAEKQELQNKMAKLMAMLDEVDRKYKHYYHQMQNVVSSFDVVAGPGSAKPYTAVALQTISRHFRCLKDAINDQINVIRKKLGEEENSSGKEGKLTRLRYIDQQLRQQRAFQQYGMIPQNAWRPQRGLPENSVTVLRAWLFEHFLHPYPKDSEKLMLARQTGLTRSQISNWFINARVRLWKPMIEDMYKEETGDLEQDSNSSSDNVPRSKNKVATSEENEDLKNARARVCETSQLSDSRASIGAMNVGGAPLRFQNEANHDDSFMNLMMKEQRSGEADGGLLLHNAAVAQHSDENARFMAYHLAGFGGRYGNGNVSLTLGLQHPGSGLSVPNAQANFPGVGDDDDIYTATGVPLGVSIASSDYESLNQMDQRQRFEQSPLLHDFVA

SEQ ID NO: 9020 - protein, 325 aa, Zea mays
MRRFLPAGGGGGGGEPSSSSSSGGHQHHQHGGLASGERAAAGLRYRGGADISLGHGHDDGGHGRSIDAADRRNDGSMDMLARHSSSPVGFFSNLVVDNGYPRSNKAGGGGGVEGQQHDPSTAANASGSSARKMKTPEFNFTGAQQGQQLGAAAGHLSRISEDGAFPGGMMGDRAGRGSAGESSGAAAAARSYSAGGFSIVGPWEESRDIITTLGAYDPQFSGAMAGTALEMAGMDRYVQLQQDQVPFKVRAKRGCATHPRSIAERERRTRISEKLRKLQDLVPNMDKQTSTADMLDLAVEHIRGLQSELQALKHEQEKCTCCRKR

SEQ ID NO: 9021 - protein, 506 aa, Zea mays
MEMVLDWRSLGSLLATVVVFRTALRNFLPPEAEMLLRRFLAWVAAAFRPPSDTILIDEADGPTGSANDLYESAQLYLSARCLATAPAVRLHKPRQSPRPVASLPDSHTTDDTFRGVRVKWTSTTRTVDRSGSGGGGNPYNIFGRGGDQRGLELQFPRQHRDLVHHHYIPHLIDEATRMRLKSRERRLYTNRATGPCDDHHRLWTSHAFAHPSTFDTLALDPALRDEVRADLLRFAARRDHYARVGRAWKRGYLLHGPPGTGKTSLVAAIANLLDFDVYDLELTTVPTNSHLRRLLVSTTPKSVVVVEDIDCSLDLSDRNKKTKKGAGVGVGIGTAGDEDAAAQLAVMSVSPVAAAVMGRESVSLSGVLNFVDGLWSSCVGERLMVFTTNHPERLDPALLRPGRMDRKIELGYCTPPALRVLAKNYLGVGDEGCDDADADPDTVNALMAEAEGLLAAAEVQITPADIAEVFMGCDGAGAAAALRKLVGELRRRRDAAALATAVAPPE

SEQ ID NO: 9022 - protein, 516 aa, Setaria italica
MEMVLDWRSLGSLLATLMVFRTAMRDFLPPEAEMCLRRLLARVAAAFRPPSGTILIDEADGASGGANDLYDSAQLYLGERCLATAPAVRLHKPRQAHRPVASLPDSHTTHDTYQGVRVRWTSTARTAERGAGGGGYSPYGVFGRGGHGVGGGGDHRTLELQFPRQHRDLIHDHYIPHLIAEAARMRLKSRERRLYTNRATGPGDDHHRLWTSHAFSHPSNFDTLAVDPALREEIRADLLRFAARRDHYARVGRAWKRGYLLHGPPGTGKTSLVAAIANLLEFDVYDLELTTVPTNSHLRRLLVSTTPKSVVVVEDIDCSLDLSDRNKKNKNGNNGADDETAAQLAAISPAAAAAMAVVGRESISLSGVLNFVDGLWSSCVGERLMVFTTNHPERLDPALLRPGRMDRKIELGYCTPPALRVLAKNYLGVGDEGCEDAGDDPDTVRDLMAEAEDLLAPAAGVRITPADIAEVFMGCDGTGAAAALRKLVGELRRRRDDYAAAAAVAPGESGEDTTDC

SEQ ID NO: 9023 - protein, 504 aa, Panicum virgatum
MEIVLDWRALGSLLATFMVFRTAVRDFLPPEAEACLRRLLARVAAALRPPRGTVLIDEADGASGGANDLYDAAQLYLGARCLATAPAVRLHKPRQSPRPVASLPDAHATHDVFRGVRVKWTSTARAVERAGHGPYGGAFGRGGGGDQRTLELQFPRQHRDLIHDHYIPHLIAEATRLRLKSRERRLYTNRATGPGDDHHRLWTSHAFAHPSTFDTLAVDPALREEIRADLLRFAARRDHYARVGRAWKRGYLLHGPPGTGKTSLVAAIANLLEFDVYDLELTTVPTNSHLRRLLVSTTPKSVVVVEDIDCSLDLSDRNKKKNGGADEETAAQLAMVSPAAAAAMAAAGRESISLSGVLNFVDGLWSSCVGERLMVFTTNHPERLDPALLRPGRMDRKIELGYCTAPALRVLAKNYLGVGDDGSDEDADADPDAVSSLMAEAEGLVAAAGVRITPADIAEVFMGCDGAGAAAALRKLVGELRRRRDGAAAAAAVVPGESAEDTTE

SEQ ID NO: 9024 - protein, 504 aa, Oryza sativa
MEMVLDWRSVGSLLATIMVFRTAMRDFLPPEAEIFLRRLLTRLAAAFRPHVGTILIDEADGASGGANDLYDASQLYLGARCLATAPTVRLHKPRQAPRPVASLPDAHTTHDVFRGVLVKWTARPVERGASAGGGGGGVFNPYNPYGRGGGGGEPRRLELQFPRQHRELIHGHYIQHVIDEATKMRLRSRERRLYTNRAAAPGDDHHRLWTSHAFSHPSTFDTLAVDPALRDDIRADLLRFAARREHYARVGRAWKRGYLLHGPPGTGKTSLVAAIANLLEFDVYDLELTTVPTNSHLRRLLVSTTPKSVVVVEDIDCSLDLSDRKNKASDDENAAQLSIISPAAAAAMAAMGRESISLSGVLNFVDGLWSSCVGERLMVFTTNHPERLDPALLRPGRMDRKIELGYCSPPALRVLAKNYLGVGVGDEGCEDAADDPDTVSGLMADAEGLLAAGVLITPADIAEVFMGCDGAGATAALRKLADELRRRRDAPAVPVTEEAAMTTE

SEQ ID NO: 9025 - protein, 354 aa, Setaria italica
MGGGARLPPPRPPRLHFHPSTPIPYLHATAPVAASSTLFVHRPAPIPSARVSRPRRRAAMSATTAADSSSTIGVSDATGVDARSLESVGQNDLLIVGPGVLGRIVAEMWKQEHPGSNVYGHTATTDHHCELTELGIIPSLKGSIPGPKFPYVIFCAPPYRSEDYAGDLRVAASNWNGEGSFLFTSSTAVYDCSDNGLCSEDSPCIQIGQSPRTDVLLKAENVVLEAGGCVLRLVGLYKSDRGPHVYWLSKGTLDARPDHILNLIHYEDAASLAIAIMKRRLRGRIFVGCDNEPLSRQEIMDRVNRSGKFDTKFQGFTGTDGPLGKRMENSKTRAEIGWQPKYPSFTEFLGLSNL

SEQ ID NO: 9026 - protein, 451 aa, Zea mays
MAERLAASLLPAASPSPSARRATVAAAAAASFPSPCSARAGLRLRSRPPLFSQKAAGRGCGLRVVRCMAASDAVQLKAAREDIKELLKSTYCHPIMVRLGWHDSGTYDKNIKDWPQRGGANGSLRFDAELSHGANAGLINALKLIQPIKDKYPGITYADLFQLASATAIEEAGGPKIPMKYGRVDVTAAEQCPPEGRLPDAGPRDPAEHLREVFYRMGLDDKEIVALSGAHTLGRARPDRSGWGKLETKYTKDGPGEPGGQSWTVEWLKFDNSYFKDMKFLSQLPWKEQKEQDLLVLPTDAALFEDPSFKVYAEKYAEDQEAFFKDYGEAHAKLSDLGAKFDPPEGFSLDDDTCSSPSDEKTEEPTLVAVGAAVATATADDNNGAAPQPEPFIAANYSYGKRELSDAMKQKIRAEYEGFGGSPDKPMQSNYFLNIMILIAGLAFLTSLLGN

SEQ ID NO: 9027 - protein, 478 aa, Setaria italica
MAERLAASLLPAASPSPSARRATVAASGSAAASFPSSCSARAGLRLRSSRSGSARFSKAAGRGGGGGALRVVRCMAASDAAQLKSAREDIRELLKTTYCHPIMVRLGWHDSGTYDKNIEEWPQRGGADGSLRFEPELNHGANAGLINALKLIQPMKDKYPGITYADLFQLASATAIEEAGGPKIPMKYGRVDVTEPEQCPPEGRLPDAGPRDPAEHLREVFYRMGLDDKEIVALSGAHTLGRARPDRSGWGKPETKYTKDGPGEPGGQSWTVEWLKFDNSYFKDMKFLSQLPSKEQKDQDLLVLPTDAALFEDPSFKVYAEKYAEDQEAFFKDYAEAHAKLSDLGAKFDPPEGFSLDDDTSDEPAAEKKEEAAPTPEPAAAAAPPPEPAAAPALEPVAAAVATATADDNNGVAPQPEPFVAAKYSYGKTELSDSMKQKIRAEYEGFGGSPDKPLQSNYFLNIMLLIAGLAFLTSLVGN

SEQ ID NO: 9028 - protein, 478 aa, Oryza sativa
MAERIAASLLPAASPSPAPSPPPPRPRVSAAAAASFPCCSTSAGGLRLRSRPSRFPQKAATTRSGRAGAGARAVVRCMAAAAVAASDAAQLKSAREDIREILKTTYCHPIMVRLGWHDSGTYDKNIEEWPQRGGADGSLRFDAELSHGANAGLINALKLIQPIKDKYPGITYADLFQLASATAIEEAGGPKIPMKYGRVDVTAAEQCPPEGRLPDAGPRVPADHLREVFYRMGLDDKEIVALSGAHTLGRSRPDRSGWGKPETKYTKDGPGEPGGQSWTVEWLKFDNSYFKDIKEQRDQDLLVLPTDAALFEDPSFKVYAEKYAEDQEAFFKDYAEAHAKLSDLGAKFDPPEGFSLDDEPAVEEKDPEPAPAPAAAAPPPPVEEKKEAEPTPVPVTVGAAVASSPADDNNGAAPQPEPFVAAKYSYGKKELSDSMKQKIRAEYEGFGGSPDKPLQSNYFLNIMLLIGGLAFLTSLLGS

SEQ ID NO: 9029 - protein, 1021 aa, Setaria italica
MLLSFSPHPSPLLLSLPSTSASKPRARLQPVIASASASPSPELLGKSALRRISDKLRSLGYLETGSEAPAPAPVTSGDAPSAGEIFVPTPAQLPRHRVGSTLDPSWATADGEAGSATRRRGRGRGRDAPGSSSMPPSAAELALPRDELRRLQGIGIRVRKRLKVGKAGITEGIVNGIHERWRNAEVVKIRFEDVWAMNMRRTHEILERKTGGLVIWRSGSTIILYRGTNYKYPYFHYRERMDGFLDEESSEQSSSGDEDEDPGVESEALSNSAEEDETSFHHDSSHESSENPVIACAEQRSTGEGKNNNIGYLKQSLSREKDTAHPILSTKRLVFDTLGGNLDLRAGAPNQQHARLHVKTHADHLGKVGPRDRSSLVAGVGSPNKFRLQLPGEVKLAEEADRLLDGLGPRFSGWWGYDPLPVDADLLPAIVPGYRRSSNLQGLAASMIKLWERCEVAKIAIKRDAHNTDSELVTEELKGLTGGTLLSRDKESIVFYRGKDFLPPAVSLAIEKRRKWGSSTIYKTKPNAEESTLAQDASVLKVSSDVSVQIHEEVTSVSENRAESLNTVAQNVETRLSQAIAEKEKAEKLLEELENASQPSKADTREVITEDERYMLRKVGLKMKPFLLLGRRGVFDGTIENMHLHWKYRELVKIICKEHSLKDVEYAARTLEAESGGILVAVEKVSKGHAIIVYRGKNYQRPSTLRPKTLLTKRDALKRSMENQRCKSLKLHVLNLSKNIDYLRDQMNSSYYYNAIHDPSVNSGTLQQKNEEVPELAPMSSEPEVEECTSVEMDGTLNLTKSGAPFDDNDMQSKVCLNKPGDGPSVTVSPPCLTGRSSTVSFNGLNRHQNQYGSTVTFNPDSHSEGDSKDVDASKFDLESDPLLPLRATPLTNQERLMLRKQALKMKKKPVLSIGRNNVITGVAKTIKTHFKKHPLAIVNIKNRADGTPIQQLISELEEATGSVLVSRETNKVILYRGWGAEVAQKSSMENSANGEEKEVISPQLLEAIRLECGLLPGESG

SEQ ID NO: 9030 - protein, 600 aa, Zea mays
MGPPFSAQDPAPSPSGGSGSGSSRRRLRRLDRRNASKNISYNATNYCQYPPSPQVASAPGSGRASLAGSLACSIDVVNSFRIGGNGDGGRDLRFLCESLGLSGPDDFAIPLADWEAHKAVRSSTSASGSPNSARTNHDSPQRDSPFCQVGAEEPAQAADADPELLAGTGRDGPIEAPERPARLDPPPESTFPDVRRAVGEGGIKGVRPPPVLKPPPSMALPAVCGVGSTWDILRSFAPDEKEDAPASRTVRRFGHRAAEEKDDDEDGAVLLMLDDLRLEESSEGFTGTSSLSTTNDDETSSTTTESMFYISPNGRFRRRIRSWNRGMLLGSGSFGTVYEGISDEGVFFAVKEVNLFDKGSNAKQCIFQLEQEIALLSQFEHENIVQYYGTDKEDSKLYIFLELLTQGSLALLYQRYRLRDTHVSAYTRQILNGLIYLHEKNIVHRDIKCANILVHANGSVKLADFGLAKEITKFNAVKSCKGTVYWMAPEVVNPKKTYGPAADIWSLGCTVLEMLTRQIPYPGLEWTQALYRIGKGESPAIPSSLSKDARDFISQCVKPNPEDRPSAIKLLEHPFVNKPIRSVWSLRTSSRSNSSTRGIN

SEQ ID NO: 9031 - protein, 599 aa, Zea mays
MGPPPGAQDPAPSPSGGSGSSRRRFRRLDRRNASKHIAYDATNFCQYPPSPQAASAPGSGRASLASSAACSIDLVNSFRIGGSGDGGGDLRFLCENLGLSGPDDFAVPRADWEAHKAARSSASASSSPNSARPNYDSPQRNSPLSQVGAEEPAQASDAETELPAATGRDGPIEAPERPARLDLPLESTCPDARRAPGQGGIKGVRPPPVLKPPPSMALPAVCGVGSTWDILRSLAPDEKDDAPASRSGRRFGHLDAVEKDDDERAAVLLMLDDLRLEESSESFTGTSSLSTTNDDDTSSTTTESMFYISPNGRFRRRIKSWSRGVLLGSGSFGTVYEGISDEGVFFAVKEVNLFDKGSNAKQCIFQLEQEIALLSQFEHENIVQYYGTDKEDSKLYIFLELVTQGSLASLYHKYRLRDTQVSAYTRQILNGLIYLHERNIVHRDIKCANILVHANGSVKLADFGLAKEITKFNELKSCKGTVYWMAPEVVNPQQTYGPAADIWSLGCTVLEMLTRQIPYPDLEWAQALYRIGKGESPAIPNTLSRDARDFISRCVKPNPEDRPSASKLLEHPFVNKSIRSVRSMRTTPSRSNSSTRGIN

SEQ ID NO: 9032 - protein, 598 aa, Panicum virgatum
MGPPPSAQDPAPSPSGGSGSGSSRRRLRRLDRRNASKNIGYDATNFCQFPPSPQPASAPASGPASLAGSVACSLDLVNSFRIGGSGDGGGDVQLLCQSLGLSGPDDFAISLADWQAHKAVRSSASASASPSSARHEPEPPARDSPLRHEGAEEPTRPADADHELPAKEPAARNAPIEALERPARLDPLESTRPDVKRAVGEGGIKGLRPPPVLKPPPTMALPAVCGAGSTWDILRSFAPDEKEHAPASRSGRGFAHQDAEEDEDAAVALTLEDLRLGESSEGFTGTSSLSTTNDDETCSTTTESMFYISPNGRFRKKIRSWNRGVLLGSGSFGTVYEGISDEGGFFAVKEVSLYDQGSNAKQCIFQLEQEIALLSQFEHENIVQYYGTDKEDSKLYIFLELVTQGSLASLYQKYRLRDTHVSAYTRQILNGLTYLHERNIVHRDIKCANILVHANGSVKLADFGLAKEITKFSAIKSCKGTVYWMAPEVVNPKKTYGPAADIWSLGCTVLEMLTQKIPYPDLEWTQALYRIGKGEAPAIPSGLSKDARDFISQCVKPNPEDRPSASKLLEHPFVNRSIRSVRSMRTSSRPNSSTRGIN

SEQ ID NO: 9033 - protein, 596 aa, Panicum virgatum
MGPPPAAQDPAPSPSGGSGSSRRRLRRLDRRNASKNIGYDATNFCQFPLSPQPASAPASGPASLAGSAACSLDLVNSFRIGGSGDGGGDVQLLCQSLGLSGPDDFAIPLADWEAHKAVRSSASASASPASARHKPEPPARDSPLRHEGADEPTRPADADHELPAKEPAARDAPIEALERPARLDPLESTRPDVKRAVGEGGIKGLRPPPVLKPPPSMALPPVCGAGSTWDILRSFAPDEKEHAPASRSGRDFSHQDAEEDEDAAVVLTLEDLRLGESSEGFTGTSSLSTTNDDETCSTTTESMFYISPNGRFRKKIRSWNRGVLLGSGSFGTVYEGISDEGGFFAVKEVSLYDQGSNAKQCIFQLEQEIALLSQFEHENIVQYYGTDKEDSKLYIFLELVTQGSLASLYQKYRLRDTHVSAYTRQILNGLTYLHERNIVHRDIKCANILVHANGSVKLADFGLAKEITKFSAIKSCKGTVYWMAPEVVNPKKTYGPAADIWSLGCTVLEMLTQKIPYPDLEWTQALYRIGKGEAPAIPSGLSKDARDFISQCVKPNPEDRPSASKLLEHPFVNRSIRSVRSMRTSSRSNSSTRGIN

SEQ ID NO: 9034 - protein, 594 aa, Setaria italica
MGPPPAAQDPAPSPSGGSGSSRRRLRRLDRRNASKNIPYDANNFCPFPPSPQPASAPASGPASLAASAACSLDLVNSFRIGGSGDGGGDVLFLCQSLGLAGPEDFAIPIADWEAHKAVRSSPSSARHKPETPARDSPLRREGVEEEPIRPADAEPELPAKEQAARDVPIEALERPAWLDPLESTRPDVKKAAGEGGIKGLRPPPVLKPPPSMALPAVCGAGSTWDILRSFAPDEKEHAPASRSGRGFRHQDAVEVEDDEDTAVVLTLDDLRLGESSEGFTGTSSLSTTNDDETSSTTTESMFYISPNGRFRRKIRSWNRGVLLGSGSFGTVYEGISDEGVFFAVKEVSLFDQGSNAKQCIFQLEQEIALLSQFEHENIVQYYGTDKEDSKLYIFLELVTQGSLASLYQKYRLRDTHVSAYTRQILNGLTYLHEKNIVHRDIKCANILVHVNGSVKLADFGLAKEITKFSAVKSCKGTVYWMAPEVINPKQTYGPAADIWSLGCTVLEMLTRQIPYPDLEWTQALYRIGKGEGPTVPSGLSKDARDFISQCVKPNPEDRPSASKLLEHPFVNRSIRSVRSMRTSSRSNSTTRGIN

SEQ ID NO: 9035 - protein, 719 aa, Setaria italica
RGESETIPAQPDHRRGAELIWPRLPCRVADPTTGPERRKDASQCGQRYPRSLAPPPPPHPPKNPTKSPRPRLTNEPEKIPHPLALFAVSPRTASPKRSAASSRFRRALPLPTASSRAPHELRPPPMGPPPAAQDPAPSPSGGSGSSRRRLRRLDRRNASKNIPYDANNFCPFPPSPQPASAPASGPASLAASAACSLDLVNSFRIGGSGDGGGDVLFLCQSLGLAGPEDFAIPIADWEAHKAVRSSPSSARHKPETPARDSPLRREGVEEEPIRPADAEPELPAKEQAARDVPIEALERPAWLDPLESTRPDVKKAAGEGGIKGLRPPPVLKPPPSMALPAVCGAGSTWDILRSFAPDEKEHAPASRSGRGFRHQDAVEVEDDEDTAVVLTLDDLRLGESSEGFTGTSSLSTTNDDETSSTTTESMFYISPNGRFRRKIRSWNRGVLLGSGSFGTVYEGISDEGVFFAVKEVSLFDQGSNAKQCIFQLEQEIALLSQFEHENIVQYYGTDKEDSKLYIFLELVTQGSLASLYQKYRLRDTHVSAYTRQILNGLTYLHEKNIVHRDIKCANILVHVNGSVKLADFGLAKEITKFSAVKSCKGTVYWMAPEVINPKQTYGPAADIWSLGCTVLEMLTRQIPYPDLEWTQALYRIGKGEGPTVPSGLSKDARDFISQCVKPNPEDRPSASKLLEHPFVNRSIRSVRSMRTSSRSNSTTRGIN

SEQ ID NO: 9036 - protein, 380 aa, Zea mays
MGVDEAGRAAGRNLTLASIGFADVRVGAAVPGGAGYKDGLLVVGLPVPKDDGLDAAARVVRDLATRLPDVGAAARTFLRNREVAEFVSGALAGAMTKAVLAPLETIRTRMVVGVGSKHIFGSFVEIVEHNGWQGLWAGNTINMLRIIPTQAIELGTFECVKRSMASAQEKWKEEGCPKIQLGDLKIELPFHLLSPIAIGGAAAGIASTLVCHPLEVLKDRMTVNREAYPSIAIAFSKIYRTDGIGGLYAGLCPTLVGMLPYSTCYYFMYETIKTNYCRAHKKKSLSRPELLVIGALSGLTASTISFPLEVARKRLMVGSLQGKCPPHMIAALAEVIQEEGAKGLFRGWAASSLKVMPTSGVTWMFYEAWKDLLLSSRLHA

SEQ ID NO: 9037 - protein, 377 aa, Setaria italica
MGLEEAGRAAAATGKKLALASISFADVRVGAAGGAGYKDDLLVVGLPVPKDDGLDVVGDLAVRLPDVGAAVRTFLRNREVAEFVSGAMAGAMTKAVLAPLETIRTRMVVGVGSKHIFGSFVEIIEQNGWQGLWAGNTINMLRIIPTQAIELGTFECVKRSMASAQEKWKEDGCPKIQLGNLKIELPFHLLSPIAIGGAVAGIASSLACHPLEVLKDRMTVNREAYPSIVIAFNKIYRADGIGGLYAGLCPTLVGMLPYSTCYYFMYETIKTSYCRAQKKKSLSRPELLVIGAVSGLTASTISFPLEVARKRLMVGAIRGKCPPHMIAALAEVVQEEGFKGLFRGWAASSLKVMPTSGVTWMFYEAWKEILLAPQLHA

SEQ ID NO: 9038 - protein, 373 aa, Panicum virgatum
MGVEEAGRARGGGKKLALASIGFADVRVGAAGGAGYREDLLEVGLPLPGPKDDGGLAVRLPDVGAAVRTFLRNREVAEFVSGAMAGAMTKAVLAPLETIRTRMVVGVGSKHIFGSFVEIIEQNGWQGLWAGNTINMLRIIPTQAIELGTFECVKRSMASAQEKWKEDGCPKIQLGNLKIELPFHLLSPIAIGGAAAGIASTLACHPLEVLKDRMTVNREAYPSIAIAFNKIYRADGIGGLYAGLCPTLVGMLPYSTCYYFMYETIKTSYCRAQKKKSLSRPELLAIGALSGLTASTISFPLEVARKRLMVGAIQGKCPPHMIAALAEVVQEEGFKGLFRGWAASSLKVMPTSGVTWMFYEAWKDILLAPRLHV

SEQ ID NO: 9039 - protein, 374 aa, Panicum virgatum
MGVEEAGRARGGGGKKLALASIGFADVRVGAAGGAGYREGLLEVGLPLPGPKDDGGLAVRLPDVGAAVRTFLRNREVAEFVSGAMAGAMTKAVLAPLETIRTRMVVGVGSKHIFGSFVEIIEQNGWQGLWAGNTINMLRIIPTQAIELGTFECVKRSMASAQEKWKEDGCPKIQLGNLKIELPFHLLSPIAIGGAAAGIASTLACHPLEVLKDRMTVNRAAYPSIAIAFNKIYRTDGIGGLYAGLCPTLVGMLPYSTCYYFMYETIKTSYCRAQKKKSLSRPELLVIGAVSGLTASTISFPLEVARKRLMVGAIQGKCPPHMIAALAEVVREEGFKGLFRGWAASSLKVMPTSGVTWMFYEAWKDILLAPRLHV

SEQ ID NO: 9040 - protein, 385 aa, Oryza sativa
MGMEEEGVARGGGGKKLALASIGFADVRVGAVAGGGGAGAGGGYKEDLLVVGLPKDDDFDVAKVVGDVAVGLPDVGAAVRNFLRNREVGEFVSGALAGAMTKAVLAPLETIRTRMVVGVGSKHIFGSFVEIVEQNGWQGLWAGNTINMLRIIPTQALELGTFECVKRSMTEAQEKWKEDGCPNIQIGNLKIELPLHLLSPIAVGGAAAGIVSTLVCHPLEVLKDRLTVNREAYPSIGLAFNKIYQTDGIGGLYAGLCPTLVGMLPYSTCYYFMYETIKTSYCRAHKKKSLSRPELLIIGALSGLTASTISFPLEVARKRLMVGTLQGKCPPHMIAALAEVFQEEGIKGLYRGWAASSLKVMPTSGITWMFYEAWKDILLAPELHT

SEQ ID NO: 9041 - protein, 371 aa, Brachypodium distachyon
MGVEVAAARGRNKLAFASIGFAEVRVGGGGGGLKDDGLLGAGLPKDAEYLFGDVSVRMPDVGAAVRTFLRRREVGEFFSGALAGAMTKAVLAPLETIRTRMIVGVGSKHIFGSFVEIMEHNGWQGLWAGNAINMIRIVPTQAIELGTFECVKRSMTSAQERWKEDGGPKIQLGGLTIELPLHLLSPVAIGGAAAGIVSTLVCHPLEVLKDRMTINREAYPSIALAFNKIYRTDGLAGLYAGLCPTLVGMLPYSTCYYFMYETIKTSYCRTHKKKSLSRPELLIIGALSGLTASTISFPLEVARKRLMVGALQGKCPPHMVAALGEVIREEGLRGLYRGWAASSLKVMPTSGMTWVFYEAWKDILLAPHLHI

SEQ ID NO: 9042 - protein, 116 aa, Saccharum officinarum
MAATRSSKSSSSSSSPRQLVAAALLVAVLVAASVLVAAEAVCDMSNEQFMSCQPAAAKTTDPPAAPSQACCDALAGADLKCLCGYKNSPWMSVYNIDPQRAMELPAKCGLATPPNC

SEQ ID NO: 9043 - protein, 116 aa, Saccharum officinarum
MAATRSSKSSSSSSSPRQLVAAALLVAALVAASVLVAAEAVCDMSNEQFMSCQPAAAKTTDPPAAPSQACCDALAGADLKCLCGYKNSPWMSVYNIDPQRAMELPAKCGLATPPNC

SEQ ID NO: 9044 - protein, 116 aa, Saccharum officinarum
MAATRSSKSPSSSSSPRQLVAAALLVAVLVAASVLVAAEAVCDMSNEQFMSCQPAAAKTTDPPAAPSQACCDALAGADLKCLCGYKNSPWMTVYNIDPQRAMELPAKCGLATPPNC

SEQ ID NO: 9045 - protein, 111 aa, Saccharum officinarum
MAATSSSRKSSSSSSPQLLAAALLVAVSVLVAAEAVCDMSNEQFMSCQPAAAKTTDPPAAPSQACCDALAGADLKCLCGYKNSPWMSVYNIDPQRAMELPAKCGLATPPNC

SEQ ID NO: 9046 - protein, 239 aa, Zea mays
MGSLGGDAEPQGARRRPRFLCLHGFRTSGEIMRKQVLGKWPADVTARLDLVFADAPFPAEGKSDVDGIFDPPYYEWFQFDKSFMEYRNFDKCLAYIEELMIKDGPFDGLMGFSQGSILSAALPGLQEQGLALTRVPKVKYLIIIGGAKFQSPTVAGKAYANKIACPSLHFIGENDFLKVHGEKLIESCVDPFVIRHPKGHTVPRLDDESLVVMHRFLEKIEGEVLEYSSKDVNETEVGM

SEQ ID NO: 9047 - protein, 241 aa, Setaria italica
MGSLGGEDRRQPEARGRRPRFLCLHGFRTSAEIMRKQVVGKWPADVTARLDLVFADAPFPAEGKSDVDGIFDPPYYEWFQFDKEFTEYKNFDKCLAYIEELMIKDGPFDGLMGFSQGAILSAALPGLQEQGLALTRVPKIKYLIIIGGAKFLSPTVAEKAYANKIACTSLHFIGDNDFLKTHGEKLIESCVDPFVIRHPKGHTVPRLDDKSLQVMLRFLEKIEKETSEHASTDVDEKEVCL

SEQ ID NO: 9048 - protein, 240 aa, Pennisetum glaucum
MGSLGGEEAPAPPGSRRPRFLCLHGFRTSAEIMRKQVLGKWPADVTARLDLVFADAPFPAEGKSDVEGIFDPPYYEWFQFDKGFTEYRNFDECLAYIEELMIKDGPFDGLMGFSQGAILSAALPGLQEQGLALTRVPKIKYLIIIGGAKFFAPTVAEKAYANKIACPSLHFIGDNDFLKTHGEKLIESCVDPFVIRHPKGHTVPRLDDKSLQVMLRFLGKIEEETSEQASTDVDEKEVCL

SEQ ID NO: 9049 - protein, 314 aa, Saccharum officinarum
MGDKVNPWCHWHNPPWKFNTETSAGNLRPPDVGLVNANSVALPAYLSTVAAPVPFFTASIAERPLSTAPRYATTLAPSLELPALYPSRKRPLVFYQKENHAPIAAPLLSKGPLDPVPELQGSNETNVTDVGAEETEGIHENTDEINALLDSDSDEGYEKLLELDRVRRQSPAENDTLSVESVASAGAATDSAPPAKKRKLSSCTDKSVVDTASSARPDHSIEQKLLVNDCDAQSCCVGEVESDHKFSLGEVEAAEGDSPDDQKRRRERIQETVAALRNIVPGGIAKDATAVLDEAICYLQYLKLKVKTLGAVSL

SEQ ID NO: 9050 - protein, 314 aa, Echinochloa colona
MGDKVNPWCQWPNPPWKFNTESSVGNLCPPDVGLVDTNSVALPTYLNTVAAPVPFFTASVADSPLPMAPRFVTTLAPSLELSALYPSHKRSLVFYQENHPIAAPLASKGTLDPVPELQGSNETNVTDVGAEETEGIHENTDEINALLDSDSDEGYEKVQELNRVKRPSPAEDDTLSVESVASAGASTGSARPAKKRRLSSGTDKSVVDTASSARLDHSIEQKLLANDCDAQSCCIGEVESNHKFTLGLGEGEAAEGDSPDDQERRRERIQETVAALRKIVPGGIAKDATAVLDEAICYLQYLKLKVKTLGAVSL

SEQ ID NO: 9051 - protein, 314 aa, Pennisetum glaucum
MADKVNPWCHWPNPPWKFNTESSAGNTCPPDIGLDVNSVALPTYLNTVAAPVPFFSASVADRPLPMAPRFVTTLAPSLKLSALYPSHKRSLVFYQENHTPIAAPLVSKGTLDPVPELQGSNETNVTDVGAEETEGVHENTDEINALLDSDSDEGYEKVQELNRARKPSPVENDTLSVESVASAGASAGSARPAKKRRLSSGTDKSVVDTASSARLDHSIEQKLLVNDCDAQSCCIGEVESDHKFSLGEGEGEAGEGDNPDDQKRRRERIQETVAALRKIVPGGIAKDATAVLDEAICYLQYLKLKVKTLGAVSL

SEQ ID NO: 9052 - protein, 313 aa, Setaria italica
MADKVNPWCHWPNPPWKFNTESSAGNIYPPDIGLVDSNSVALPTYLNTVAAPVPFFTASVADRPLPMAPRFVTKLAPSFEFSALYPSHKRSLVFYQENHTPIAAPLISKQTLDPVPELQGSNETNVTDVGAEETEGIHENTDEINALLDSDSDEGYEKVQELNRVRKPSPAENDTLSVESVASAGASAGSVRPAKKRKLSSGTDKSVVDTASSARLDHSIEQKLLVNDSDAQSCCIGEVESDHKFFLGEGEAAEGDNPDDQNRRRERIQETVAALRKIVPGGIAKDATAVLDEAICYLQYLKLKVKTLGAVSL

SEQ ID NO: 9053 - protein, 314 aa, Panicum virgatum
MGDKDNPWCHWPNSPWKFNTESSAGNICPPDVGLVDTNLVALPTCLNTVAAPVPFFTASIAERPLPMTPRFVTTLVPSLELSSLYPSHKRPLVFYQENHTPITAPLVRKGTLDPVPELQGSNETNLTDVGAEETEGIHENTDEINALLYSDSDEGYEKVQELNRIRRPSPAENDTLSVESVASAGASASGSARPAKKRRLCSGTDKSVVDTASSARPDHSIEQKLLVNDCDAQSCCIGEVESDHKFARGEGEAVEGDSPDDQKRRRERIQETVAALRKIVPGGIAKDATAILDEAICYLQYLKLKVKTLGAASL

SEQ ID NO: 9054 - protein, 315 aa, Panicum virgatum
MGDKDNSWCHWPNSPWKFNTESSAGNICPPDVGLVDANLVALPTCLNMVAAPVPFFTASIAERPLPMTPRFVTTMVPSLELSAMYPSHKRPLVFYQENHTPIAAPLVRKGTLLDPVPELQGSNETNLTDVGAEETEGIHENTDEINALLDSDSDEGCEKVQELNRVRRPSPAENDTLSVESVASAGASAAGSARPAKKRRLCSGTDKSVVDTASSARLDHSIEQKLLVNDCDAQSCCIGEVESDHKFALGEGEAVEGDNPDDQKRRRERIQETVAVLRKIVPGGIAKDATAVLDEAICYLQYLKLKVKTLGAVSL

SEQ ID NO: 9055 - protein, 312 aa, Zea mays
MGDKVNPWCHWPNPQWKFNTESSAGNLHPPDVGLANADSVALPAYHLNAAPMPFFAASSIAERPLPMGPRHVTTLAPSFESPAPCPSRKRPSVLYQKETHGPTAAPLRRSKGPLDPVPELQGSNETNVTDVGAEETEGVHENTDEIDALLDSSDSDEGPHELDRARRQPAAENETSSVESVASAAGSAPPAKKRRLSSCTDRSVVDTASSARPDHSVEQKPLASDCDAQSCCVGEVVESGRLRFSPGEGEAAEGDSPDDQRRRRERIQETVAALRNIVPGGTAKDATAVLDEAICYLQYLKLKVKTLGAASL

SEQ ID NO: 9056 - protein, 328 aa, Zea mays
MAAASSPTFPPPATDVAAPGVPDLSIPYDLATRGQWQALFSHLSHPAHTPHPHHRLLLSALSALCLAKLRRFPDAAALLASLHPDPACPPPPFLIRLLHALLPLFLPDRPLALDRLYTLLSSVRARPNAGHPEWRRRDALVASVLAADHLAHREFDVALALLADIAGRYPGDPVLLSRLAYAHLQIGNLGAASAAFRHVESVAAASEDPTRHANLLARNRALECIVGKDYAAAVREYERCIEADPADAVALNNKALCLMYSRDLGDAIKVLEGALERVPTAALNETVVVNLCSMYELAFVNHGEVKRSLAEWIARVAPDDFDTSCTRM

SEQ ID NO: 9057 - protein, 330 aa, Setaria italica
MAAASSPTSPPPPPETDAAAPGLPDLSIPYDLATRGQWQALFSHLSHPAHVPHPHHRLLLSALSALSLAKLRRFPDAAALLASLHPDPACPPPPFLIRLLHALLPLFLPDRPLALDRLYTLLSSVRARPDAGHPEWRRRDALVASLLAADHLAHREFDVALALLSDIAARDPGDPVLLSRLAYAHLQIGNLAAASAAFRHVESVVAAAEDPARHANLLARNRALECIVAKDFAAAVREYERCIEADPADAVALNNKALCLMYSRDLGDAIKVLEGALERIPTAALNETVVVNLCSMYELAFVNHGEVKRSLAEWIARVAPDDFDTSCTRM

SEQ ID NO: 9058 - protein, 400 aa, Setaria italica
IKTSQNSIALLKAQVQRKYTNAEAQDPHAVHFQPTPPPVERGSTTRATPVTTHQRLLPSSPRSRSRSHRAMAAASSPTSPPPPPETDAAAPGLPDLSIPYDLATRGQWQALFSHLSHPAHVPHPHHRLLLSALSALSLAKLRRFPDAAALLASLHPDPACPPPPFLIRLLHALLPLFLPDRPLALDRLYTLLSSVRARPDAGHPEWRRRDALVASLLAADHLAHREFDVALALLSDIAARDPGDPVLLSRLAYAHLQIGNLAAASAAFRHVESVVAAAEDPARHANLLARNRALECIVAKDFAAAVREYERCIEADPADAVALNNKALCLMYSRDLGDAIKVLEGALERIPTAALNETVVVNLCSMYELAFVNHGEVKRSLAEWIARVAPDDFDTSCTRM

SEQ ID NO: 9059 - protein, 326 aa, Brachypodium distachyon
MSAASSPDPPRSPATSAAAAALPDLSIPHDLATRGQWQALLAHLAHPSRTHHPHHRLLLSALSALSLAKLRRFPDAAALLASLHPDPACPPPPFLLRLLHALLPLFFPDRPLALDRLYTLLSSVRARPDAQHPEWRRRDALVTSLLASDHLAHREFDVALALIADLAAREPDNPVLLSRLAYAHLQIGNLAAASAVFRHVESVAANDPSHANLLARNRALECIVAKDYAAAVREYERCLEVDPADAIALNNKALCLMYSRDLGDAIKVLEGALERVPTAALNETVVVNLCSMYELAFVNHSEVKRTLADWITRVAPDDFDKSCTRM

SEQ ID NO: 9060 - protein, 324 aa, Hordeum vulgare
MSATPALASPPATSAAAAALPDLSVPYDLATRGQWQALLAHLAHPSHAHHPHHRLLLSALSALSLAKLRRFPEGAALLASLHPDPGCPPPPFLLRLLHALLPLFFPDRPLALDRLYTLLSSVRARPDAQHPEWRRRDALVASILASDHLAHREFDVALALVAELVAREPDNPVLLSRLAYAHLQIGNLAAASAVFQHVESVVAGDSSHDNLLSRNRALECIVAKDYAAAVREYERCIEADPSDAIALNNKALCLMYSRDLGDAIKVLEGALETMPTAALNETVVVNLCSMYELAFVNHGEVKRTLADWITRVAPDDFDKSCTRM

SEQ ID NO: 9061 - protein, 323 aa, Triticum aestivum
MSATSALGSPATSAAAAPLPDLSIPYDLATRGQWQALLANLAHPSHAHHPHHRLLLSALSALSLAKLRRYPDGAALLASLHPDPGCPPPPFLLRLLHALLPLFFPDRPLALDRLYTLLSSVRARPDAQHPEWRRRDALVSSILASDHLAHREFDVALALVAELVAREPDNPVLLSRLAYAHLQIGNLAAASAVFQHVESVAAGDSSHDSLLSRNRALECIVAKDYAAAVREYERCIEADPADAIAVNNKALCLMYSRDLGDAIKVLEGALETMPTAALNETVVVNLCSMYELAFVNHGEVKRTLADWITRVAPDDFDKSCTRM

SEQ ID NO: 9062 - protein, 384 aa, Pennisetum glaucum
PTRQDSPISRSPTTWPRAGGAVGEEEGPPLGPHQRPRPSFFVPEISRSRSHRAMAASSSPTSPPPPPATEAADAPGLPDLSIPYDLATRGQWEALLSHLSHPAHVPHPHHRLLLSALSALSLAKLRRFPDAAALLASLHPDPACPPPPFLIRLLHALLPLFLPDRPLALDRLYTLLSSVRARPDAGHPEWRRRDALVASLLAADHLAHREFDVALALLANIAARDPGNPVLLSRLAYAHLQIGNLAAASAAFRHVESVAAAAEDPARHANLLARNRALECIVAKDFAAAVREYERCIEADPADAVALNNKALCLMYSRDLGDAIKVLEGALERIPTAALNETVVVNLCSMYELAFVNHGEVKRTLAEWIARVAPDDFDTSCTRM

SEQ ID NO: 9063 - protein, 316 aa, Secale cereale
GSPATSATAAPLPDLSTPYDLATRGQWQALLAHLAHPSHAHHPHHRLLLSALSALSLAKLRRFSDGAALLASLHPDPGCPPPPFLLRLLHALLPLFFPDRPLALDRLYTLLSSVRARPDAQHPEWRRRDALVSSILASDHLAHREFDVALALVAELVAREPDNPVLLSRLAYAHLQIGNLAAASAVFQHVESVAAGDSSHDNLLSRNRALECIVAKDYAAAVREYERCIEADPTDAIAVNNKALCLMYSRDLGDAIKVLEGALETMPTAALNETVVVNLCSMYELAFVNHGEVKRTLADWITRVAPDDFDKSCTRM

SEQ ID NO: 9064 - protein, 330 aa, Oryza sativa
MAEAAAAASNSTPASPPPPPAAAAALGLPDLSVPYDLATRGQWKSLLSNLDDASHPRHRLLLSALSALSLAKLRRYADAAALIASLRPDPGCPPPPFLLRLLHALLPLFLPADRPLALDRLYTLLSSVRARPDASHPEWRRRESLVASLLAADHLAHREFDVALALLASVAALDPGNPAVLSRLGYAHLQIGNLAAAAAAFRHVESVAGGDPAHASLLARNRALECVVAKDYAAAVREYERCIEADAADAVAVNNKALCLMYSRDLGDAIKVLEAALEGHPTAALNETVVVNLCSMYELAFVNHADVKRSLTDWIARVAPDDFDPSCTRM

SEQ ID NO: 9065 - protein, 216 aa, Zea mays
MAKTKQGKRDVDAYTIKGTNKVVRVGDCVLMRPADTDNPPYVARVERMESDGRGSVRVRVRWYYRPEEAKGGRRPFHGAKELFLSDHFDTQSAHTIEGKCIVHSFKSYTKLDNVGPEDFYCRFDYKAATGAFTPDRVAVYCKCEMPYNPDDLMVQCEGCKDWFHPSCMGMTIEQAKKIDHYMCSDCAKENGAKRPSNSYSVSPNSDSKIESKRRKR

SEQ ID NO: 9066 - protein, 216 aa, Setaria italica
MAKTKQGKRDVDAYTIKGTNKVVRVGDCVLMRPADTDKPPYVARVERMESDGRGGVRVRCRWYYRPEEAKGGRRPFHGAKELFLSDHFDTQSAHTIEGKCVVHSFKNYTKLDNVGPEDFYCRFDYKAGSGAFTPDRVAVYCKCEMPYNPDDLMVQCEGCKDWFHPSCMGMTIEQAKKIDHYMCSDCAKENGAKRPSNSYPVAPNSDSKIESKRRKR

SEQ ID NO: 9067 - protein, 216 aa, Pennisetum glaucum
MAKTKQGKRDVDAYTIKGTNKVVRVGDCVLMRPADTDKPPYVARVEGMESDGRGGVRVRCRWYYRPEEAKGGRRPFHGAKELFLSDHFDTQSAHTIEGKCVVHSFKNYTKLDDVGPEDFYCRFDYKAGSGAFTPDRVAVYCKCEMPYNPDDLMVQCEACKDWFHPSCMGMTIEQAKKIDHYMCSDCAKENGVKRPSNSYPVAPNSDSKIESKRRKR

SEQ ID NO: 9068 - protein, 215 aa, Panicum virgatum
MAKTKQGKRDVEAYSIKGTNKVVRVGDCVLMRPADTDNPPYVARVERMESDGRGGVRVRVRWYYRPEEAKGGRRPFHGAKELFLSDHFDTQSAHTIEGKCVVHSFKNYTKLDNVGPEDFYCRFDYKASSGAFTPDRVAVYCKCEMPYNPDDLMVQCEGCKDWFHPSCMGMTIEQAKKIDHYMCSDCAKENGAKRTSNSYLVPPNSDSKVILFFSL

SEQ ID NO: 9069 - protein, 216 aa, Triticum aestivum
MAKTKQGKRDIDSYTIRGTTKVVRVGDCVLMRPSDTDNAPYVARVESLESDGRGSVRVRVRWYYRPEESKGGRRQFHGAKELFLSDHFDTQSAHTIEGKCIVHSFKNYTKLDNVGPEDFFCRFEYKAATGAFTPDRVAVYCKCEMPYNPDDLMVQCEGCKDWFHPTCMGMTIEQAKKLDTFLCADCAKENGAKRPSNSYPSSPSSDSKVEPKRRKR

SEQ ID NO: 9070 - protein, 216 aa, Secale cereale
MAKTKQGKRDIDSYTIRGTTKVVRVGDCVLMRPSDTDNAPYVARVESLESDGRGSVRVRVRWYYRPEESKGGRRQFHGAKELFLSDHFDTQSAHTIEGKCIVHSFKNYTKLDNVGPEDFFCRFEYKAATGAFTPDRVAVYCKCEMPYNPDDLMVQCEGCKDWFHPTCMGMTIEQAKKLDTFLCADCAKENGVKRPTNSYPSSPSSDSKVEPKRRKR

SEQ ID NO: 9071 - protein, 216 aa, Brachypodium distachyon
MAKTKQGKRDVDSYTIKGTTKVVRVGDCVLMRSSDKDNPPYVARVESLESDGRGSLRVRVRWYYRPEESKGGRRQFHGAKELFLSDHFDTQSAHTIEGQCIVHPFKTYTKLDNVGPEDFFCRFEYKAATGAFTPDRVAVYCKCEMPYNPDDLMVQCEGCKDWFHPSCMGMTIEQTKKLDYFMCSDCAKENGTKRPSYSDPASPSSDSKVQPKRRKR

SEQ ID NO: 9072 - protein, 216 aa, Oryza sativa
MAKTKQGKKDVESYTIKGTTKIVRVGDCVLMRASDTEKAPYVGRVERLETDGRGSVRVRVRWYYRPEESKGGRRQFHGAKELFLSDHFDTQSAHTIEGKCVVHSFKNYTKLDNVGPEDFFCRFEYKAATGAFTPDRVAVYCKCEMPYNPDDLMVQCEGCKDWFHPSCMGMTIEQAKKLDHFLCADCVKENGTKRPSNSYPASSNSDSKVEPKKRKR

SEQ ID NO: 9073 - protein, 217 aa, Hordeum vulgare
MAKTKQGKRDIDSYTIRGTTKVVRVGDCVLMRPSDTDNAPYVARVESLESDGRGSVRVRVRWYYRPEESKGGRRQFHGAKELFLSDHFDTQSAHTIEGKCIVHSFKNYTKLDNVGPEDFFCRFEYKAATGAFTPDRVAVYCKCEMPYNPDDLMVQCEGCKDWFHPTCMGMTIEQAKKLDTFLCADCAKENGAKRPSNSYPSSPSSDSKVSDVLFPFL

SEQ ID NO: 9074 - protein, 216 aa, Setaria italica
MAKTKQGKKDVDSYTIRGTNKVVRVGDCVLMRPSDSDNQPYVARVEKMEADGRGSVRVRVRWYYRPEESKGGRRQFHGAKELFLSDHFDLQSAHTIEGKCVVHSFKNYTKLDNVGPEDFFCRFEYKAATGSFTPDRVAVYCKCEMPYNPDDLMVQCDACKDWFHPSCMGMTIEQAKKLDHFVCSDCVKENGSKRLSNAYATSPNSEPKAESKRQRR

SEQ ID NO: 9075 - protein, 216 aa, Panicum virgatum
MAKTKQGKKDVDSYTIRGTNKVVRVGNCVLMRPSDSDNQPYVARVEKMEADGRGSVRVRVRWYYRPEESKGGRRQFHGAKELFLSDHFDLQSAHTIEGKCVVHSFKNYTKLDNVGPEDFFCRFEYKAATGSFTPDRVAVYCKCEMPYNPDDLMVQCDACKDWFHPSCMGMTIEQAKKLDHFVCSDCVKENGPKRLSNGYATSPNSEPKAESKRQRR

SEQ ID NO: 9076 - protein, 241 aa, Panicum virgatum
MAKTKQGKRDVDAYTIKGTNKVVRVGDCVLMRPADTDNPPYVARVERMESDGRGGVRVRVRWYYRPEEAKGGRRPFHGAKELFLSDHFDTQSAHTIEGKCVVHSFKNYTKLDNVGPEDFYCRFDYKASSGAFTPDRVAVYCKCEMPYNPDDLMVQCEGCKDWFHPSCMGMTIEQAKKIDHYMCSDCAKENGAKRTSNSYPGPTNSDSKVIAFFFCLYQLSHDCIDCLLLFCFSCSFSFYLR

SEQ ID NO: 9077 - protein, 216 aa, Setaria italica
MAKTKQGKKDVDSYTIRGTNKVVRVGDCVLMRPSDSDNQPYVARVEKMEADGRGSVRVRVRWYYRPEESKSGRLQFHGAKELFLSDHFDLQSAHTIEGKCVVHSFKNYTKLDNVGPEDFFCRFEYKAATGSFTPDRVAVYCKCEMPYNPDDLMVQCDACKDWFHPSCMGMTIEQAKKLDHFVCSDCVKENGSKRLSNAYATSPNSEPKAESKRQRR

SEQ ID NO: 9078 - protein, 216 aa, Oryza sativa
MAKTKQGKRDVDSYTISGTNKVVRVGDCVLMRPVDSDNQPYVARVEKMELDGRGSVRVRVRWYYRPEESKGGRRQFHGAKELFLSDHFDMQSANTIEGKCVVHSFKNYTKLDNVGPEDFFCRFEYKAATGAFTPDRVAVYCKCEMPYNPDDLMVQCDDCKDWFHPSCMSMTIEQAKKLDHFVCSDCVKENGAKRPSHAYAGSTKYEPKAESKRQRR

SEQ ID NO: 9079 - protein, 216 aa, Sorghum bicolor
MAKTKQGKKDVDSYTIRGTNKLVHVGDCVLMRASDSDNQPYVARVEKMEADGRGSVRVRVRWYYRPEESKGGRLQFHGAKELFLSDHFDLQSAHTIEGKCVVHSFKNYTKLDNVGPEDFFCRFEYKAATGSFTPDRVAVYCKCEMPYNPDDLMVQCDACKDWFHPSCMSMTIEQAKKLDHFVCSDCLKENGSKRLSNAYATSPNSEPKAESKRQRR

SEQ ID NO: 9080 - protein, 216 aa, Amorphophallus konjac
MAKTKPGKKDLESYTIKGTNKVVKVGDCVLMRPSDLDKPPYVARVEKIEADHRNNVKVRVRWYYRPEESIGGRRQFHGAKELFLSDHYDVQSAHTIEGKCIVHSFKNYTKLENVGAEDYFCRFEYKAATGSFTPDRVAVYCKCEMPYNPDDLMVQCEGCKDWFHPSCMGMTIEQAKKLDHFLCSDCGTEDDSKRSLNSFPVSPVSEPKVESKRRKR

SEQ ID NO: 9081 - protein, 214 aa, Avena sativa
MAKIKQGKKDVDSYTIRGTNKVVRVGDTVLMRPSDTDNQPYVARVESMETDGRGSVRVKVRWYYRPEEAKGGRRQFHGAKELFRSDHLDMQSAHTIEGKCIVHSFKDYTKLNNVGAEDFFCRFDYNAASGAFSPDRVAVYCKCEMPYNPDDLMVQCDACKDWFHPSCVEMTIEQAKKIDHFMCSDCAEENGEKKPSNGYGPNAEPKTEPKRQRR

SEQ ID NO: 9082 - protein, 140 aa, Ananas comosus
MAKTKPGKRDLDSYTIKGTNKIVKVGDCVLMRPSDSEKPPYVARVEKIEADHRNNVRVRVRWYYRPEESIGGRRQFHGAKELFLSDHYDVQSAHTIEGKCTVHSFKNYTKLENVGAEDYFCRFEYKAATGGFTPDRVAVL

SEQ ID NO: 9083 - protein, 557 aa, Setaria italica
MVAAALDAMAGTRWGRWLGLVTAVWVQCISGNNYTFSNYSHALKTLMGLTQLQLNGLSVAKDVGKAFGLLAGLASDRVPTWLLLAIGSLEGLLGYGAQWMVVSGAVAPLPYWQMCVFLCLGGNSTTWMNTAVLVTCIRNFRRSRGPVSGLLKGYVGLSTAIFTDVCSALFADDPASFLVMLAVVPAAVCALAMVFLREGPNGGAAGGATADEAEDGRCFAAINSLAVAIALYLLAADLTGIGARGGAVSAVFVAVLLVLLASPGAVPALLAWKSWVKARKAANADLEEADSLAAAAAPLLVAAKTAAGRSEEEEARAPGERPRLGEEHTIAQALTSLDFWLMFASFLMGVGTGLAVMNNLGQMGVAMGYADVSIFVSMTSIWGFFGRIASGTISEHFIKTRAIPRPLWNAASQVLMAVGYIVMALAIPGSLFIGSVVVGACYGVRLAVTVPTASELFGLKYYGLIYNILILNLPLGSFLFSGMLAGLLYDAEATPVPGGGNTCVGAHCYRLVFLIMAVACAVGFGIDVLLSVRTKRVYAKIHESKRASRSAVAQRVS

SEQ ID NO: 9084 - protein, 529 aa, Zea mays
MAGTRWGRWLGLVTAVWVQCISGNNYTFSNYSHALKTLMGLTQLQLNGLSVAKDVGKAFGLLAGLASDRVPTWLLLAVGSLEGLLGYGAQWMVVSGAVAPLPYWQMCVFLCLGGNSTTWMNTAVLVTCIRNFRRSRGPVSGLLKGYVGLSTAIFTDTCSALFADDPASFLVMLAVVPAAVCALAMVFLREGAAAADEDDDGRCFAAINSLAVAIALYLLAADLTGLGGGGGVVFVAVLLVLLASPAAVPAILAWKSWAETRKAANADLEEADSLAAAAPLLLVAKEARAPGERPRLGEEHTIAQTLTSLDFWLMFASFLMGVGTGLAVMNNLGQMGVAMGYVDVSLFVSMTSIWGFFGRIASGTISEHFIKTRGIPRPLWNAASQVLMAVGYIVMALAMPGSLFIGSVVVGICYGVRLAVTVPTASELFGLKYYGLVYNVLILNLPLGSFLFSGLLAGLLYDAEATAVPGGGNTCVGAHCYRLVFLIMALACVVGFGLDVLLCVRTKRVYAKIHESKRLSRSAVAERVG

SEQ ID NO: 9085 - protein, 552 aa, Oryza sativa
MVAAALDAMAGTRWGRWLGLVTAVWVQCISGNNYTFSNYSHSIKTLMGLTQLQLNGLSVAKDVGKAFGLLAGLASDRVPTWLLLAVGSLEGLLGYGAQWLVVSRAVAPLPYWQMCVFLCLGGNSTTWMNTAVLVTCIRNFRRSRGPVSGLLKGYVGLSTAIFTDVCSALFADDPASFLVMLAVVPAAVCAVAMVFLREGEVGGGGADGREEEEEDGWCFAAINTLAVAIALYLLAADLTGVGGGGGVVSAVFVAVLLVLLASPAAVPAHVAWKSWMKTRKLANADVEEAEECASAPLLVAKATAAAAAEARGPGEKPVLGEEHTIAQALMSLDFWLMFASFLMGVGTGLAVMNNLGQMGVAMGYSDVSLFVSMTSIWGFFGRIASGTISEHFIKTRAIPRPLWNAASQILMAVGYVVMAVGMPGSLFVGSVVVGICYGVRLAVTVPTASELFGLKYYGLIYNILILNLPLGSFLFSGLLAGLLYDAQATKVPGGGNTCVGAHCYRLVFVVMAIACVVGFGLDVLLCFRTKRVYAKIHESKRQSRSAVVQRVS

SEQ ID NO: 9086 - protein, 560 aa, Brachypodium distachyon
MVSSALDAMSGTAWGRWLGLVAAVWVQCISGNNYTFSNYSDSIKTLMGLTQLQLNGLSVAKDVGKAFGLVAGLASDRVPTWLLLAIGSLEGFLGYGAQWLVVSRAVAPPPYWQMCVWLCLGGNSTTWMNTAVLVTCIRNFRGSRGPVSGVLKGYVGLSTAIFTDVCSALFADDPASFLVMLAVVPAAVCAVAMVFLREGPQAAAAAGRQEEDDARGFTAISMLAVAIALYLLAADLTGTGGGGGVVSTIFVAVLLVLLAAPVAVPAHVALRSWMKSRKAPNADAEAAEAAAAAAESTTAPLLLAAAPAKGEERNGSEAEARGPGERPRLGEEHTIAQALASMDFWLLFTSFLMGVGTGLAVMNNLGQMGSAMGYSDVSIFVSMTSIWGFFGRLASGTISEHFIKTRATPRPAWNAASQVLMAAGYVVMALGMPGSLFVGSVVVGICYGVRVAVTVPTASELFGLKHYGLIYNILILNLPLGSFLFSGLLAGLLYDAEATAVPGGGNTCAGAHCYRLVFVVMAVACVAGFALDVLLSLRTRRVYAKIHQAKSRSASVQRVS

SEQ ID NO: 9087 - protein, 547 aa, Hordeum vulgare
MAGTAWGRWLGLVAAVWVQCISGNNYTFSNYSDSIKTLMGLTQLQLNGLSVAKDVGKAFGLLAGLASDRVPTWLLLAVGSLEGFLGYGAQWLVVSRAVAPLPYWQMCVCLCLGGNSTTWMNTAVLVTCIRNFRGSRGPVSGVLKGYVGLSTAIFTDVCSALFADDPASFLVMLAVVPAAVCAVAMVFLREGRVADSDCTGAAGDEADARGFAAISTLAVAIALYLLAADLTGVGGGGGVVSTVFVAVLMVLLAAPVAVPAYVGWTSWMKSRKAANADAEDAAAPLLLDSKAAAAAQQGSEAEEARGPGERPRLGEEHTIAEALASVDFWVLFSSFLMGVGTGLAVMNNLGQMGVAMGYADVSLFVSMTSIWGFFGRIASGTISEHFIKTRALPRPVWNAASQVLMCAGYVLMAFGMPGSLFVGSVVVGVCYGVRLAVTVPTASELFGLKYYGLIYNILILNLPLGSFLFSGLLAGLLYDAEATKVPGGGNTCSGAHCYRLVFVVMAAACVVGFGLDVLLSLRTRRVYAKIHQAKRAKRLAAAAQRVS

SEQ ID NO: 9088 - protein, 540 aa, Triticum aestivum
MAGTAWGRWLGLVAAVWVQCISGNNYTFSNYSDSIKTLMGLTQLQLNGLSVAKDVGKAFGLLAGLASDRLPTWLLLAIGSLEGFLGYGAQWLVVSKTISPLPYWQMCVCLCLGGNSTTWMNTAVLVTCIRNFRGSRGPVSGVLKGYVGLSTAIFTDVCSALFADDPASFLVMLAVVPAAVCAVAMVFLREGRVASADSGGDEADARGFAAISTLAVAIALYLLAADLTGVGGGGGLVSTVFVAVLMVLLAAPAAVPAYVGWTSWMKSRKAANADAEDAAAPLLLDSKEATQPQGNGEAEEARGPRLGEEHTIAEALSSVDFWVLFSSFLMGVGTGLAVMNNLGQMGVAMGYTDVSIFVSMTSIWGFFGRLASGTISEHFIKTRALPRPVWNAASQVLMCAGYVVMAFGMPGSLFVGSVVVGVCYGVRLAVTVPTASELFGLKYYGLIYNILILNLPLGSFLFSGLLAGLLYDAEATKVPGGGNTCSGAHCYRLVFVVMAAACVVGFGLDVLLSLRTRRVYAKIHQAKRAKRSAAAAQRVS

SEQ ID NO: 9089 - protein, 1314 aa, Zea mays
MEASAASDETLAAVFAQLKLHTVALLDLLRTRRPISSSGSSLREMAAFLRAAPAPALQLCFDYTVFPLLLLLDAAVQCRKQGNAPGQVAGGIDIGDAVAEAGLTCLEVLLTKCHLTSVNQMVAMLKKLTSGAMLSPSEASEEFRGAIIRCFRALVLQLQPCLDHFCSCKHGIVLPTIPTSTCLEVRSVVRPNHSAQPEECLLAFLQSQNASAAVGHWLSLLLQASELEASRGHRGSADVRKESLHTLRILIGKVGSADALAFFLPGIVSRLGKVLYTAKTMISGAAGSSLSIEQAILGLTEALMIVLNDKENLSALGKHKNENHSGGSESTEHILQMLRQLPTKNISDKISHDEITDDSVSNVNNSFADRKALHVKRTKKWLEETTSNVDKLLSATFPHLAIHSSEKVRKAVVSGVKGLLSSCSSTLKRTKMLLLECLCVLACDDAAAVSEAAQDALDHLFNQGHNLVTEKEISDTFTRLVERLPQVVLGSEETTALSHARMLLALTFYAGPQFLINHLHRSPVIAARFFDCLGLCIGHSSQFSGSMDKLIVSKPLSIGYLYSVAELKSGAYSKDTTNISLHATSTSAASKISVIHDNALPNALLGTVEYELPHVPPWFFHAGSQKLYGVLAGIIRLVGLSTVSGEGTAATLSLFVDILLDQFRRLSTELRDKDVYNDGLQRWYMKGEAGQALRQASSAVCMLNELMYGLSGRSLGMFLQLFSNGSAQMPRTVCQKNQLLACVKHNAVTNKREVWGFSEQKGTKDNILHCISSILHEYVSPEVWDLPTEKDTELHLIELNLPLHFYRDTTALHTVVLEGIGVLGVLLGQDFALSGFMHSSLYLLLRELISSSAQIRTACDAVLRALATAGGHCSVGQFVVANADYIIDSLCRQLRHLDLNPHVPDVLASMLCYIGASRDILPFLEEPMQSISSELEVLGRHDHPRLTVPFLKAVSEISKACRHESTCLPDEAQSFYEKVSSEGQEVKIMIEKRMESSAISERKNVDARSYFMTLEYWEDLFCKLNEMRRYRRIVGSLAGSCLSAAIPLLSSNKETACLVALDIVESAAISIANVEEAYKCECQSKGVIEEAIQFCSFDELLDGTDATEDVDENRLLPAMNKLWPYLVICLRNKISVPVVRKCTEMLRRAICISGGDFYVRRFHKDGPIVWRLLALSPFRRLSKMDEKAIILPYRDTSLNSEEPMAEISSQKIQIAVLDMIAAISSNKRSAVALESVLKKVCGLVVGIAYSSLTDVYYSLNQRESLLPNQDLALVSDLLPPPVSSREYLFVQYGGEGVRFLILCICNLAEFLWSC

SEQ ID NO: 9090 - protein, 296 aa, Setaria italica
MAKKPIQYVVVDAFTAEPFKGNPASVCVLDDAERAADARWMQAVATEFNLSQTAFLLRDSSSAAAAAPRFGLRWFTPNTEVALCGHATLASAHYLFTSVLAEHEALIEFATKSGILTAKKVPAPASAGVSGEGKLFIELDLPAIDFVECDEAELPSLPETLNGVPVVSVHKSTTVSDFIVELSSGKEVADIIPNIHEIKRCSGRGVIFTGPAPDESGYDFFTRFFCPKFNIDEDPVCGSAHCVLAPYWARKLGKQKLTAFQVSPRSGTLYLELEAAARRVRIQGEAVTVMTGTLLT

SEQ ID NO: 9091 - protein, 300 aa, Saccharum officinarum
MAILAVASPLKTLNLSPADHSRIRLSSSVLHLPLRVPRWRRLRCSAQYSEAAAPPTSTTTPRPAEIPWSKELCNSVRLIGTVGTDVELRQLPSGSAVARGRLAVWKSATETTWVTLQFWDDLAIVASEHVKKGDRIFVSGRLVSDTVDEGPEKRHVYYKLAVQQLNFIESQPVRLYEPEASQDAPGGRRADYFNSTSNSTEDKNRDNMSSSRSTEELWQAVFANPLDWWDNRTNKKNPRYPDFKHKHTGEALWVDGRNNPNWVISQLAVLDSRLSSLQDNERKPVSYMYADEFMTLDGNR

SEQ ID NO: 9092 - protein, 300 aa, Zea mays
MAILAVASPLKTLNPSPGDHSRCRLSSSLLHLPLPVPRWRRLRCSAQYSEAAAQPTSTTTARPADIPWSKELCNSVRLIGTVGTDVELRQLPSGSAVARGRLAVWKSATETTWVTLQFWDDLAIVASEHVKKGDRIFVSGRLVSDTVDEGPEKRHVYYKLAVQQLNFIESQPVRLYEPEASQDALGGRRADYFNSISNSTEDKNRDNMSSSRSTEELWQVFFANPLDWWDNRTNKKNPRYPDFKHKQTGEALWVDGRNNPNWVISQLAVLDSRMSSLQDNERKPVSYMYADEFMTLDGNR

SEQ ID NO: 9093 - protein, 300 aa, Setaria italica
MAILAVASPLKTLNPSPADPRRRRLSYSLLRLPPPVPRGRRLWCSAQYGETAAPPTTTPRPAEIPWSRELCNSVRLIGTVGTEVELRQLPSGSAVARGRLAVWKSATETTWVTLQFWDDLALVASEHVKKGDRIFVSGRLVSDTVDEGPEKRHVYYKVAVQQLNFIESMQPVRLYEPEASDDNPGGSRGGYFDSTSSSSEDKNRDNISSSSRSTEELWQAFFANPLDWWDNRTNKKNPRYPDFKHKHTGEALWVDGRNNPNWVISQLAVLDSRMGSLQDNERKPVSYMYADDFMTLDGSR

SEQ ID NO: 9094 - protein, 299 aa, Panicum virgatum
MALAVASLLKTLNPSPAGHRRRRLSSSLLRLPPPVPRGRRPRCSAQYGEPVAPPTTTTPRPAEIPWSRELCNSVRLIGTVGTEVELRQLPSGSAVARGRLAVWKSATETTWVTLQFWDDLAHVASEHVKKGDRIYVSGRFVSDTVDEGPEKRHVYYKVAVQELNFIESMQPVRLYEPEASQDTPSGRRGDYFDSTSSSTEDKNRDTISSSRSTEELWQAFFANPLEWWDNRTNKKNPRYPDFKHKHTGEALWIDGRNNPNWVVSQLAVLHSRMGSLQDNERKPVSYMYADEFMTLDGNQ

SEQ ID NO: 9095 - protein, 282 aa, Echinochloa colona
PRRRHLSSSLLCFPQPVPCGRRLRYSAQYGEAAAPPTTTTTPRPAEIPLEQELCNSVRLIGTVGTEVELRQLPSGSAVARGRLAVWKSATETTWVTLQFWDDLALVASEHVKKGDRIYVSGRLVSDTVDEGPEKRHVYYKVAVQELNFIESMQPVRLYEPEASQDTPGGRRGDYFDYTSSSTDYKSRDNISSSRSTEELWQAFFANPLDWWDNRTNKKNPRYPDFKNKSTGEALWVDGRNNPNWVISQLAVLDSRMGSLQDNERKPVSYMYADEFMTLDGSR

SEQ ID NO: 9096 - protein, 733 aa, Sorghum bicolor
MSYHCRALVQGPFLHPPFSPGAAGAPAPSLGVSVGLPSRALRLPRPARASVEKREQQATMEEKAGQAAFGWAARDATGVLSPYNFSRRVPKDDDVTIKVLYCGICHTDLHIIKNDWGNAMYPVVPGHEIVGVVTGVGGGVTRFKAGDTVGVGYFVGSCRSCDSCGKGNENYCAGVVQTSNGVDYAHGGVPTKGGFSDVIVVNEHYVVRVPDGLALDRTAPLLCAGVTVYSPMMRHGLNEPGKHLGVVGLGGLGHVAVKFGKAFGMKVTVISTSASKRQEAIESLGADEFLISRDPEEMKAATGTMDGIIDTVSAWHPITPLLALLKPLGQMVVVGGPSKPLELPAYAIVPGGKGVAGNSVGSVGDCQAMLEFAGKHGIGAEVEVIKMDYVNTAIERLEKNDVRYRFGDADVTIKVLFCGICHTDLHVIKNEWGNAMYPVVPGHEVVGVVTDVGHGVTKFKAGDTVGVGYFVDSCRTCESCSTGHENYCPDLVLTSNGVDHHHHGATTKGGFSDVLVVSQDFVVRVPESLPLDGAAPLLCAGVTVYSPMAQYALNEPGKHLGVVGLGGLGHMAVKFAKAFGMTVTVISSSPGKRDEALGRLGADAFLVSHDAAQMKAAAATLDGIIDTVSAGHQIVPLLALLKPMGQMVVVGAPSTPLELPAYAIITGGKRVAGNGVGSVADCQAMLDFAGEHGVTADIEVVQMDYVNTAIERLEKNDVRYRFVIDVAGSKMEE

SEQ ID NO: 9097 - protein, 365 aa, Zea mays
MEQGGKMAHGWAARDASGLLSPYSFSRRVQGDDDVTIKVLFCGICHTDLHIIKNEWGNAMYPVVPGHEVVGVVTDVGHGVSKFKAGDTVGVGYFVDSCRACESCSTGHENYCPDLVLSSNGVDHHHHDGGASASATTKGGFSDVLVVSQDFVVRVPESLPPDGAAPLLCAGVTVYSPMVQYALNGPGKHLGVVGLGGLGHLAVKFGKAFGMTVTVISSSPAKREEALGRLGADAFLVSHDASQMKAAAATMDGIIDTVSAGHQIVPLLALLKPMGQMVVVGAPSTPLELPAYAIITGGKRVAGNGVGSVADCQAMLDFAAEHGVTADTEVVPMDYVNTAIERLEKNDVRYRFVVDVAGSQMDTVA

SEQ ID NO: 9098 - protein, 357 aa, Setaria italica
MEQGGKPVLGWAARDASGHLSPYRFSRRVQRDGDVTIKVLFCGICHTDLHVIKNEWGNAMYPVVPGHEVVGVVTDVGTGVTKFKAGDTVGVGYFVDSCGACESCGTGHENYCPNLVLASNGVDSDGATTKGGFSDVVVVSKDYVVRVPESLPPDGAAPLLCAGVTVYSPMMQYGLNEPGKHLGVVGLGGLGHMAVKFGKAFGMTVTVISSSPGKREEALGRLGADAFLVSHDAAQMKAAAGSMDGIIDTVSAGHQIVPLLELLKPMGQMVVVGAPSKPLELPAYAIIAGGKRVAGNGVGSIADCQAMLDFAGEHGIAADVEVVGMDYVNTAIQRLERNDVRYRFVVDVAGSQLDATA

SEQ ID NO: 9099 - protein, 357 aa, Brachypodium distachyon
MEQGKAALGWAARDASGHLSPYNFSRRVQKDDDVTIKVLFCGICHTDLHIIKNEWGNALYPIVPGHEVVGVVTDVGPGVKNFKAGETVGVGYFLDSCRTCDSCSKGHENYCPTLVLTSNGVDYDGATTQGGFSDVVVVNQDYVVRVPDTLPPDGAAPLLCAGVTVYSPMMQYGLNAPGKHLGVVGLGGLGHMAVKFGKAFGMKVTVISSSLRKREEALDRLGADDFLVSSDAEQMKAAAGAMDGIIDTVSAGHPIVPLLELLRPMGQMVVCGAPSEPLQLPAYAVITGGKRIAGNGVGSVRDCQAMLDFAGEHGITADVEVVKMDYVNTAVERLERNDVRYRFVIDVAGSLQQGGAA

SEQ ID NO: 9100 - protein, 360 aa, Sorghum bicolor
MEQVSKAALGWAARDASGHLSPYSFSRVLRDGDVTIKVLFCGVCHTDLHIIKNEWGNALYPVVPGHEVVGVVTDVGAGVTKFKAGDTVGVGYFIDSCRTCESCSTGHENYCPDLVLTSNGVARDGGVTTTTTTQGGFSDVVVVDQHYVVRVPASLPPDGAAPLLCAGVTVYSPMVEYGLNVPGKRLGVVGLGGLGHIAVKFGKAFGMAVTVISSSPAKRGEAIERLGADEFLVSRDTEQMKAAAGTMDGIIDTVSAGHPIVPLLALLKPMGQMVIVGAPSTPLELPAYAIITGGKRVAGNGVGSIADCQAMLDFAGQHGITADIELVRMDYVNTAMERLERNDVRYRFVVDVAGSLGAAA

SEQ ID NO: 9101 - protein, 356 aa, Setaria italica
MEQGGKAVLGWAARDASGHLSPYSFSRRVLRDGDVTIKVLFCGICHTDLHVIKNEWGNAMYPVVPGHEVVGVVTDVGPGVTKFEAGDTVGVGYFVDSCRSCESCSTGHENYCPDVVLASNGVDGDGATTQGGFSDVVVVDQDYVVRVPRSLPPDGAAPLLCAGVTVYSPMVQYGLNAPGKRLGVVGLGGLGHIAVKFGKAFGMTVTVISSSPGKREEAIERLGADEFLVSSDPEQMKAEAGTMDGIIDTVSAWHPLAALLELLKPMGQMVLVGVPSKPLELPAFAVCPSGKRVAGNGVGSVGDCQAMLDFAGEHGITADVEVVGMDYVNKAIERLERNDVRYRFVVDVAGSLGADA

SEQ ID NO: 9102 - protein, 356 aa, Triticum aestivum
MEKGTPAIGWAARDDSGLLSPYSFSRRVPKDDDVTIKVLFCGICHTDLHIAKNEWGNALYPIVPGHEIVGIVTDVGPGVKSFKAGDTVGVGYFLDSCRSCDTCSKGYENYCPTLVLTSNGVDYDGATTQGGFSDVLVVNQDYVLRVPESLSLAGAAPLLCAGVTVYSPMMQYGLNAPGKHLGVVGLGGLGHMAVKFGKAFGMTVTVISSSPRKREEALERLGADAFLVSRDAEQMKAAAGTMDGIIDTVSAGHPLVPLLELLKPMGQMVVVGAPSEPLALPAYAIIGGGKRVAGNGVGSVSSCQAMLDFAGKHGITADVEVVKMDYVNTAVERLEKNDVRYRFVIDVAGSQLDAAA

SEQ ID NO: 9103 - protein, 356 aa, Hordeum vulgare
MEKGTPALGWAARDESGLLSPYSFSRRARKDEDVTIKVLFCGICHTDLHIAKNEWGNALYPIVPGHEIVGVVTDVGPGVKSFKVGDTVGVGYFVDSCRSCGTCSKGYENYCSTLVLTSNGVDYDGATTQGGFSDVLVVNQDYVLRVPESLSLAGAAPLLCAGVTVYSPMMQYGLNAPGKHLGVVGLGGLGHMAVKFGKAFGMTVTVISSSPRKREEALERLGADAFLVSQDAEQMKAAAGTMDGIIDTVSAGHPLVPLLELMKPMGQMVVVGAPSEPLALPAYAIIGGGKRLAGNGVGSVRDCQAMLDFAGKHGITADVEVVKMDYVNTAVERLEKNDVRYRFVIDVAGSQLGAAA

SEQ ID NO: 9104 - protein, 357 aa, Panicum virgatum
MEQGGKAALGWAARDASGHLSPYSFSRRVPRDGDVTIKVLFCGLCHTDLHIIKNEWGNAMYPVVPGHEVVGVVTDVGPGVTKFVAGDTVGVGYFVDWCRSCESCGAGHENYCPGVVLASNGVDGDGATTQGGFSDVVVVDQGYVVRVPRSLPPDGAAPLLCAGVTVYSPMVEYGLNAPGKRLGVVGLGGLGHMAVKFAKAFGMAVTVISSSPGKREEAIGRLGADEFLVSRDPEQMKAAAGTMDGIIDTVSAWHPLAPLLELLKPMGQMVLVGVPSKPLELPAFAVCPSGKRVAGNGVGSVGDCQAMLDFAGEHGITADVEVVGMDYVNTAIERLERNDVRYRFVVDVAGSLLGAAA

SEQ ID NO: 9105 - protein, 356 aa, Triticum aestivum
MEKGTPALGWAARDESGLLSPYSFSRRVQKDDDVTIKVLFCGICHTDLHIAKNEWGNALYPIVPGHEIVGVVTDVGPGVESFKAGDTVGVGYFIDSCRSCDTCSKGYENYCSTLVLTSNGVDYDGATTQGGFSDVLVVNQDYVLRVPESLSLAGAAPLLCAGVTVYSPMMQYGLNAPGKHLGVVGLGGLGHMAVKFGKAFRMTVTVISSSPRKREEALERLGADAFLVSQDAEQMKAAAGTMDGIIDTVSAGHPLVPLLELLKPMGQMVVVGAPSEPLALPAYAIIGGGKRVAGNGVGSVSSCQAMLDFAGKHGITADVEVVKMDYVNTAVERLERNDVRYRFVIDVAGSQLDAAA

SEQ ID NO: 9106 - protein, 314 aa, Brachypodium distachyon
MRSLRAAHTLASRSLLLSARALHGTACPGAAAAAGGRWGAPPPAPSSRVVPAGIAGAVSFSLTFATVAAAEVQAKERLPVDLLPQNVVLYQYQACPFCNKVRAFLDYHDIPYKVVEVNPLSKKEIKWSEYKKVPILTVDGEHLVDSSDIINILQRKISPDDDVMSEEEAKWRRWVDEHLVHILSPNIYRTTSEALESFDYIAKHGNFSTVERFAAKYAGAAAMYMVSKKLMKKYNITDARASLYEACNTWTEALNGRNFLGGSKPNLADLAVFGVLRPIRYLRSGKDMVEHTQIGEWYQRMEDAVGEPSRIQDE

SEQ ID NO: 9107 - protein, 319 aa, Triticum aestivum
MRSLRAARTLLASRSFLLSSRALHAAAASPAAGRWGNAPPPPPTPCPGPSSRAGIAGAVSFSLTFATVAVAEVQAKERLPTDLLPRNVVLYQYQACPFCNKVRAFLDYHDIPYKVVEVNPLSKKEIKWSEYKKVPILTVDGEHLVDSTDIINILQHRISPDDEVTNEEETKWRKWVDEHLVHVLSPNIYRTTSEALESFDYIAKHGNFSYTERFAVKYAGAAAMYFVAKKLKKKYNITDERASLYDAANTWTEALNGRNFLGGSKPNLADLAAFGVLRPIRYLQSGKDMVEHTQIGEWYQRMEDAVGEPSRIPEGQYQE

SEQ ID NO: 9108 - protein, 186 aa, Saccharum officinarum
MGSGKASSPPGAAAAGGSGSPPGGAVVCCMCGDRGLLPELFRCSACSVRSQHTYCTDRYPKVESYGTCNWCLRADGGVASTSNSPRSTGKAAARSAPHGGDTTGSGSGRSPKVAARGDFASSNLSKPIKKQQPQQQHAQRLLLRRSASDLGSRVRTDHNAPPASPGVARGRPRVRRYKLLEEVITS

SEQ ID NO: 9109 - protein, 182 aa, Zea mays
MGSGKASSPPGPTAGGRGSPPGAAVCCMCGDRGLLPELFRCSACSVRSQHTYCTDRYPKVESYGVCNWCLRADGGVASTSNSPRSAGKAVVQRPAPHGGDKIGSGTSPKAAARGDFASSNLSKPIKKQPQQHAQRLLLRRSASDLGSRVVRTDHDAPPSPGVTTRGRPRVRRYKLLEEVITS

SEQ ID NO: 9110 - protein, 177 aa, Zea mays
MGSGKASSPPGAAAGGSAPPPGGAVVCCMCGDRGVLSELFRCSACSVRSQHTYCTDRYPKAESYGTCNWCLRADGRVASTSNSPRSAGKAAARPPSHGGDTIGSGRSPKVAARGDFASSNLSKPVKKQHAQRILLRRSASDLGSRVPTDHNAPPSPGVARGRPKVRRYKLLEEVISS

SEQ ID NO: 9111 - protein, 182 aa, Setaria italica
MGSGKASSPGAVAGASGGPPQQPPGAAVCCMCGDRGLLPELFRCSACSVRSQHTYCTDRYPKVESYGTCNWCLRVDGGVAASTSSSPRSAGKAAARSPAGHSDPTSGGGRSPKVAARGDFASSNPSKPIKKQQPQHQRLLLRRSASDLGSRAVRDAPPPSPGVARGRPRVRRYKLLEEVITS

SEQ ID NO: 9112 - protein, 1090 aa, Setaria italica
MAGGQQPEASPGRYQRRRDEIDDDCADVLGVDVRGPDADPFDIPAKRAPVERLRRWRQAALVLNASRRFRYTLDLKKEEEKEQIRRKIRAHAQVIRAALLFKEAGEKQNGDRELPEILPRGFGIREEQLTVMTRDHNYSALQEYGGVKGLTNLLKTNSEKGIHGDEADLSCRANAFGANRYPRKKGRSFWVFLWEACQDMTLVILIIAAIISLVLGIATEGIKEGWYDGTSIAFAVFLVIVVTAVSDYKQSLQFQHLNEEKQNIQVEVIRGGRRIQVSIFDIVVGDVVALKIGDQVPADGVVISSHSLAIDESSMTGESKIVMKDQKTPFLMAGCKVADGYGTMLVTAVGLNTEWGLLMASISEDNNEETPLQVRLNGVATFIGIVGLSVAAMVLIVLFARYFSGHTTNSDGSVQFVKGRTSAKSAIFGSIKILTVAVTIVVVAVPEGLPLAVTLTLAYSMRKMMADKALVRRLSACETMGSATTICSDKTGTLTLNQMTVVQSIVGGVKLQAPANVDNLSPTVVSLLLEGIAQNTSGSVFEAQDGSVEITGSPTEKAILAWGLELRMKFAEERSRSAIIHVSPFNSEKKRAGVAVAVRDSDIHVHWKGAAEIVLDLCKSWIDVDGSNHEMTPDKANQLKKFIEDMAEQSLRCIAFAYRNLDLEDVPSEEQRISWQLPDDDLTLIGIAGMKDPCRPEVREAVELCKKAGVKVRMVTGDNLKTARAIALECGILEDSDASAQAIIEGRVFRAYNDTEREDVADKISVMARSSPNDKLLLVKALKKRGHVVAVTGDGTNDAPALHEADIGLAMGIQGTEVAKESSDIIILDDNFSTVVKVVRWGRSVYANIQKFIQFQLTVNVAALVINVVAAVSSGNVPLNAVQLLWVNLIMDTLGALALATEPPTDQLMRRSPVGRREPLVTNIMWRNLFIQAVFQVAVLLTLNFRGRNLLHLTQDTLDYSSKVKNTVIFNTFVLCQVFNEFNSRKPEELNIFSGVSRNHLFLGVVTITVVLQVIIIEFLGKFTSTVRLNWKLWLVSVVIAFVSWPLAFVGKFIPVPKTELKDIILRCWPQRNERAEQQGQDERRAESQV

SEQ ID NO: 9113 - protein, 1040 aa, Setaria italica
MAGGQQPEASPGRYQRRRDEIDDDCADVLGVDVRGPDADPFDIPAKRAPVERLRRWRQAALVLNASRRFRYTLDLKKEEEKEQIRRKIRAHAQVIRAALLFKEAGEKQNGDRELPEILPRGFGIREEQLTVMTRDHNYSALQEYGGVKGLTNLLKTNSEKGIHGDEADLSCRANAFGANRYPRKKGRSFWVFLWEACQDMTLVILIIAAIISLVLGIATEGIKEGWYDGTSIAFAVFLVIVVTAVSDYKQSLQFQHLNEEKQNIQVEVIRGGRRIQVSIFDIVVGDVVALKIGDQVTAVGLNTEWGLLMASISEDNNEETPLQVRLNGVATFIGIVGLSVAAMVLIVLFARYFSGHTTNSDGSVQFVKGRTSAKSAIFGSIKILTVAVTIVVVAVPEGLPLAVTLTLAYSMRKMMADKALVRRLSACETMGSATTICSDKTGTLTLNQMTVVQSIVGGVKLQAPANVDNLSPTVVSLLLEGIAQNTSGSVFEAQDGSVEITGSPTEKAILAWGLELRMKFAEERSRSAIIHVSPFNSEKKRAGVAVAVRDSDIHVHWKGAAEIVLDLCKSWIDVDGSNHEMTPDKANQLKKFIEDMAEQSLRCIAFAYRNLDLEDVPSEEQRISWQLPDDDLTLIGIAGMKDPCRPEVREAVELCKKAGVKVRMVTGDNLKTARAIALECGILEDSDASAQAIIEGRVFRAYNDTEREDVADKISVMARSSPNDKLLLVKALKKRGHVVAVTGDGTNDAPALHEADIGLAMGIQGTEVAKESSDIIILDDNFSTVVKVVRWGRSVYANIQKFIQFQLTVNVAALVINVVAAVSSGNVPLNAVQLLWVNLIMDTLGALALATEPPTDQLMRRSPVGRREPLVTNIMWRNLFIQAVFQVAVLLTLNFRGRNLLHLTQDTLDYSSKVKNTVIFNTFVLCQVFNEFNSRKPEELNIFSGVSRNHLFLGVVTITVVLQVIIIEFLGKFTSTVRLNWKLWLVSVVIAFVSWPLAFVGKFIPVPKTELKDIILRCWPQRNERAEQQGQDERRAESQV

SEQ ID NO: 9114 - protein, 1086 aa, Brachypodium distachyon
MPTGVQAPEASPGRYQRHRDEVPDDVGCEDVLGIDLEPVADPFDIPAKRAPVERLRRWRQAALVLNASRRFRYTLDLKKEEEKEQIRRKIRAHAQVIRAALLFKEAGEKQNGEMELSEMPSQGFRIRADQLTAMTRDHNYSALQEYGGVNGLTKLLKTNPEKGVHGDEADLSCRLGAFGANRYPRKKGRSFWVFLWEACQDLTLAILIVAAVISLVLGIATEGIKEGWYDGASIAFAVFLVILVTAVSDYKQSLQFQHLNEEKQNIQVEVIRGGRRIQVSIFDIVVGDVVALKIGDQVPADGVLISGHSLAIDESSMTGESKIVFKDQKSPFLMGGCKVADGYGTMLVTAVGLNTEWGLLMASISEENNEETPLQVRLNGVATFIGIVGLVVAAMVLVVLFARYFTGHTTNPDGSVQFVKGRTGVKSIIFGVIKILTVAVTIIVVAVPEGLPLAVTLTLAYSMRKMMADKALVRRLSACETMGSATTICSDKTGTLTLNQMTVVRSIVAGIELQPVAAVEKLSPTVTSVVLEGIAQNTSGSVFEPEDDNTVEVTGSPTEKAILSWGLELHMKFAEERSKSAIIHVSPFNSEKKRGGVAVITRDSDVHVHWKGAAEIVLALCTNWLNVDGSTHKMTPDKANQFKKYIEDMAEQSLRCVAFAYRNLDLKDVPSEEQRTNWQVPDNDLTLIAIVGMKDPCRPGVRDAVELCTNSGVKVRMVTGDNLQTARAIALECGILTDPHASAPVIIEGRVFREYGDADREAIADKISVMGRSSPNDKLLLVKALKKNGHVVAVTGDGTNDAPALHEADIGLSMGIQGTEVAKESSDIIILDDNFASVVKVVRWGRSVYANIQKFIQFQLTVNVAALIINVVAAISSGNVPLNAVQLLWVNLIMDTLGALALATEPPTDQLMKRTPVGRREPLVTNIMWRNLFIQAAYQVAVLLTLNFRGRNLLHLTQDTLEHSSKVKNSFIFNTFVLCQVFNEFNSRKPEELNIFEGVSRNHLFLAVVSITIVMQVVIIEFLGKFTSTVKLTWELWLVSLAIAFVSWPLAFVGKFIPVPKTPLKNLILKCWPKWKKQGEGPAPPV

SEQ ID NO: 9115 - protein, 1090 aa, Brachypodium distachyon
MPTGVQAPEASPGRYQRHRDEVPDDVGCEDVLGIDLEPVADPFDIPAKRAPVERLRRWRQAALVLNASRRFRYTLDLKKEEEKEQIRRKIRAHAQVIRAALLFKEAGEKQNGEMELSEMPSQGFRIRADQLTAMTRDHNYSALQEYGGVNGLTKLLKTNPEKGVHGDEADLSCRLGAFGANRYPRKKGRSFWVFLWEACQDLTLAILIVAAVISLVLGIATEGIKEGWYDGASIAFAVFLVILVTAVSDYKQSLQFQHLNEEKQNIQVEVIRGGRRIQVSIFDIVVGDVVALKIGDQVPADGVLISGHSLAIDESSMTGESKIVFKDQKSPFLMGGCKVADGYGTMLVTAVGLNTEWGLLMASISEENNEETPLQVRLNGVATFIGIVGLVVAAMVLVVLFARYFTGHTTNPDGSVQFVKGRTGVKSIIFGVIKILTVAVTIIVVAVPEGLPLAVTLTLAYSMRKMMADKALVRRLSACETMGSATTICSDKTGTLTLNQMTVVRSIVAGIELQPVAAVEKLSPTVTSVVLEGIAQNTSGSVFEPEVTSQDDNTVEVTGSPTEKAILSWGLELHMKFAEERSKSAIIHVSPFNSEKKRGGVAVITRDSDVHVHWKGAAEIVLALCTNWLNVDGSTHKMTPDKANQFKKYIEDMAEQSLRCVAFAYRNLDLKDVPSEEQRTNWQVPDNDLTLIAIVGMKDPCRPGVRDAVELCTNSGVKVRMVTGDNLQTARAIALECGILTDPHASAPVIIEGRVFREYGDADREAIADKISVMGRSSPNDKLLLVKALKKNGHVVAVTGDGTNDAPALHEADIGLSMGIQGTEVAKESSDIIILDDNFASVVKVVRWGRSVYANIQKFIQFQLTVNVAALIINVVAAISSGNVPLNAVQLLWVNLIMDTLGALALATEPPTDQLMKRTPVGRREPLVTNIMWRNLFIQAAYQVAVLLTLNFRGRNLLHLTQDTLEHSSKVKNSFIFNTFVLCQVFNEFNSRKPEELNIFEGVSRNHLFLAVVSITIVMQVVIIEFLGKFTSTVKLTWELWLVSLAIAFVSWPLAFVGKFIPVPKTPLKNLILKCWPKWKKQGEGPAPPV

SEQ ID NO: 9116 - protein, 1027 aa, Triticum aestivum
AALVLNASRRFRYTLDLKKEEEKEQIRRKIRAHAQVIRAALLFKEAGEKQNGDTELPEILPRGFGIGEDQLTSMTRDHNYSALQEYGGVKGLTNLLKTNPEKGIHGDEADLSCRANAFGANRYPRKKGKSFWVFLWEACKDLTLVILIVAAAISLVLGIATEGIKEGWYDGASIAFAVFLVILVTAVSDYKQSLQFQHLNEEKQNIQVEVIRGGRRIQVSIFDIVVGDVVALKIGDQVPADGILISGHSLAIDESSMTGESKIVLKDQNSPFLMGGCKVADGYGTMLVTAVGLNTEWGLLMASISEDNNEETPLQVRLNGVATFIGIVGLVVAAMVLVVLFARYFTGHTTNPDGTVQFVKGRTGVKSTIFGVIKILTVAVTIVVVAVPEGLPLAVTLTLAYSMRKMMADKALVRRLSACETMGSATTICSDKTGTLTLNQMTVVRSIVGAIELQPQATIDKLSHTVTSLVLEAIAQNTSGSVFEPEDGSTVEVTGSPTEKAILSWGLELHMKFAVERSKSAIIHVSPFNSEKKRGGVAVIGRDSDVHVHWKGAAEIVLALCTNWLDVDGSTHEMTPDKANHFRKYIEDMAEQSLRCVAFAYRNLDPKDIPSEEQRINWELPDNDLTLIGIVGMKDPCRPGVRDAVELCTNSGVKVRMVTGDNLQTARAIALECGILTDPQASAPVIIEGKVFRAYSDAEREAVADKISVMGRSSPNDKLLLVKALKKNGHVVAVTGDGTNDAPALHEADIGLSMGIQGTEVAKESSDIIILDDNFASVVKVVRWGRSVYANIQKFIQFQLTVNVAALIINVVAAISSGNVPLNAVQLLWVNLIMDTLGALALATEPPTDQLMKRTPVGRREPLVTNIMWRNLFIQAVYQVAVLLTLNFRGRDLLHLTQDTLEHSSKVKNSFIFNTFVLCQVFNEFNARKPEELNIFEGVSRNHLFLAVVSVTVVLQVIIIEFLGKFTSTVRLSWQLWLVSLAIAFISWPLALVGKFIPVPQTPLKNLILKCWPKKKKQGDEGAAPPV

SEQ ID NO: 9117 - protein, 990 aa, Zea mays
MVFCASDMLVLKFPIITSTSAAVHAVITVFICSLIFTRSYCVFLLWQQAALVLNASRRFRYTLDLKKEEEKEQIRRKIRAHAQVIRAALLFKEAGEKQTHETELPEILPRDFGIGEEQLTVMTRDHNYSALQEYGGVIGLANLLKTNLEKGIHGDEADLSCRANAFGPNRYPRKKGRSFWVFLWEACQDMTLVILIIAAVISLVLGIATEGTKEGWYDGTSIAFAVFLVIVVTAVSDYKQSLQFQHLNEEKQNIQVEVIRGGRRIQVSIFDIVVGDIVALKIGDQVSADGVVISGHSLAIDESSMTGESKIVMKDQKSPFLMAGSKVADGYGTMLVTAVGLNTEWGLLMASISEDNNEETPLQVRLNGVATFIGIAGLSVAAMVLVVLFARYFTGHTTDSDGSVQFVKRHTSVKSAIFGSIKILTVAVTIVVVAVPEGLPLAVTLTLAYSMRKMMADKALVRRLSACETMGSATTICSDKTGTLTLNQMTVMQSIVGEVKLQPPANVDKLSSTVASLLLEGIAQNTSGSVFEAQDGSVEVTGSPTEKAILSWGLDRDSNVHVHWKGAAEIVLALCTSWLNVDGSTHEMTPDKDPCRPEVRDAVELCKKAGVKVRMVTGDNLKTAKAIALECGILDDSEASAQAIIEGRVFRAYDDTERENVADKISVMARSSPNDKLLLVKALKKIGHVVAVTGDGTNDAPALHEADIGLSMGIQGTEVAKESSDIIILDDNFSSVVKVVRWGRSVYANIQKFIQFQLTVNVAALVINVVAAVSSGNVPLNAVQLLWVNLIMDTLGALALATEPPTDQLMRRPPVGRREPLVTNIMWRNLFIQAVFQVAVLLTLNFRGRDLLHLTHDTLGHSSKVKNTLIFNTFVLCQVFNEVNSRKPEELNIFSGVSRNHLFLAVVSITVVMQVIIIEFLGKFTSTVRLNWKLWLVSVVIAFLSWPLAFVGKFIPVPRTELKDLIVRCWPKRGESAAQQTQDDRMEVPV

SEQ ID NO: 9118 - protein, 1029 aa, Oryza sativa
MPVGVQAPEASPGRYHRRRDDDDGNGSDCSDVLGVDVLDEGADPFDIPAKRASVERLRRWRQAALVLNASRRFRYTLDLKKEEEKEQIRRKIRAHAQVIRVKGLANLLKTNTEKGVHGDEVDLACRANAFGANRYPRKKGRSFLVFLWEACQDLTLVILIIAAVISLVLGIATEGIKEGWYDGASIAFAVFLVILVTAVSDYKQSLQFQHLNEEKQNIQVEVIRGGRRIEVSIFDIVVGDVVALKIGDQVPADGVLVSGHSLAIDESSMTGESKIVVKDHKSPFLMGGCKVADGYGTMLVTAVGLNTEWGLLMASISEDNNEETPLQVRLNGVATFIGIVGLSVAAMVLIVLVARYFTGHTTNPDGSIQFVKGQTSVKSTIFGTIKILTIAVTIVVVAVPEGLPLAVTLTLAYSMQKMMADKALVRRLSACETMGSATTICSDKTGTLTLNQMTVVRSVVGGIKLKSPADIENLSPVVSSLILEGIAQNSSGSVFEPEDGSPIEITGSPTEKAILSWGVEFHMKFAEEKSKSSIIHVSPFNSEKKRAGVAVIVDDSDIHVHWKGAAEIVLALCTNWLDVNGISHEMTPDKANQFKKYIEEMAEESLRCVAFAYRTLDLNYVPNEEERINWELPDNELALIGIVGMKDPCRPGVRNAVDLCKNAGVKVRMVTGDNLQTARAIALECGILTDSQASQPVIIEGKVFRAYSDAEREAVADQISVMGRSSPSDKLLLVKALKKKGNVVAVTGDGTNDAPALHEADIGLAMGIQGTEVAKESSDIIILDDNFASVVKVVRWGRSVYANIQKFIQFQLTVNVAALIINVVAAISSGNVPLNAVQLLWVNLIMDTLGALALATEPPTDQLMKRPPVGRKEPLVTNIMWRNLFIQAVFQVTVLLTLNFRGRDLLHLTQDTLDHANKVFNEFNSRKPYELNIFDGVSRNHLFLAVVSITVVLQVIIIEFLGKFTSTVRLSWKLWLVSVGIGFVSWPLAFSGKFIPVPQTELKTYISRCLPGKKDNEGSTPPPPPPPPV

SEQ ID NO: 9119 - protein, 91 aa, Saccharum officinarum
MSLRYMSRVGARAAQAVRESTGRSVKDKAQSSSASMARSNGGRPAPAAGSVESGRASAAAAARRKAEEEKRRRAEQALRTVMFLSVWGPNT

SEQ ID NO: 9120 - protein, 90 aa, Panicum virgatum
MSLRYVSRVGARAAQAVRESTGRSVKDKAQSASSSASMARSSRAPAAGSVDSGRASAAAAARRKAEEERRRRAEQALRTVMFLSVWGPNT

SEQ ID NO: 9121 - protein, 88 aa, Pennisetum glaucum
MSLRYMSRVGARAAQAVRESTGRSVKDKAQSASSSASMARSGRAAGSVDSGRVSAAAAARRKAEEEKRRRAEQALRTVMFLSVWGPNT

SEQ ID NO: 9122 - protein, 90 aa, Panicum virgatum
MSLRYMSRVGARAAQAVRESTGRSVKDKAQSASSSSASMARSSRAAGSSVDSGSVSAAAAARRKAEEEKRRRAEQALRTVMFLSVWGPNT

SEQ ID NO: 9123 - protein, 90 aa, Pennisetum glaucum
MSLRYMSRVGARAAQAVRESTGRSVKDKAQSASSSASMARSGRAAGSVDSGRVSAAAAAAARRKAEEEKRRRAEQALRTVMFLSVWGPNT

SEQ ID NO: 9124 - protein, 88 aa, Setaria italica
MSLRYMSRVGARAAQAVRESTGRSVKDKAQSASSSASMARSGRAVGWVDSGRISAAAAARRKAEEEKRRRAEQALRTVMFLSVWGPNT

SEQ ID NO: 9125 - protein, 93 aa, Zea mays
MTVRSACSARRRFSSSAFLLAAAAAATALALPDSTDPAAGALLPPLLAMDAACACALTDLPVLSRTTRAPTRLMYLKLIALQLLTATLCPGLD

SEQ ID NO: 9126 - protein, 88 aa, Zea mays
MSLRYMSRVGARVVRESTGRSVKAQAQAASMARSGGSRAPAAGSVESGRASAVAAAAAARRKAEEEKRRRAEQALRTVMFLSVWGPNT

SEQ ID NO: 9127 - protein, 283 aa, Zea mays
MQPQPAEMDPAVDASASTAQADSNVSAAVPAPDPSPPLPAPEAETVDPPPPPPAPAPKTVTWSEKLTSESPTHVHAAAAAESSQYVSRGPASSSSKGAVEAMRETLSRWGKSWGETTKLVESLSRDTWQHFKTGPSFTEAAMGRLAQGTKVLAEGGYEKIFKQTFEVLPDEELKICYACYLSTSAGPVMGVLYISTAKIAFCSDNPLSYKAGNKTEWSYYKVVIPLHQLRAANPSVSKLSPAEKYIQVVSIEGHEFWFMGFLMYDKAATSLQEALASARELQP

SEQ ID NO: 9128 - protein, 288 aa, Oryza sativa
MQTPAEIPPAAAAAAEAPAVPRSDDPPAASDPSSPPPPPPPVAVAAATADPPPPAQPQGQKTVTWSEKLTSESPTYVAAATAEAAESSQYVSRGPASSSSKGAVEAMKETLSRWGKSVGETTKMVESLSRDTWQHFKTGPSFTEAAMGRLAQGTKVLAEGGYEKIFRQTFEVLPEEQLKISYACYLSTSAGPVMGVMYISTAKIAFCSDNPLSYKAGNKTEWSYYKVVIPLHQLRAANPSVSKVNPAEKYIQVVSVEGHEFWFMGFLMYDKAVCSLQEAMNSAREMQP

SEQ ID NO: 9129 - protein, 291 aa, Brachypodium distachyon
MQPAAEMQPPAGSPTASQSDTPQPPPPSDPSPPPSPAPAPAPAPEAADPPAPAPALAPVQLQAQQKSVTWSEKLTSESPTHVPAAAAAEASQYVSRGPASSSSKGAVEAMKDTLSRWGKSMGETTKMVESLSRDTWQHFKTGPSFTEAAMGRLAQGTKVLAEGGYDKIFKQTFEVLPDEQLKISYACYLSTSAGPVMGVMYISTAKIAFCSDNPLSYKAGNKTEWSYYKVVIPLHQLRSANPSVSKVNSAEKYIQVVSVEGHEFWFMGFLMYDKAVATLQEALDCSRELQP

SEQ ID NO: 9130 - protein, 409 aa, Zea mays
MYLLDLFTNNVESEDEAEAACAVVLTPPLSLEGGLAAELRPANLAQRVLSLFLNVRPGSDLSHFQLPATFNLPKSQLQLYGEGVYCAGEDLLGRCARGRDSLERLACVVAWSISTTRPPIFGFAPYNPVLGETHHVSTTSGCGGGLNVLLEQVSHRPPVTALHATDARGEVRLVWCQSPAPRFHGASVEAAVRGARELRLLRHAETYVIGCPGLLIRLFPSPACEWSGDVRVVCAESGLEAQLSYCRTRRSFLGFGGGDARCVRGRIFRSAEPGDTLCEIDGFWDRQVTRRDLATGEVSVLYDAQRAIGDLATPVVQDRKGVSASESAVVWGEVSNAILKKDWETAQQAKRRVEDTARRFAKERNDRGEVWTPKHFSLSQNKSGDWECWPLEDSVPPAPIVVPSSSSSS

SEQ ID NO: 9131 - protein, 394 aa, Zea mays
MTESEGEAEAARAAVLTPPLSLGAGGLAGELRPANLGQRVLSLFRNVRPGSDLSHFQLPATFNLPKSQLQLYGEAVYCGGEDMLARCARGADSLQRMCAVVAWSISTTRPPIFGFAPYNPVLGETHHVSTSAGLNVLLEQVSHRPPVTALHATHARGEVELVWCQSPAPRFHGASVEAAVRGARELRLPRHAETYAVGCPGLVIRLLPSPGCEWAGDVRVSCAESGLEATLSYRRSRRSFLGLGGGDARCVRGRVFRSAAPDDTLCEVDGFWDRQVSLRDVATGEVSVLYDARQTIADLATPVVQDRKGVSASESAVVWAEVSAAILNKDWEAARQAKRRVEETARRLAKERNERGEVWTPSHFSLWQNKHGDWECWPLEDSVPPAPIVVPSPL

SEQ ID NO: 9132 - protein, 390 aa, Setaria italica
MVESEGEAAACAAAVLTPPLSLEGGLAAELRPANLVRRVLSLFRNVSPGSDLSHFQLPATFNLPKSQLQMYGEGLYCAGEDLLGRCARGKDSLERLTSVVAWSISTTRPPIFGFAPYNPVLGETHHVSAGSGGLNVLLEQVSHRPPVSALHATNAAGDVRLVWCQSPVPKFHGASIEAAVRGRRELRLPRHGERYEVDCPNLLIRLLPAPSVEWSGDVRVVCAESGLEAQLSYCRSRSFLGFGGDARCVRGRVFRSASRDETIYEIDGFWDRTVSLKDVSTGEVSVLYDAQRAISKLTTPVVQDHKGLAPSESAVVWGEVSDALLKKDWEKARQAKRRVEDEARKLAKERNEKGEVWTPKHFSLSQNKNGEWECWPLEESVPPAPIVVPS

SEQ ID NO: 9133 - protein, 414 aa, Zea mays
MYHQHQGLSELFTTRTSFPMEQHLFLRGGNAQGDSGLVLSTDAKPRLKWTPELHQRFVDAVNQLGGAEKATPKTVMRLMGIPGLTLYHLKSHLQKYRLSKNLQAQANVSTSKNAIGCTSIADRIPGTSAATMSSTNVVPQAEKTIQIGEALQMQIEVQRQLNEQLEVQRHLQLRIEAQGKYLQAVLEQAQETLGKQNLGPANLEDAKIKISQLVSQVSTECFSNAITDVKGSSSVHRLEPRQIQFVESSTNSYLSVAEGFIKEQRLQHQQHHGVLKAHDGSSLFCRKRPHEHETQFALNRSLSERRMAHLQNDEQYSKAEFGYESDTEIVHEYTAPQNGGGSTTSSASGSKVDAEKLYLEEQKCARQVAEYPRESKLIDFENSCSGKKLDLNTHNVDDTDQAYRHFDLNDFSWS

SEQ ID NO: 9134 - protein, 410 aa, Zea mays
MYHQHQGPSELFTTRTSFPMEQHPFLRGGNAQGDSGLVLSTDAKPRLKWTPELHQRFVDAVNQLGGEEKATPKTVMRLMGIPGLTLYHLKSHLQKYRLSKNLQAQANASTSKNGCTPVADRIPGTTAATMSSTNVLPQAEKTIQIGEALQMQIQVQRQLNEQLEVQRHLQLRIEAQGKYLQAVLEQAQETLGKQNLGPANLEDAKIKISELVSQVSNECFSNAITDVKESSSVHRLEPIQIEFVESSTNSYLSVAEGFIKEHKLQHHGVLKAYDDSSLFCRKRSHEHETQFALNRSLSEHRMAHLQNEEGYHKAEFGYESDTEMAHEYTAPQKNGRCSTTSSASGSKVDAEKLYLEEQKCARQAVEYPRESKLVDFEHPCSVNKLDLNTHNVDDTNQAYRHFDLNGFSWG

SEQ ID NO: 9135 - protein, 412 aa, Setaria italica
MYHQHQGPSELFTTRTSFPMEQHLFLRGGNAQGDSGLVLSTDAKPRLKWTPELHQRFVDAVNQLGGAEKATPKTVMRLMGIPGLTLYHLKSHLQKYRLSKNLQAQANVSTSKNAIGCTNIADRMPGTSAPTMSSTNAIPQAEKTIQIGEALQMQIEVQRQLNEQLEVQRHLQLRIEAQGKYLQAVLEQAQETLGKQNLGPANLEDAKIKISELVSQVSNECFSNAITDIKESSSVHRLEPKQIQFVESSTNNYLTAAEGFIKEHRLHHHGVLKAHDDSSLFCRKGSHEHETPLALNRSLSERRMAHLQIENGYSKAELGYENDTEMAPEYIGPPKNGGGSTSSSASGSKGDAEKPYLEEPNCTRQAVEYPRESKLLDFGHSCPGKKLDLNTHNVDDTDQAYRHFDLNGFSWS

SEQ ID NO: 9136 - protein, 413 aa, Panicum virgatum
MYHQHQGPSELFTTRTSFPMEQHLFLRGGNAQGDSGLVLSTDAKPRLKWTPELHQRFVDAVNQLGGAEKATPKTVMRLMGIPGLTLYHLKSHLQKYRLSKNLQAQANVSTSKNAIGCATIADRMPGTSAPTMSSTNVIPQAEKTIQIGEALQMQIEVQRQLNEQLEVQRHLQLRIEAQGKYLQAVLEQAQETLGKQNLGPANLEDAKIKISELVSQVSNERFSNAITDIKESSSVHRLEPKQIQFVDSCWKSNYLTAAEGFIKEHRLQHHGVLRAYDDSSLFCRKGSHEHENQIALNRSLSERRMAHLQNEKGYNKAEFGYESDTEMAPEYITPQKNGGGSTTSSASGSKGDTGKTYLEEPNCTRQSVEYPSESKLLDFEHSCPGKKLDLNTHNVDDADQAYRHFDLNGFSWS

SEQ ID NO: 9137 - protein, 398 aa, Echinochloa colona
MYHQHQGPSELFTTRTSFPMEQHLFLRGGNAQGDSGLVLSTDAKPRLKWTPELHQRFVDAVNQLGGAEKATPKTVMRLMGIPGLTLYHLKSQSPESTRLSKNLQAQANVSSSKNAIGCTTIVDRMPGTSAPAMSSSNVIPQAEKTIQIGEALQMQIEVQRQLNEQLEVQRHLQLRIEAQGKYLQAVLEQAQETLGKQNLGPANLEDAKIKISELVSQVSNECFGNTITDIKESSGVHRLEPKQIQFVESSANNYLTAAEGFIKEHRLQHHGVLKAYDDSSLICRKGSHEHETQFALNRSLSERRMTHLQNEKGYSKEEFGYESDTEMAPEYVTPQKNGGGSTTSSASGSKGDAEKPYLEEPNCTRQAVEYPRESKLLDFEHSCPGKKLDLNTHNVDDT

SEQ ID NO: 9138 - protein, 103 aa, Panicum virgatum
MYHQHQGPSDLFTTRTSFPMEQHLFLRGGNAQGDSGLVLSTDAKPRLKWTPELHQRFVDAVNQLGGAEKATPKTVMRLMGIPGLTLYHLKSHLQVLENPKSSW

SEQ ID NO: 9139 - protein, 411 aa, Oryza sativa
MYHQHQGRSDLFTTRTSFPMERHLFLHGGNTQGDSGLVLSTDAKPRLKWTPELHQRFVDAVNQLGGAEKATPKTVMRLMGIPGLTLYHLKSHLQKYRLSKNLQGQANVGTTKNALGCTGVADRIPGTSALAMASASAIPQAEKTIQIGEALQMQIEVQRQLNEQLEVQRHLQLRIEAQGKYLQAVLEQAQETLGKQNLGPASLEDAKIKISELVSQVSNECLSNAVTEIRESSSIHRLEPRQIQFVESSANNCLTAAEGFKEHRLQNHGVLKAYDDSTLFCRKQSQDQESQYSLNRSLSERRMGHLYSGKQYHKSEGSDSDTEVLHEYITPQKNGGGSTTSSTSGSKEINVEKLYLDEPSCKRQTVDYQRESKLLDFDQQSSGKNLDLNTHNIDDNDQGYRHFDLNGFSWS

SEQ ID NO: 9140 - protein, 383 aa, Triticum aestivum
MYHQHQGPSELFTTRTTFPMERHLFLHGGSTQGDSGLVLSTDAKPRLKWTPELHQRFVDAVNQLGGAEKATPKTVMRLMGIPGLTLYHLKSHLQKYRLSKNLQAQVNVGTNKNTIGCAIVADGMPGTSVPAMINTNVIPQPEKTMQIGEALQMQIEVQRQLNEQLEVQRHLQLRIEAQGKYLQAVLEQAQESLGKQNLGPANLEDAKMKISELVSQVSNECFSNAVTEIKESSSMHRLEPRQIQFMESSTNNCLTAAGGFINEHRLHSHGMLKAYDDSSIFCRKHSPDREYQFSLNRSLSERKMGHLHNVNEYHKAEFGSESDMEIQQEYTTPQKNGRGSTTSSASGSKEEMRTDYILKNQTARDKRLNIQVLSIQVLGRNLI

SEQ ID NO: 9141 - protein, 406 aa, Brachypodium distachyon
MYHQHQGPSELFSTRTTFPMERHLFLHGGSTQDSGLVLSTDAKPRLKWTPELHQRFVDAVNQLGGAEKATPKTVMRLMGIPGLTLYHLKSHLQKYRLSKNLQAQVNVGTTKNAIGCAVVADSMPATSTPAMTNTNVIPQAEKTIQIGEALQMQIEVQRQLNEQLEVQRHLQLRIEAQGKYLQSVLEQAQESLGKQNLGPANLEDAKIKISELVSQVSNECFSNAVTDIKESSRMHRLEPRQIQFVESSTNNCLTAAEGYINEHRLHSHGVLKAYDDSSILYRKQSHGHEYQFPLNRSLSERRMGHLHNVKEYHKAELGSESDTEIQQEYITPQKNVGGSTTSSASGTKEGDIKKLYLEEPSCKRRAMDYPSFERPNSGKKLDLNTHNTDDSDQGFRHFDLNGFSWS

SEQ ID NO: 9142 - protein, 1925 aa, Setaria italica
MASAGAGPSGPVRSQSGRQRTMSRLPTRALTMRPEGFSGEDGVEIVELVPSSLAPIVPILRAANEIEEENPRVAYLCRFTAFEKVHTMDPNSNGRGVRQFKTYLLHKLEKDEQETKRRLASTDAREIQKFYEYYCQKYLEEDHEKRKPEEMARYYQIASVLYDVLKTVTPGKHHPEYDKYAEGVEKEKASFSQYNILPLNISVPRQPIMEIPEIKAAVGLLRQMDGLPMPKPQSSDGKTGLDGMDRPVQDLLEWLWQTFGFQKGNVENQKEHLILLLANIDMRQQGHAHQSERHVHMIRNSTVIDLMDKIFKNYNSWCQYLHLESNIRIPRDASTQQPELLYIGLYLLIWGEASNVRFMPECLCYIFHHMARDLHDIISDRRDGWFDPPFQREGSDDAFLQLVIEPIYSVMQKEAARSKRGTVSHSKWRNYDDLNEYFWSKKCFKKLGWPMDPTADFFAVPTRTKNETEQHDHAIRRRRASKTNFVEVRTFLHLFRSFDRMWAFFILSFQAMAIIAWSPSGSLSSIFEADVFRNVLTIFITAAFLNFLQAMLEIILNWKAWKSLECSQRMRCILKFAAAIAWLIILPITYSGSIQNPTGLVKFFSNWIGNLQNESIYNFAVALYMLPNILSALFFIFLPIRGVLERSNSRIIRFLLWWTQPKLYVARGMYEDTGSLLKYTTFWILLLICKLAFSFYVEIAPLVEPTRIIMSLDRPPYEWHEFFPNLQHNLGVVTTVWAPIVMVYFMDTQIWYAIFSTICGGVNGAFSRLGEIRTLGMLRSRFQAIPRAFGKKLVPNRGSHFKREEEDRNPPYDKFADIWNAFITSLREEDLLNNREKNLLIVPSSGGETSVFQWPPFLLASKIPIALDMAKNVKKKDDELMKRINQDPYTEYAVIECYETLLDILYSIIVEQSDKKVIDKIDESIKNSIECKQLVKEFRLDELPQLSEKFDKLLDLLKFYDENDPTKNNTQIANLLQDIMEIITQDIMKNGQGILKDEGQKQLFANLNLDPLKHVAWREKCVRLQLLLTTKESAIYVPTNLEARRRITFFANSLFMKMPRAPPVRSMMSFSVLTPYFKEEVLFSPKDLGRKNEDGISILFYLRKIFPDEFRNFLQRINCKPKDEEELKERMEEICHWASYRGQTLSRTVRGMMYYRKALEIQCLQDTKDPAKFGRDTSIESYQELQSDSEMAQAIADIKFTYVVSCQIYGMQKTSKKKEDKNRYLNILNLMITNPSLRVAYIDEVEAPTGNGTTEKTYYSVLVKGGEKYDEEIYRIKLPGRPTDIGEGKPENQNHAIIFTRGEALQAIDMNQDNYIEEAFKMRNVLEEFESRKYGKRKPTILGLREHIFTGSVSSLAWFMSNQETSFVTIGQRVLANPLKVRFHYGHPDIFDRLFHITRGGISKASKTINLSEDIFSGFNSTMRGGNVTHHEYMQVGKGRDVGMNQISSFEAKVANGNGEQTLSRDIYRLGRRFDFYRMLSFYFTTVGFYFSSMVTVLTVYVFLYGRLYLVMSGLEKSILMDPRNQQNVKALENALASQSVFQLGLLLVLPMIMEVGLEKGFRTALGEFIIMQLQLASMFFTFQLGTKTHYYGRTILHGGAIYRPTGRGFVVYHAKFTENYRLYSRSHFVKGLELLILLVVYLVYGSSYRSSNLYIFVTCSIWFLVASWLFAPFIFNPSCFEWQKTVDDWTEWRKWMGNRGGIGMSVEKSWEAWWISEQDHLRKTSIRALLLEIIISLRFLIYQYGIVYHLNIAVARHNKSIMVYALSWVVMLLVLVVLKMVSIGRQKFGTDLQLMFRILKGLLFLGFVSVMAVLFVVLNLTIADVFASILGFLPTGWCILLIGQACSPLLRRTVLWDSIMELGRSYENIMGLILFLPIGFLSWFPFVSEFQTRLLFNQAFSRGLQISRILAGQEVDIGDESESE

SEQ ID NO: 9143 - protein, 1913 aa, Oryza sativa
MATGGGGLSGPQPSLRRGLSRAFTMRPEGYSGEDGGEYSEESELVPNSLAPIVPILRAANEIEEENQRVAYLCRFTAFEKAHTMDPNSGGRGVRQFKTYLLHRLEKDEHETQRRLAGTDAKEIQRFYEHYCKKNLVDGLKTKKPEEMARHYQIASVLYDVLKTVTPEKFHAEFDIYAKEVEKEKASFSHYNILPLNISGQRQPVMEIPEIKAAVDLLRKIDGLPMPRLDPVSAEKETDVPTVRDLFDWLWLTFGFQKGNVENQKEHLILLLANIDMRKGANAYQSDRHNHVYGSQMHSDTVRSLMRKIFENYISWCRYLHLESNIKIPNDASTQQPEILYIGLYLLIWGEASNVRFMPECICYIFHHMARDLYDIISDRRQDFDPPFRREGSDDAFLQLVIQPIYSVMKQEAAMNKRGRTSHSKWRNYDDLNEYFWSKRCFKQLKWPMDSAADFFAVPLKIKTEEHHDRVITRRRIPKTNFVEVRTFLHLFRSFDRMWAFFILAFQAMVIVAWSPSGLPSAIFDPTVFRNVLTIFITAAFLNFLQATLEIILNWKAWRSLECSQMIRYILKFVVAVAWLIILPTTYMSSIQNSTGLIKFFSSWIGNLQSESIYNFAVALYMLPNIFSALFFIFLPFRRVLERSNSRIIRFFLWWTQPKLYVARGMYEDTCSLLKYTLFWILLLICKLAFSFYVEIYPLVGPTRTIMFLGRGQYAWHEFFPYLQHNLGVVITVWAPIVMVYFMDTQIWYAIFSTICGGVNGAFSRLGEIRTLGMLRSRFEAIPIAFGKHLVPGHDSQPKRHEHEEDKINKFSDIWNAFIHSLREEDLISNRERNLLIVPSSMGDTTVFQWPPFLLASKIPIALDMANSVKKRDEELRKRINQDPYTYYAVVECYQTLFSILDSLIVEQSDKKVVDRIHDRIEDSIRRQSLVKEFRLDELPQLSAKFDKLLNLLLRTDEDIEPIKTQIANLLQDIMEIITQDIMKNGQGILKDENRNNQLFANINLDSVKDKTWKEKCVRLQLLLTTKESAIYVPTNLDARRRITFFANSLFMKMPKAPQVRSMMSFSVLTPYFKEEVLFSAEDLYKKNEDGISILFYLRKIYPDEWKNFLERIEFQPTDEESLKTKMDEIRPWASYRGQTLTRTVRGMMYYRRALEIQCIQDKTDIVKLEHRRTVESSQQGWASFDMARAIADIKFTYVVSCQVYGMQKTSKDPKDKACYLNILNLMLMYPSLRVAYIDEVEAPAGNGTTEKTYYSVLVKGGEKYDEEIYRIKLPGKPTDIGEGKPENQNHAIVFTRGEALQAIDMNQDNYLEEAFKMRNVLEEFESEKYGKRKPTILGLREHIFTGSVSSLAWFMSNQETSFVTIGQRVLANPLKVRFHYGHPDIFDRLFHITRGGISKASKTINLSEDIFSGFNSTMREGNVTHHEYMQVGKGRDVGMNQISSFEAKVANGNGEQTLSRDIYRLGRRFDFYRMLSFYFTTVGFYFSSMVTVLTVYVFLYGRLYLVMSGLERSILLDPRIEQNIKPLENALASQSFFQLGLLLVLPMVMEVGLEKGFRTALGEFVIMQLQLASVFFTFQLGTKTHYYGRTILHGGAKYRPTGRGFVVYHAKFADNYRMYSRSHFVKGLELLILLVVYLVYGSSYRSSSMYLFVTFSIWFLVASWLFAPFIFNPSCFEWQKTVDDWTDWRKWMGNRGGIGMSVDQSWEAWWISEQEHLRKTSIRSLLLEIILSLRFLIYQYGIVYHLNIARRSKSILVYGLSWLVMLSVLVVLKMVSIGRQKFGTDLQLMFRILKGLLFLGFVSVMAVLFVVCNLTISDVFASILGFMPTGWCILLIGQACSPLVKKAMLWDSIMELGRSYENLMGLVLFLPIGLLSWFPFVSEFQTRLLFNQAFSRGLQISRILAGQKDIGEE

SEQ ID NO: 9144 - protein, 310 aa, Glycine max
MATLIPPPPPPPPPPAAAADPKVDYLNLPCPIPFEELHREAMMSLKPDLFEGMRFDFTKMLNQKFSLNHSVLMGPTEVPSQSTETIKIPTAHYEFGSTFIDHPRLLLWGRILTDGRLNARVKCDLSENLTFKANAQLTNEPHMSHAMINFDYKGKDYRTQFQLGNGALLGASYIQSVTQHLSLGGEVFWAGQHRKSGIGYAARYNTDKSVATGQVASTGMVLLSYVQKVSEKVSLASEFMCNYLSRDVTASFGYDYILRQCRLRGKIDSNGCVAAFLEERLNMGLNFILSAELDHRKKDYKFGFGLTVGE

SEQ ID NO: 9145 - protein, 308 aa, Cajanus cajan
MATTVPPPPAPAPAPAVDAKVDYFNLPCPIPFEELHREAMMSLKPDLFEGMRFDFTKMLNQKFSLNHSVLMGPTEIPSQSTETIKIPTAHYEFGSTFIDHPRLLLWGRILTDGRLNARVKCDLSENLTFKANAQLTNEPHMSHGMINFDYKGNDYRTQFQLGNGALLGASYIQSVTQHLSLGGEVFWAGQHRKSGVGYAARYNTDKMVATGQVASTGMVLLSYVQKVSEKVSLASELMCNYLSRDVTASFGYDYILRQCRLRGKIDSNGCVAAFLEERLNMGLNFILSAELDHRKKDYKFGFGLTVGE

SEQ ID NO: 9146 - protein, 309 aa, Vitis vinifera
MAGFVPPPPPPAPPAPPKPDEKVDYLDLPCPIPYEEIHREALMSLKPELFEGMRFDFTKGLNQKFSLSHSVFMGPTEIPSQSSETIKIPTAHYEFGANFIDPKLMLFGRILTDGRLNARVKCDLTENLTLKANAQLTSEPHMSHGMVNFDYKGGDYRTQLQLGNGALFGASYIQSVTPYLSLGGEVFWAGQHRKSGIGYAARYNTDKMVATGQVASTGMVALSYVQKVSEKVSLASDFMYNYMSRDVTASFGYDYILRQCRLRGKIDSNGCTAAFLEERLNMGLNFILSAEIDHRKKDYKFGFGLTVGE

SEQ ID NO: 9147 - protein, 309 aa, Cichorium intybus
MAALVPPPATASPAAEAIKPEKVDYMDLPCPIPYEEIHREAMMSLKPEHFEGMRVDFTKGLNQRFSLSHSIVMGPTEVPSQSADTIKIPTANYEFGANFIDPRLMLFGRILTDGRLSARVKCDLSENLTMKANAQLTNEPHMSHGMFNFDYKGTDYRTQFQLGNGGLLGASYIQSVTPHLSLGGEVFWAGQHRKSGLGYAARYNTDKMVASGQIASTGMVALSYVQKVSEKVSLASDLMYNYMSRDVTASFGYDYILRQCRLRGKIDSNGCTSAFLEERLNMGLNFILSAEIDHRKKDYKFGFGLTVGE

SEQ ID NO: 9148 - protein, 309 aa, Lactuca sativa
MAAFIPQPPATASPAEAIKPEKVDYMDLPCPIPYEEIHREAMMSLKPELFEGMRVDFTKGLNQRFSLSHSIVMGPTELPSQSADIIKIPTANYEFGANFIDPKLMLFGRILTDGRLSARVKCDLSENLTMKANAQLTNEPHMSHGMFNFDYKGSDYRTQFQLGNGGLLGASYIQSVTPHLSLGGEVFWAGQHRKSGLGYAARYNTDKMVASGQIASTGMVALSYVQKVSEKVSLATDMMYNYMSRDVTASFGYDYILRQCRLRGKIDSNGCASAFLEERLNMGLNFILSAELDHRKKDYKFGFGLTVGE

SEQ ID NO: 9149 - protein, 374 aa, Ambrosia trifida
CVVLLHKHKRRLTSPYSIPSIPSSQNTHKTLIFYIIFINALNHYHNITTTQPLTYIYKTPSQPTHNQQWLHIFLHLHRRLNPPSLRKLYYFDLPCPIPYEEIHREAMMSLKPEHFEGMRFDFTKGLNQKFSLSHSVVMGPTEVPSQSAETIKIPTANYEFGANFIDPKLMLFGRILTDGRLSARVKCDLSENLTLKANAQLTNEPHMSHGMFNFDYKGSDYRTQLQLGNGGLIGASYIQSVTPHLSLGGEVFWAGQHRKSGLGYAARYNTDKMVASGQIASTGMVVLGYVQKVSEKVSLATDMMYNYMSRDVTASFGYDYILRQCRLRGKIDSNGCTSAFLEERLNMGLNFILSAEIDHKKKDYKFGFGMTVGE

SEQ ID NO: 9150 - protein, 310 aa, Cichorium intybus
MAALVPPPPATASPAAEAIKPEKIDYMDLPCPIPYEEIHREAMMSLKPEHFEGMRVDFTKGLNQRFSLSHSIVMGPTEVPSQSADTIKIPTANYEFGANFIDPKLMLFGRILTDGRLSARVKCDLSENLTMKANAQLTNEPHMSHGMFNFDYKGTDYRTQFQLGNGGLLGASYIQSVTPHLSLGGEVFWAGQHRKSGLGYAARYNTDKMVASGQIASTGMVALSYVQKVSEKVSLASDLMYNYMSRDVTASFGYDYILRQCRLRGKIDSNGCTSAFLEERLNMGLNFILSAEIDHRKKDYKFGFGLTVGE

SEQ ID NO: 9151 - protein, 315 aa, Amsonia hubrichtii
MATLVPPPATTAPTQSAASQPTVIEPEKVDYLNLPCPIPYEEIHREAFMSLKPELFEGMRFDFTKGLNQRFSLSHSVFMGPTEIPSQSSETIKIPTAHYEFGANFLDPKLMLFGRVLTDGRLTARLKCDLAENLTLKGSAQLTNEPHMSNGMFNFDYKGKDYRTQFQLGTGALLGASYIQSVTKNLSLGGEVFWAGQHRKSGIGYAARYNTDKMVATGQVASTGMVLLSYVQKISEKVSLASDFMYNYMSNDVTASFGYDYILRQCRLRGKIDSNGCVAGFLEERLNMGLNFILSAELDHRKKDYKFGFGLTVGE

SEQ ID NO: 9152 - protein, 315 aa, Citrullus lanatus
MAGLAPPTAAAAAATALPVPPKKIEDEKVDYLNLPCPIPYEEIHREAFMSLKPELFEGMRFDFTKGLNQKFSLSHSVFMGPIEIPNQSTETVKIPTATYEFGANYIDPKLMLFGRILTDGRLNARVKCDLSDNLTLKANAQLTNEPHMSHGMVNFDYKGRDFRTQFQLGNGALFGASYIQSVSPHLSLGGEVFWAGQHRKSGIGYAARYNTDKMVATGQVASTGMVALSYVQKVSEKVSLASDFTYNYMSRDVISSLGYDYILRQCRLRGKIDSNGCVAAFLEERLNMGVNFILSAEIDHRKKDYKFGFGLTVGE

SEQ ID NO: 9153 - protein, 311 aa, Ipomoea nil
MAAFVPPPAAAAPPADSKPAAPEKVDYMNLPCPIPYEEIHREAFMSLKPELFEGMRFDFTKALNQRFSLSHSVFMGPTEIPSQSTETIKIPTSHYEFGANFIDPKLMLLGRLMTDGRLNARVKCDLSENLSLKANAQLSNEPHMSQGMVNFDYKGKDYRSQFQLGNGGLLGANYIQSVTPHLSLGGEVFWAGQHRKSGIGYAARYNTDKMVATGQVASTGLVALNYVQKVSEKVSLATDFMYNYISGDVTASVGYDYILRQCRLRGKIDSTGCVAAFLEERLNMGVNFILSAEVDHKKKDYKFGFGLTVGE

SEQ ID NO: 9154 - protein, 315 aa, Olea europaea
MATLTTPPTAVTDPPAAGSSPSVAEPQKVDYMNLPCPIPYEEIHREALMSLKPELFEGMRFDFTKGLNQKFSLSHSVMMGPTEIPSQSSETIKIPTAHYEFGANFIDPKLMLFGRVLTDGRLNARLKCDLTENLTLKGNAQLTHEPHMSHGMFNFDYKGLDYRTQLQLGNGALLGASYIQSVSPHLSLGGEVFWAGQHRKSGIGYAARYNTDKMVATGQVASTGMVALSYVQKVSDKVSLASDFMYNYMSRDVTASFGYDYILRQCRLRGKIDSNGCVAALLEERLNMGLNFILSAEMDHRKKDYKFGFGLTVGE

SEQ ID NO: 9155 - protein, 311 aa, Cirsium arvense
MATLVPPPTTPPPPPPAEAIKPEKVDYMDLPCPIPYEEIHREAMMSLKPDHFEGMRVDFTKGLNQKFSLSHSIVMGPTEVPSQSAETIKIPTANYEFGANFIDPKLMLFGRVYTDGRLSARVKCDLAENLTMKANAQLTNEPHMSHGMFNFDYKGTDYRTQFQLGNGNLLGASYIQSVTPHLSLGGEVFWAGQHRKSGIGYAARYNTEKMVASGQIASTGMVALSYVQKVSEKVSLASDLMYNYMSRDVTASFGYDYILRQCRLRGKIDSNGCTSAFLEERLNMGLNFLLSAEIDHKKKDYKFGFGLTVGE

SEQ ID NO: 9156 - protein, 309 aa, Arnica chamissonis
MATQVPPPTTASPAAEAIKPEKVDYMDLPCPIPYEEIHREAMMSLKAEHFEGMRVDFTKGLNQRFSLSHSIVMGPTEVPSQSAETIKIPTANYEFGANFIDPKLMLFGRILTDGRLSARVKCDLSENLTLKANAQLTNEPHMSHGMFNFDYKGSDYRTQLQLGNGGLIGASYIQSVTPHLSLGGEVFWAGQHRKSGLGYAARYNTDKMVASGQIASTGMVVLGYVQKVSEKVSLATDMMYNYMSRDVTASFGYDYILRQCRLRGKIDSNGCTSAFLEERLNMGLNFILSAEIDHKKKDYKFGFGLTVGE

SEQ ID NO: 9157 - protein, 308 aa, Cichorium intybus
MATLVPPPPSPAAAEAIKPEKVDYMDLPCPIPYEEIHREALMSLKADYFEGMRVDFTKGLNQKFSLSHSISMGPTEIPSQSAETIKIPTANYEFGANYIDPKLMLIGRVLTDGRVTARVKCDLSDNLSMKANAQLTSEPHMSHGMVNFDYKGSDYRAQFQLGNGALLGASYIQSVTPHLSLGGEVFWAGQHRKSGLGYAARYNTDKMVASGQIASTGMVALSYVQKVSEKVSLASDLMYNYMSRDVTASFGYDYILRQCRLRGKIDSNGCTSAFLEERLNMGLNFIISAEIDHNKKDYKFGFGLTVGE

SEQ ID NO: 9158 - protein, 312 aa, Flaveria ramosissima
MATRVPPPATVPPPPPPAEAIKPEKVDYMDLPCPIPYEEIHREAMMSLKPDHFEGMRVDFTKGLNQKFSLSHSIVMGPTEVPSQSAETIKIPTANYEFGANFIDPKLMLFGRILTDGRLSARVKCDLSENLTMKANAQLTNEPHMSHGMFNFDYKGSDYRTQLQLGNGGLIGASYIQSVTPHLSLGGEVFWAGQHRKSGIGYAARYSTDKMVASGQIASTGMVVLGYVQKVSEKVSLATDMMYNYMSRDATASFGYDYILRQCRLRGKIDSNGCTSAFLEERLNMGLNFILSAEIDHKKKDYKFGFGLTVGE

SEQ ID NO: 9159 - protein, 311 aa, Acacia harpophylla
MATIAPLIPGAAAGTSAQKKEEEKVDYLNPPCPIPYEEVHREALMSLKPELFEGMRFDFTKGLNQKFSLSHSLFMGPTEVPSPSSETIKIPTSHYEFGANFLDPKLMLIGRIMTDGRLNARVKCDLTESLTLKANAQLTNEPHMSHGIANFDYKGTDFRTQLQVGNGALFGASYIQSLTPYLSLGGEVFWSGQHRKSGLGYAARYNTDKMVATGQVASTGMVLLSYVQRVSEKVSLASEFMYNYMSRDVTASFGYDYILRQCRLRGKIDSNGTVSAFLEERLNMGLNFIISAELDHWKKDYKFGFGLTVGE

SEQ ID NO: 9160 - protein, 316 aa, Manihot esculenta
MAGMVPPGTAMLGEASAAASAKKINEVGKKVDYMNLPCPIPYEELHREALMSLKPELFEGMRFDFTKGLNQKFSLSHSVFMGPMELPSQSAETIKIPTAHYEFGANFIDPKLMLFGRVLTDGRLNARVKCDLTDDLTLKANAQLTNEPHMSHAMFNFDYKGKDYRTQLQLGNGALFGASYIQSVTPHLSLGGEVFWAGQHRKSGLGYAARYETDKMVATGQVASTGMVALSYVQKVSDKVSLATDFMYNYMSKDVTASVGYDYILRQARLRGKIDSNGCAAAFLEERLNMGLNFILSAELDHKKKDYKFGFGLTVG

SEQ ID NO: 9161 - protein, 317 aa, Cucurbita pepo
MAGLAPPTTATAAAAATALPVPPKKTEDEKVDYLDLPCPIPYEEIHREAFMSLKPELFEGMRFDFTKGLNQKFSLSHSVSMGPIEIPSQSTETIKIPTATYEFGANYIDPKLMLFGRILTDGRLNARVKCDLSDNLTLKGNAQLTNEPHMSHGMVNFDYKGRDFRSQFQLGNGALFGASYIQSVSPHLSLGGEVFWAGQHRKSGIGYAARYNTDKMVATGQVASTGMVALSYVQKVSEKVSLATDFTYNYMSRDVISSLGYDYILRQCRLRGKIDSNGCVAAFLEERLNMGVNFILSAEIDHRKKDYKFGFGLTVGE

SEQ ID NO: 9162 - protein, 278 aa, Cichorium intybus
MATLVPPPPSPAAAEAIKPEKVDYMDLPCPIPYEEIHREALMSLKADYFEGMRVDFTKGLNQKFSLSHSISMGPTEIPSQSAETIKIPTANYEFGANYIDPKLMLIGRVLTDGRVTARVKCDLSDNLSMKANAQLTSEPHMSHGMVNFDYKGSDYRAQFQLGNGALLGASYIQSVTPHLSLGGEVFWAGQHRKSGLGYAARYNTDKMVASGQIASTGMVALSYVQKVSEKVSLASDLMYNYMSRDVTASFGYDYILPSVGLEARLTQMVAHLPFLKKG

SEQ ID NO: 9163 - protein, 312 aa, Flaveria ramosissima
MATRVPPPATVPPPQPPAEAIKPEKVDYMDLPCPIPYEEIHREAMMSLKPDHFEGMRVDFNKGLNQKFSLSHSIVMGPTEVPSQSAETIKIPTANYEFGANFIDPKLMLFGRILTDGRLSARVKCDLSENLTMKANAQLTNEPHMSHGMFNFDYKGSDYRTQLQLGNGGLIGASYIQSVTPHLSLGGEVFWAGQHRKSGIGYAARYSTDKMVASGQIASTGMVVLGYVQKVSEKVSLATDMMYNYMSRDATASFGYDYILRQCRLRGKIDSNGCTSAFLEERLNMGLNFILSAEIDHKKKDYKFGFGLTVGE

SEQ ID NO: 9164 - protein, 83 aa, Cucumis sativus
MAGLAPPTAATATAAPYPLPIPPKKTEDEKVDYLNLPCPIPYEEIHREAFMSLSRNYLKVCDLISLKDSIKSFPSATVCYGTN

SEQ ID NO: 9165 - protein, 310 aa, Flaveria ramosissima
MATHVPPPPTASPATAEAIKPEKVDYMDLPCPIPYEEIHREAMMSLKPEHFEGMRVDFTKGLNQRFSLSHSIVMGPTEVPSQSAETIKIPTANYEFGANFIDPKVMLFGRILTDGRLSARVKCDFSENLTMKANAQLTNEPHMSHGMFNFDYKGTDYRAQLQLGNGGLLGASYIQSVTPHLSLGGEVFWAGQHRKSGIGYAARYNTDKMVASGQIASTGMMVLGYVQKVSEKVSLATDMMYNYMSRDVTASVGYDYILRQCRLRGKIDSNGCTSAFLEERLNMGLNFILSAEIDHKKKDYKFGFGLTVGE

SEQ ID NO: 9166 - protein, 304 aa, Cyclamen graecum
MATLVPPPATLVPPPETPAVASPEKVDYLNLPLPIPYEEIHREALMSLKPELFEGMRFDFTKGLNQKFSLSHSVFMGPTEIPSQGSEAIKIPTAHYEFGANFIDPKLMLFGRVLTDGRVNARVKCDLSENLTLKANAQLTNEPHMSQGMANFDYKGKDFRTQFQLGNGALFGASYIQSVTPHLSLGGEVFWTGQHRKSGIGYAARYNNDKMVATGQVASTGMVALSYVQKVSEKVSLASDFMYNYMSRDVTASFGYDYILRQCRLRGKIDSNGCTAAFLEERLNMGLNFILSAEIDHKKKDYKF

SEQ ID NO: 9167 - protein, 308 aa, Taraxacum officinale
MATLVPPPPAAAAAEAIKPEKVDYMDLPCPIPYEEIHREALMSLKADYFEGMRIDFTKGLNQRFSLSHSIAMGPTEFPSQSADIIKVPIANYEFGANFIDPKMMLIGRVLTDGRVNARVKCDLTENLSMKADAQLTNEPHMSHGMVNFDYKGTDYRTQFQLGNGGLLGASYIQSVTPHLSLGGEVFWAGQHRKSGLGYAARYNTDKMVATGQIASTGMVALGYVQKVSEKVSLASDLMYNYMSRDVTASFGYDYILRQCRLRGKIDSNGCTSAFLEERLNMGLNFIISAEIDHMKKDYRFGFGLTVGE

SEQ ID NO: 9168 - protein, 309 aa, Carica papaya
MAGFVPAGTTTIHNDEKSKTDEKVDYTNLPCPIPYEELHREALMSLKPELFEGLRFDFTKGLNPKFSLSHSVLMGPTEIPSQSSETIKIPTAHYEFGANFIDPKLMLIGRVLTDGRLNARVKWDLTDTLTLKANAQLTNEPHMSHGMVNFDYKGKDYRSQLQLGNGALLGASYIQSVTSYLSLGGEIFWAGQHRKSGIGYGARYETDKMVGTAQVASTGMVALSYVQKVSEKVSLASDFMYNYMSRDVTASVGYDYILRQCRLRGKIDSNGCTAAFLEERLNMGLNFVLSAELDHKKKDYKFGFGLTVG

SEQ ID NO: 9169 - protein, 304 aa, Tropaeolum majus
MAGIIPPVTAIQTDANTKAEEKVDYTNLPCPIPYEEIHREALMSLKPELFEGLRFDFTKGLNQKFSLSHSVLMGPTEVPSQSAETIKIPTANYEFGANYIDPELMLIGRVMTDGRLNARVKWEMTDTLTMKANAQLTGEPHMSHAMVNFDYKGRDYRTQFQLGNGALFGANYIQSVTPHLSLGGEVFWAGQHRKSGIGYAARYESNKMVATGQVASTGMVALSYVQKVSDKASLASDLMYNYMSRDVTASVGYDYILRQSRLRGKIDSNGCAAAFLEERLNMGLNFILSAELDHKKKTTSSALG

SEQ ID NO: 9170 - protein, 189 aa, Catharanthus roseus
MATLVPPSASTLPPQQHPAGSKPTVIEPEKVDYLNLPCPIPYEEIHREAFMSLKAELFEGMRFDFTKGLNQRFSLSHSVFMGPTEIPSQSSETIKIPTAHYEFGANFLDPKLMLFGRVLTDGRLNARLKCDLSENLTLKGSAHLTNEPHMSNGMFNFDYKGKDYRSQFQIGTGALLGASYIQSVTKICL

SEQ ID NO: 9171 - protein, 313 aa, Castanea mollissima
MATATATAPPTSSTTTLPQMKKEDEKVDYFNLPCPIPYEEIHREAFMSLKPELFEGMRFDFTKGLNQRFSLSHSVFMGPMEIPSQSSETIKIPTAHYEFGANFIDPKLMLFGRIMTDGRLNARVKCDLTDNLSFKGNAQLTNEPHMSHGMAYFDYKGKDYRSQFQLGNGALLGANYIQSVTPNLSFGGEVFWAGQHRKSGIGYAARYNTDKMVATGQVASTGLVALSYVQKISEKVSLASDLMYNYMSKEATASFGYDYILRQCRLRGKIDSNGCASAFLEERLNMGLNFILSAELDHRKKDYKFGFGLTVGE

SEQ ID NO: 9172 - protein, 137 aa, Glycine max
MGVVVIDGSTVRDFVNDETAFTKSVDEQFSALDLNNDGVLSRSELRTAFESMRLIETHFGIDVSTPPEQLAKLYDSIFDKFDGDRSGAVDRREFRDEMRKIMLAIADGLGSFPIRMVLEDDPNSLLQKAADLEASKT

SEQ ID NO: 9173 - protein, 137 aa, Phaseolus vulgaris
MGVVIIDGTTVRDFVNDAAAFTKSVDEQFTALDLNKDGVLSRSELRTAFESMRLIETHFGIDVATPPENLATFYDSIFDKFDGDRSGAVDRHEFREEMKKIMLAIADGLGSFPIRMVLEDDPNSLLQKAADLEASKI

SEQ ID NO: 9174 - protein, 137 aa, Cajanus cajan
MGVVVIDGTTVRDFVRDEAAFAKSVDEQFAALDLNNDGVLSRSELRTAFQSMRLIESHFGIDVATPPEQLAALYDSIFQKFDGDRSGAVDRGEFREEMKKIMLAIADGLGSFPIQMVLEDDPHSLLQKAADLEASKS

SEQ ID NO: 9175 - protein, 137 aa, Vigna unguiculata
MGVVIIDGTTVSDFVNDTAAFTKCVDDQFTALDLNNDGVLSRSELRKAFESMRLIEAHFGIDVTTTPEKLATLYDSIFDKFDVDRSGTVDRDEFREEMKKIMLAIADGLGSFPIQMVLEDDPNSLLQKAADLEASKT

SEQ ID NO: 9176 - protein, 140 aa, Arachis hypogaea
MGVVVIDGTTVRDFVNDDAHFNKSVDEQFTALDTNNDGVLSRSELRTAFESMRLIETHFGIDVATSPEELKKLYDSIFERFDGDGSGDVDKNEFRSEMKKIMLAIADGLGSFPIQMVLEDDDNSLLQKAADLEASKTAAA

SEQ ID NO: 9177 - protein, 140 aa, Arachis hypogaea
MGVVVIDGTTVRDFVNDDAHFNKSVDEQFTALDTNNDGVLSRSELRTAFESMRLIETHFGIDVATSPEELKKLYDSIFERFDGDGSGDVDKNEFRSEMKKIMLAIADGLGSFPIQMVLEDDDNSLLQKAADLEASKTATA

SEQ ID NO: 9178 - protein, 139 aa, Arachis hypogaea
GVVVIDGTTVRDFVNDDAHFDKSVDEQFTALDTNNDGVLSRSELRTAFESMRLIETHFGIDVATSPEELKKLYDSIFERFDGDGSGDVDKNEFRSEMKKIMLAIADGLGSFPIQMVLEDDDNSLLQKAADLEASKTATA

SEQ ID NO: 9179 - protein, 140 aa, Lotus japonicus
MGVVIIDGTTVRDFVNDEASFTKSVDEQFAALDLNNDGVLSRAELRTAFESMRLIEAHFGIDVATPPEQLTKIYDSVFDTFDGDGSGTVDRLEFRSEIKKIMLAVADGLGTNPIQMALEDDSNNLLQKAADLEASKIGAA

SEQ ID NO: 9180 - protein, 134 aa, Arachis hypogaea
DGTTVRDFVNDDAHFNKSVDEQFTALDTNNDGVLSRSELRTAFESMRLIETHFGIDVATSPEELKKLYDSIFERFDGDGSGDVDKNEFRSEMKKIMLAIADGLGSFPIQMVLEDDDNSLLQKAADLEASKTATA

SEQ ID NO: 9181 - protein, 870 aa, Cajanus cajan
MANPTQPNVGFTPERESPNPEKSPIPPPPSFVAASPGFLPPKLHLQQDQASSRSLKTPSVLSPANGVTTGSPVPHLSTPPGPPVFTSPVRPAAVPFRTSPASPQPVAFSSGSLPMSSSPPQYSNGSFELQHQVSDNIEDHVPVGESSFVLFSAHKVLKQKKQGNVPSLGFGALVSPGREVSMGPHVIQRDPHRCQSCGAYANIYCNILLGSGQWQCVICRKLNASEGEYIAHSKEDLRRFPELSSPMFDYVQTGNKRPGFVPVSDSRMSAPIVLVIDECLDEPHLHHLQSSLHAFVDSLPTTTRLGIILYGRTVSVYDLSEEAMASADVLPGDKSPSQESLKALIYGTGIYLSPMHASLAVAHSIFSSLRAYKLNIPEASRDRCLGTAVEVALAIIQGPSADLSRGVVKRSGGNSRIIVCAGGPNTYGPGSVPHSFNHPNYPYMEKTAIKWMENLGREAHRHNTIIDILCAGTCPVRVPILHPLAKASGGVLVLHDDFGEAFGVNLQRASARSAGSHGLLELRTSDDILITQVVGPGEESHVDTHESFKNDTALYIQMLSVEETQSFSLSMETEGDIKSDYAFFQFAIQYSNVYQADVSRVITVRLPTVDSISAYLESVQDEVAAVLIAKRTLLRAKNHSDAIDMRATIDERIKDIALKFGSQLPKSKLHSFPKELSLLPELLFHLRRGPLLGSIIGHEDERSVLRNLFLNASFDLSLRMVAPRCLMHREGGTFEELPAYDLAMQSDAAVVLDHGTDVFIWLGAELAADEGRSAAALAACRTLAEELTEYRFPAPRILAFKEGSSQARYFVSRLIPAHKDPPYEQEARFPQLRSLTSEQRTKLKASFVHFDDPSFCEWMRSLKVVPPQPS

SEQ ID NO: 9182 - protein, 871 aa, Phaseolus vulgaris
MANPTQPNVGFTPERESANPEKSPIPPPPNSVASPPGFPSPKLHLQQDQSSSRSVKTPSVLSPANGVTTGSSIPHLSTPPGPPVFTSPVRPAAVPFRTSPASPQPLAFSSGSSLPTSSSPLQFSNGSFELQQQVSDSIDDKVPVGESSFVLFSARKILKQKKQANVPSLGFGALVSPGREVSMGPQVIQRDPHRCQSCGAYANIYCNILLGSGQWQCVICRKLNGSDGEYIAHSKEDLRRFLELSSTMFDYAQTENKRPGFVPVSDSRMSAPIVLVIDECLDEPHLHHLQSSLHAFVDSLSPTTRLGIVLYGRTVSVYDLSEESMASADVLPGEKSPSQESLKALIYGTGIYLSPMHASLAVAHSIFSSLRAYKLNIPEASRDRCLGTAVEVALAIIQGPSADLSRGVVKRSGGNSRIIVCAGGPNTYGPGSVPHSFSHPNYPYREKTAIKWMENLGSEAHRHNTIIDVLCAGTCPVRVPILHPLAKTSGGVFVLHDDFGEAFGVNLQRASARSAGSHGLLELRTSDNIVITQVVGPGEESHVDTHETFKNDTALYIQMLSVEETQSFSLSMETEGDIRSDFVFFQFAIQYSNVYQADVSRVITVRLPTVDSISAYLESVQDEVATVLIAKRTLLRAKNHSDAIDMRSTIDERIKDIALKFGSQLPKSKLHSFPKELALLPELLFHLRRGPLLGSIIGHEDERSVLRNLFLNASFDLSLRMVAPRCLMHREGGTFEELPAYDLAMQSDAAVVLDHGTDVFIWLGAELAADEGRSAAALAACRTLAEELTECRFPAPRILAFKEGSSQARYFVSRLIPAHKDPPYEQEARFPQLRSLTSEQRTKLKASFVHFDDPSFCEWMRSLKVVPPQPS

SEQ ID NO: 9183 - protein, 873 aa, Lotus japonicus
MANPTQPNVGFTPSNPDRQGQNPDKGPIPPPLSFAAAPRFPPPKLQLHQDQASPQPAKTPSPNLVSPANGVTTGSPVPHLSTPPGPPVFSSPVRPAAVPFRTSPASPQPLAFSSSSSLPTSSSPQYSNGAFDLQSQVSDSIADHAPVGESSFVLFSAHKVLKQKKQANVPSLGFGALVSPGREVSTGPQVIQRDPHRCQSCGGYANIYCNILLGSGQWQCVICRKLNGSGGEYVAASKEDLHRFPELSSPMVDYVQTGNKRPGFVPVSDSRMSAPVVLVIDECLDEPHLHHLQSSLHAFVDSLPPTTRLGIVLYGRTVSVYDFSEESIASADVLPGDKSPSEDSLKALIYGTGIYLSPMHASLPVAHSIFSSLRAYKLNIPEASRDRCLGTAVEVALAIIQGPSDLSRGVVKRSGGNSRVIVCAGGPNTYGPGSVPHSFSHPNYPYMEKTALKWMENLGREAHRQNTVVDILCAGTCPVRVPILHPLAKASGGVFILHDDFGEAFGVNLQRASARSAGSHGLLELRTSDDILITQVVGPGEESHVDTHETFKNDTALYIQMLSVEETQCFSISMETKGDIKSDFVFFQFTIQYSNVYQADVSRVITVRLPTVDSVSGYLESVQDEVAAVLIAKRTLLRAKNQSDAIDMRATIDERIKDIALKFGSQLPKSKLHCFPKELSLLPEILFHLRRGSLLGSIIGHEDERSVLRNLFLNASFDLSLRMVAPRCLMHREGGTFEELPAYDLAMQSDTAVVLDQGTDVFIWLGAELGADEGKSAAALAACRTLAEELTEFRFPAPRILAFKEASSQARYFVSRLIPAHKDPPYEQEARFPQLRTLTQEARTKLKSSFVHFDDPSFCEWMRSLKVVPPQPR

SEQ ID NO: 9184 - protein, 601 aa, Trifolium pratense
MANNPTQPNVGFIPSNPEEDRQTPIHPPPPPPTFAPRFPPPILHLQKDQGSVHSNAISPANGSPVPHMSTPPGPPVFTSPVRPAAVPFRTSPASPQPPALSTASSLPTSSSPLYSNGSFDLQSQVSGGIEDHIPLGESSSFVLFSAHKVLKQKKQANVPSLGFGALVSPGREVSTGPQVIQRDPHRCQSCGAYANIYCNILLGSGQWQCVICRKLNGSDGEYIAHSKEDLHRFPELSSPMVDFVQTGTKRPGYVPVSDSRMSAPVVLVIDESLDEPHLHHLQSSLHAFVDSLPPTTRLGIILYGRTVSVYDFSEESVASADVLPGDKSPSQDSLKALIYGTGIYLSPMHASLAVAHSIFSSLRPYKLNVPEASRDRCLGTAVEVALAIIQGPSADLSRGVVKRSGGNSRIIVCAGGPNTYGPGSVPHSFNHPNYPYMEKTALKWMENLGREAHRHNILVDILCAGTCPVRVPILHPLAKASGGVLVLHDDFGEAFGVNLQRASARSAGSHGLLELRTSDDILITQVVGPGEESHVDTHETFKNDTALYIQMLSVEETQSFSLSMETKGDIKGDFVFSSLQFSIQMCIRRMSQGSLLLDCQQ

SEQ ID NO: 9185 - protein, 863 aa, Cicer arietinum
MANNNPTQPNVGFIPSNPEHRQSPTPNPDKTPIPPPPSFAAVPRFPPPILHLQKDQATPHSNGSPVPHLSTPPGPPVFTTPVRPAAVPFRTSPASPQPLALSSASSLPTSSPPHYTNRSSDLQPQVSDSIEDHISLGESSFVLFSAHKVLKQKKQANVPSLGFGALVSPGREVSTGPQVIQRDPHRCQSCGAYANIYCNILLGSGQWQCVICRKLNGSDGEYVAHSKEDLHRFPELSSPMVDFVQTGNKRPGFVPVSDSRMSAPVVLVIDECLDEPHLQHLQSSLHAFVDSLPPTTRLGIILYGRTVSVYDFSEDLVASADVLPGEKSLSQESLKFLIYGTGIYLSPMHASLAVAHSIFSSLRPYKLNMPEASRDRCLGTAVEIALAIIQGPSADLSRGVVKRPGGNSRIIVCAGGPNTYGPGSVPHSFNHPNYPYMEKTALKWMENLGREAHRHNTVIDILCAGTCPVRVPILHPLAKASGGVLVLHDDFGEAFGVNLQRASARSAGSHGLLELRTSDDILITQVVGPGEESHVDTHESFKHDTALYIQMLSVEETQSFSLSMETKGDIKSDFVFFQFAIQYSNVYQADVSRVITVRLPTVDSVSGYLESVQDEVAAVLIAKRTLLRAKSHSVAVDMRSTIDERIKDIGLKFGSQLPKSKLHCFPKELSLLPELLFHLRRGPLLGCIIGHEDERSVLRNLFLNASFDLSLRMVAPRCLMHREGGTFEELPAYDLAMQSDTAVVLDHGTDVFIWLGAELVADEGKSAAALAACRTLAEELTEFRFPAPRILAFKEGSSQARYFVSRLIPAHKDPPYEQEARFPQLRALTSEQRTKLKSSFVHFDDPSFCEWMRSLKVVPPQPS

SEQ ID NO: 9186 - protein, 595 aa, Trifolium pratense
MANNPTQPNVGFIPSNPEQEQDRQTPIHPPPPPPTFAAPPRFPPPILHLQKDQGSIHSANGSPVPHLSTPPGPPVFTSPVRPAAVPFRTSPVLPQPPALSTASSLPTSSSPSYSNGSLDLQSQPSGGLEDHIPLGESSSFVLFSAHKVLKQKKQANVPSLGFGALVSPGREVSTGPQVIQRDPHRCQSCGAYANIYCNILLGSGQWQCVICRKLNGSDGEYIAHSKEDLHRFPELSSPMVDFVQTGTKRPGYVPVSDSRMSAPVVLVIDECLDEPHLHHLQSSLHAFVDSLPPTTRLGIILYGRTVSVYDFSEESVASADVLPGDKSPSQDSLKALIYGTGIYLSPMHASLAVAHSIFSSLRPYKLNVPEASRDRCLGTAVEVALAIIQGPSADLSRGVVKRSGGNSRIIVCAGGPNTYGPGSVPHSFNHPNYPYMEKTALKWMENLGREAHRHNILVDILCAGTCPVRVPILHPLAKASGGVLVLHDDFGEAFGVNLQRASARSAGSHGLLELRTSDDILITQVVGPGEESHVDTHETFKNDTALYIQMLSVEETQSFSLSMETKGDIKGDFVFSSLQFSIQMCIRRMSQGSLL

SEQ ID NO: 9187 - protein, 861 aa, Medicago truncatula
MSNNPTQPNVGFIPSNPEQKQTPIPILPPPPPPSTSILAPPPRFPPPILQLQKDHTSSANGSPVPHLSTPPGPPVFTSPVRPAAIPFRTSPASPQPPARSSASSLPTSSPPRYSNGSFDLQSQVSGGLEDHIPNGESSFVLFSAHKVLKQKKQANVPSLGFGALVSPGREVSTGPQVIQRDPHRCQSCGAYANIYCNILLGSGQWQCVICRKLNASDGEYIAHSKEDLHRFPELSSPMVDYVQTGTKRPGFVPVSDSRMSAPVVLVIDECLDEPHLQHLQSSLHAFVDSLPPTTRLGIILYGRTVSVYDFLEESVASADVLPGDKSPSEDSLKALLYGTGIYLSPMHASLAVAHSIFSSLTPYKLNVPEASRDRCLGTAVEVALAIIQGPSADLSRGVVKRSGGNSRIIVCAGGPNTYGPGSVPHSFNHPNYPYMEKTALKWMENLGREAHRHNILVDILCAGTCPVRVPILNPLAKASGGVLVLHDDFGEAFGVNLQRASARSAGSHGLLELRTSDDILITQVVGPGEESHVDTHETFKNDAALYIQMLSVEETQSFALSMETKGDIKSDFVFFQFAIQYSNVYQADVSRVVTVRLPTVDSVSGYLESVQDEVAAVLIAKRTLLRAKNHSVAVDMRATIDERIKDIGLKFGSQLPKSKLHCFPKELSLLPELLFHLRRGPLLGCIIGHEDERSVLRNLFLNASFDLSLRMVAPRCLMHREGGTFEELPAYDLAMQSDTAVVLDHGTDVFIWLGAELVANEGKSASALAACRTLAEELTEFRFPAPRILAFKEGSSQARYFVSRLIPAHKDPPYEQEARFPQLRTLTSEQRTKLKSSFVHFDDPSFCEWMRSLKVVPPQPS

SEQ ID NO: 9188 - protein, 876 aa, Lupinus angustifolius
MANPTQPNVGFTSSNTQERQGPTLPNPDNKTPILPPPSFVTPPRFPPPTLHLQKQDQASNVLSPANDGVIKTGSGHVPHLSTPPGPPVFTSPVRPAAVPFRTSPASPQPVAFSSGPSLPSLSQPQFSNGSDELQQHRDSDSIIQDHVPAEDSSFVLFSAHKVLKQKKQANVPSLGFGALLSPGREISTGPQVIQRDPHRCQICGAYANIYSNILLGSGQWQCVICRKLNGSGGEYIAYNKEELHRFPELSSPMVDYVQTGNKGPSFVPVSDSRMSAPVVLVIDECLDEPHLQHLQSSLHAFVDSLPPTTRLGIVLYGRTVSVYDFSEESVASADVLPGDKSPSQESLKALIYGTGIYLSPMHASLPVAHSIFSSLRAYKLNIPEASRDRCLGTAVEVALAIIQGPSADLSRGIVKRLGGNSRIIVCAGGPNTYGPGSVPHSFSHPNYPYMEKTALKWMENLGREAHRHNTVVDILCAGTCPVRIPILQPLAKASGGVLVLHDDFGEAFGVNLQRASARSAGSLGLLELRTSDDILITQVVGPGEESHVDTHESFKNDTALYIQMLSVEETQCFSISMETKGDIKRDSVFFQFAIQYSNVYKADVSRVVTVRLPTVDSISGYLQSVQDEVAAVLIAKKTLLRAKNHSDAIDMRATIDERIKDIALKFGSQLPKSKLHRFPKEISLLPELLFHLRRGPLLGSIIGHEDERSVLRNLFLNASFDLSLRMLAPRCLMHREGGTFEELPAYDLAMQSDAAVVLDHGTDVFIWLGSEVAADEGRSAAALAACRTLAEELTEFRFPAPRILAFKEGSSQARYFVSRLIPAHKDPPYEQEARFPQLRSLTQEKRTKLKSSFVHFDDPSFCEWMRSLKVVPPEPR

SEQ ID NO: 9189 - protein, 864 aa, Trigonella foenum-graecum
MANNPTQPNVGFIPSNPEQKQTPIPIHPPPPPPSTSSILAPPPRFPPPILQLQKDQAANGAVATGSPVPHLSTPPGPPVFTSPVRPAAVPFRTSPASPQPPALSSASSLPTSSPPHYSNGSFDLQQISGGTEDNIPIGESSFVLFSAHKVLKQKKQANVPSLGFGALVSPGREVSTGPQVVQRDPHRCQSCGAYANKYCNILLGSGQWQCVICRKLNGSDGEYIAHSKEDLHRFPELSSPMVDFVQTGTKRPGFVPVSDSRMSAPVVLVIDECLDEPHLQHLQSSLHAFVDSLPPTTRLGIILYGRTVSVYDFLEESVASADVLSGDKSPSEDSLKALLYGTGIYLSPMHASLAVAHSIFSSLTPYKLNVPEASRDRCLGTAVEVALAIIQGPSADLSRGVVKRSGGNSRIIVCAGGPNTYGPGSVPHSFNHPNYPYMEKTALKWMENLGREAHRHNILVDILCAGTCPVRVPILHPLAKASGGVLVLHDDFGEAFGVNLQRASARSAGSHGLLELRTSDDILITQVVGPGEESHVDTHETFKNDTALYIQMLSVEETQSFALSMETKGDIKSDFVFFQFAIQYSNVYQADVSRVVTVRLPTVDSVSGYLESVQDEVAAVLIAKRTLLRAKNQSVAVDMRATLDERIKDIGLKFGSQLPKSKLRCFPKELSLLPELLFHLRRGPLLGCIIGHEDERSVLRNLFLNASFDLSLRMVAPRCLMHREGGTFEELPAYDLAMQSDTAVVLDHGTDVFIWLGAELVADEGKSASALAACRTLAEELTEFRFPAPRILAFKEGSSQARYFVSRLIPAHKDPPYEQEARFPQLRTLTSEQRTKLKSSFVHFDDPSFCEWMRSLKVVPPQPS

SEQ ID NO: 9190 - protein, 876 aa, Prunus persica
MANPRQPSIGYSVSITPSHPDTTSPDPEKISIPPPTLITPGAPRFPLPRFQQDQAPSPSLKTPNASSPANGLKTGSPIPHLSTPPGPPVFTSPVRPAAVPFRASPATPQPVAFSPGSSLPTSSPLNFSNGSHELQHELSNVTEDDIASVGESPYVLFSAHKVLKQKKQANIPSLGFGALVSPGREISPAPQIIQRDPHRCHSCGAYANIYCNILLGSGQWQCVICRELNGSEGEYIAPSKEDLCNFPELSSPMVDYVQTGNNRPGFIPVSDSRMSAPIVLVIDECLDEPHLWDLQSSLHAFVDSLPPTTRIGIILYGRTVSVYDFSEESIASADVLPGETSPSQDSLKALIYGTGIYLSPMHASLPVAHAIFSSLRPYKLKIPEASRDRCLGTAVEVALAIVQGPSGEMSRGVIKRSGGNSRIIVCAGGPNTYGPGSVPHSFSHPNYPHMEKTALKWMEHLGHEAHRHNTVVDILCAGTCPVRVPILQPLAKASGGVFVLHDDFGEAFGVNLQRASTRAAGSRGFLAIRCSDDILITQVVGPGEEAHMDTHETFKNDTSLYIQMLSVEETQSFSLSLENKRDIMTEYVYFQFTIQYLNVYQADISRVITIRLPTVDSVSAYLASVQDEVAAVLIAKRTLLRAKNYSDAIDMRATIDERIKDIALKFGSQAPKSKHYRFPKEVSLLPELLFHLRRGPLLGSIVGHEDERSVLRNLFLNASFDLSLRIVAPRCLMHREGGTFEELPAYDLAMQSDAAVVLDHGTDVFIWLGAELAADEGKSAAALAACRTLAEELTELRFPAPRILSFKEGSSQARYFVSRLIPAHKDPPYEQEARFPQLRTLTTEQRTKLKSSFLNFDEPSFCEWVRSLRVVPPEPS

SEQ ID NO: 9191 - protein, 878 aa, Quercus alba
MANPPPPSLGYSVSITPSNPDISNPHSERNPILPPPPPPSNSPTPPRFPPPKLQQDQIPSSSIKSPNVPSPSNGVKMGSPIPHLSTPPGPPVFTSPVRPAAVPFRSSPASPQPVAFSSGSSLPTSSPPQFSNGSVELQQQVSDDTLDLTPAGDSAYVLFSAHRVLKQKKLANVPSLGFGALVSPGREISSGPQVIQHDPHRCQSCGAYVNFYCKILIGSGQWQCVICHELNGSQGEYIAPNKELLRTFPELSSPMVDYIQTSNNRPGFIPVSDSRMSAPIVLVIDECLDEPHLQHLQSSLHAFVDSLHPSTKLGIVSYGRTVSVYDFSEESVASADVLPGDKSPTQEQLKALIYGSGIYLSQMHASLPVAHAIFSSMRPYKLNFPEASRDRCLGTAVEVALAIIQGPSAELSRGVVKRSGGNSRIIVCAGGPNTYGPGSVPHSFSHPNYPHMEKMALKWMEQLGQEAHRHNTVVDILCAGTCPVRVPVLQPLAKASGGVLVLHDDFGEAFGVNLQRASSRAVGSHGLLEIRCSDDILITQVVGPGEEAHLDTHETYTNDSSLYIQMLSVEETQSFSVSMETKRDIKRDYVFFQFAVQFSNMFQADISRVITVRLPTVDSVSAYLESVQDEVAAVLIAKRTLLRAKNSSDAVDMRTTIDERVKDIALKFGSQIPKSKLYRFPKELSLLPELLFHLRRGPLLGSIIGHEDERSVLRYLFLNASFDLSLRMVAPRCLMHREKGTFEELPAHDLAMQSDAAVVLDHGTDVFIWLGAELAADEGRSASALAACRTLAEEITELRFPAPRILAFKEGSSQARYFVSRLIPAHKDPPYEQEARFPQLRSLTTEQRMKLKSNFLHFDDPSFCEWMRSLKSVPPEPS

SEQ ID NO: 9192 - protein, 876 aa, Prunus mume
MANPRQPSIGYSVSITPSHPDTTSPDPEKISIPPPPLITPGAPRFPVPRFQQDQAPSPSLKTPNAPSPANGLKTGSPIPHLSTPPGPPVFTSPVRPAAVPFRASPATPQPVAFSPGSSLPTSSPLNFSNGSLELQHELSNVAEDDIASVGESPYVLFSAHKVLKQKKQANIPSLGFGALVSPGREISPAPQIIQRDPHRCHSCGAYANIYCNILLGSGQWQCVICRDLNGSEGEYIAPSKEDLCNFPELSSPMVDYVHTGNNRPGFIPVADSRMSAPIVLVIDECLDEPHLWDLQSSLHAFVDSLPPTTRIGIILYGRTVSVYDFSEESIASADVLPGEKSPSQDSLKALIYGTGIYLSPMHASLPVAHAIFSSLRPYKLKIPEASRDRCLGTAVEVALAIVQGPSGEMSRGVIKRSGGNSRIIVCAGGPNTYGPGSVPHSFSHPNYPHMEKTALKWMEHLGHEAHRHNTVVDILCAGTCPVRVPILQPLAKASGGVFVLHDDFGEAFGVNLQRASTRAAGFRGFLAIRCSDDILITQVVGPGEEAHMDTHETFKNDTSLYIQMLSVEETQSFSLSLENKRDIMTEYVYFQFTIQYLNVYQADISRVITVRLPTVDSVSAYLASVQDEVAAVLIAKRTLLRAKNYSDAIDMRATIEERIKDIAMKFGSQAPKSKLYRFPKEVSLLPELLFHLRRGPLLGSIVGHEDERSVLRNLFLNASFDLSLRMVAPRCLMHREGGTFEELPAYDLAMQSDAAVVLDHGTDVYIWLGAELAADDGKSAAALAACRTLAEELTELRFPAPRILSFKEGSSQARYFVSRLIPAHKDPPYEQEARFPQLRTLTTEQRTKLKSSFLNFDEPSFCEWVRSLRVVPPEPS

SEQ ID NO: 9193 - protein, 875 aa, Manihot esculenta
MANPPQPSLGYPLTVTPTNPDKSTPQPEKTPISPSPPVLPGASIFPSRNLQQDQNSSPSIKTPNLLSPSNGIKTGSPIPHLSTPPGPPVFTSPVRPAAVPFRTSPATPQPVAFSSGSSLPTSSPPHFSDGSLELQHQVPLAIEDSISLEELPHILFSAHKVLKQKKLANVSSLGFGALISPGRKISPGPQIILRDPHRCQNCGAYANLYCKILLGSGQWQCVICRKLNGSDGEYIAPSKEDLHNFPEMSSTMVDYVQTGNKRPGFVPVSDSRMSAPIVLVIDDCLDEPHLQHLQSSLHAFVDSLPPTARIGIILYGRTVSVYDFSEESMASADVLPGDKSPSQESLKALIYGTGVYLSPMHASKEVAHQIFSSLTPYKLNIAEASRDRCLGTAVEVALGIIQGPSAEMSRGIVKRAGGNSRIIVCAGGPSTYGPGSVPHSFSHPNYPHMEKMALKWMEHLGCEAHRQNTVVDLLCAGTCPVRVPVLQPLAKASGGVLVLHDDFGEAFGVNLQRASTRASGSQGLLEIRCSDDILITQVVGPGEEAHIDTHEAFKNDASLSIQMLSVEETQSFALSMETKGDIKTDWVFFQFAIQYSSLYQADISRVITVRLPTVDSVSSYLGSVQDEVAAVLIAKRTLLRAKNYSAAIDMRATIDERIKDIALKYGSQLQKSKLYRFPKELSLLPEFLFHLRRGPLLGNIVGHEDERSVLRNLFLNASFELSLRMVAPRCLMHREGGTFEELPAYDLAMQSDTAVVLDQGTDVFIWLGAELAADEGRSAAALAACRTLAEELTEVRFPAPRILAFKEGSSQSRYFVSRLIPAHKDPPYEQEARFPQLRSLTTERRTKLKCSFIHFDDPSFCEWMRSLKVVPPEPS

SEQ ID NO: 9194 - protein, 870 aa, Malus domestica
MSNPPQPPIGYSVSITPSRPHIPSPDPEKISIPPPPLITPRFPPPKFQHDQTPPPLIKTPNVPSPANGLKTGSPIPHLSTPPGPPVFTSPVRPAAVPFRASPATPQPVAFSPGTSLSTCSPPNFSNGSQHQLSNDTEDDAVPVGESPYVLFSAHKVLKQKKQANVPSLGFGALVSPGREISPGPQIIQRDPHRCHSCGAYANIYCNILLGSGQWQCVICRELNGSEGEYRAPSKEDLCNFPELSSPMVDYVQTGNNRPGFVPVSDSRMSAPIVLVIDECLDEPHLWDLQSSLHAFVDSLPPTMRIGIILYGRTVSVYDFSEESIASADVLPGDKSPSQDALKALIYGSGLYLSPMHASLPVAHAIFSSLRPYKLKISETSRDRCLGTAVEVALAIVQGPSGEMSRGVIKRSGGNSRIIVCAGGPNTYGPGSVPHSFSHPNYPHMEKTALKWMEHLGQEAHRQNTVVDILCAGQCPVRVPVLQPLAKASGGIFVLHDDFGEAFGVNLQRASTRAAGSRGFLAIRCSDDILITQVVGPGEEAHIDTHETFKNDTSLYIQMLSVEETQSFSLSLENKRDIRTEYVYFQFTIQYLNVYQADISRVITVRLPTVDSVSAYLTSVQDEVAAVLIAKRTLLRAKNYSDAIDMRATIDERIKDIALKFGSQVPKSKFYRFPKEISLLPELLFQLRRGPLLGSIVGHEDERSVLRNLFLNASFDLSLRMVAPRCLMHREGGTFEELPAYDLAMQSDAAVVLDHGTDVFIWLGAELAADEGKSAAALAACRTLAEELTELRFPAPRILSFKEGSSQARYFVSRLIPAHKDPPYEQEARFPQLRTLTTEKRTKLKSSFISFDEPSFCEWVRSLKVVPPEPS

SEQ ID NO: 9195 - protein, 872 aa, Populus trichocarpa
MTNPPPPSLGYSVTVTPSNPDSSTPQPVKNSAPPPTMLPGAPRFPPPKLQQDQIPSPFFRNPNLLSPANGVRSPVPHLSTPPGPPVFKSPVRPAAVPFRTSPATPQPIAFSSGSTLPTSSPPHFSNGSVELQHQVPLATEDSTLVNESLCALFSAHKVLKQKKLTNVPSLGFGALFSPGREIFPGPQILQRDPHRCHNCGAYANLYCKILLGSGQWQCVICRKLNGSEGEYVAPSKEDLRNFPELSSPIVDYVRTGNKRPGFIPVSDSRMSAPVVLVIDDCLDEPHLQHLQSSLHAFVDSLPPTARIGIILYGRTVSVYDFSEESMASADVLPGDKSPIQESLKALIYGTGVYLSPMHASKEVAHKIFSSLRPYKSNIAEALRDRCLGTAVEVALAIIQGPSAEMSRGVVKRNGGNSRIIVCAGGPNTYGPGSVPHSFSHPNYPHLEKTALKWMENLGREAHRNNAVVDILCAGTCPVRIPVLQPLAKASGGVLVLHDDFGEAFGVNLQRASSRASGSHGLLEIRCSDDILITQVVGPGEEAHVDTHETFKNDNALCIQMLSVEETQSFALSMETKGDIKSDCVFFQFTVLYANIYQADISRVVTVKLPTVDSVSAYLESFQDEVAAILIAKRTLLRAKNHSDAMDMRGTIDERIKDIALKFGSLVPKSKLHRFPKELSALPELLFHLRRGPLLGSIVGHEDERSVLRNLFLNASFDLSLRMVAPRCLMHREGGTFEELPAYDLAMQSDTAVVLDHGTDVFIWLGAELAADEGRSAAALAACRTLVEEITELRFPAPRILAFKEGSSQARYFVSRLIPAHKDPPYEQEARFPQLRSLTTEQRTKLKSSFIHFDDPSFCEWMRSLKVVPPEPS

SEQ ID NO: 9196 - protein, 828 aa, Ricinus communis
MANNPPQPSVGYPLTITPKIDTSTPEKSPIPPSPPILAPRFPPPILQQDQVLSPSIKTPNLLSSANGVNIGSPIPHLSTPPGPPVFSSPVRPAAVPFRTSPATPQPIAFSSGSSLPTSSPPHFLNGSPELQHQVPQVSEDSMPAEELSCILFSAHKVLRQKKLANVPSLGFGALISPGREISPAPQIIQRDPHRCQNCGAYANLYCKILLGSGQWQCVICRKLNGSDGEYIAPSKEDLRNLPELSSPLVDYVQTGNKRPGFIPVSDSRMSAPTILVIDDCLDEAHLQHLQSSLHAFVDSLPPTARIGIILYGRTVSVYDFSEESMASADVLPGDKSPTQESLKALIYGTGVYLSPMHASKEVAHQIFSSLRPYKLNIAETSRDRCLGTAVEVALAIIQGPSAEMSRSVVKRAGGNSRIIVCAGGPNTYGPGSVPHSFSHPNYPHMEKMALKWMEHLGHEAHRQNTVVDILCAGTCPVRVPILQPLAKASGGVLILHDDFGEAFGVNLQRASIRASGSQGLLEVRCSDDILISQVVGPGEEAHVEPHETFKNDTSLSVQLLSVEETQSFALSMETKREINSDCVFFQFAIQYSSIYIADISRVITVRLPTVDSVSEYLESVQDEVAAILIAKRTLLRAKNSSDAIDARATIDERIKDMALKFGSQVPKSKLHRFPKELSLLPELLFHLRRGPLLGNIVGHEDERSVLRNLFLNASFDLSLRMVAPRCLMHREGGTFEELPAYDLAMQSDTAVVLDHGTDVFIWLGAELAADEGRSAAALAACRTLAEELTELRFPAPRILAFKEGSSQARYFVSRLIPAHKDPPYEQVK

SEQ ID NO: 9197 - protein, 875 aa, Theobroma cacao
MATPPQASPGYSKTITPQMDSPSPNPDRSPIVPAPSTISPAAPRFPPPNLRKDQIPSPSIKNPTMLSPANGVKTGSPIPHLSTPPGPPVFTSPVRPAAVPFRTSPATPQPVAFSSGSSLPTSSPPHFSNGSVELQQQLPSAIEESLPDGESPCVLFSAQKVLKQKKQANVPSLGFGVLVSPGRETSPGPQVIQRDPHRCHNCGAYSNFYCNILIGSGQWQCVICRNLNGSEGEYITSSKEDLCNFPELSSPLVDFIQTGNKRPSFVPVTDSRTSAPIVLVIDECLDEPHLQHLQSSLHAFVESVLPTTRIGIILYGRTVSVYDFSEESIASADVIPGGTSPTQENLKALIYGTGIYLSPMHASKEVAHQIFSSLRPYKLNVPEASRDRCLGTAVEVALAIIQGPSADMSRGVVKRPGGNSRIIVCSGGPNTYGPGSVPHSYTHPNYPHKEKTALKWMEGLGREAHQHNTVVDILCAGTCPVRVPVLQPLAKASGGVLVLHDDFGEAFGVNLQRASARAAGSHGLLEIRCSDDILVTHVVGPGEEAHIDTHETFKNDISLCIQLLSVEETQCFSISMENKHDIKSDYVYFQFAIQYSNVYQADIARVITIRLPTVDSVSAYLQSVQDEVAAVLIAKRTLLRANNYSDAIDMRTTIDERVKDIALKFGSQVPKSKLYRFPKEISLLPELLFHLRRGPLLGSIVGHEDERSVLRNLFLNASFDLSLRMVAPRCLMHREGGTFEELPAYDLAMQSDTAVVLDHGTDVFIWLGAELAADEGRSAAALAACRTLAEELTELRFPAPRILAFKEGSSQARYFVSRLIPAHKDPPYEQEARFPQLRTLTTEQRTKLKSSFIHFDDPSFCEWIRSLKVVPPEPS

SEQ ID NO: 9198 - protein, 874 aa, Eucalyptus grandis
MANQRPPSPGYSITMTPSNPGTPAPHTDRSPIRPPPLTPAAPRFPPPQLQQEHLASPLIRNPNLQSPPNGVHSGSPTPHMSTPPGPPVFTSPVRPAAVPFRSSPATPQPVAFSSGSSLPASSPPHFSNGSGDLQHQVSDSAEDLTSTGKAPYVLFSAQKVLKQKRQANVPSLAFGALVSPGREVSTGPQILQRDPHRCQNCGAYANFYCNILIGSGQWQCVICRKLNASEGEYIASSKEELRNFPELSSPMVDYVQTGNRRPGFIPVSDSRMSAPIVLVIDECLDEPHLQHLQSSLHAFVDSLSPTTRIGIILYGRTVSVYDFSEESVASADVLPGDKSPTQESLKALIYGTGIYLSPMHASLPVAHTMFSSFRPYKLDVPEVSRDRCLGTALEVALALIQGPSAEMSRGIVKRSGGNGRIIVCAGGPCTYGPGSVPHSFTHPNYAHMEKTATKWMEHLGREAHRNNTVVDILCAGTCPLRVPVLQPLAKASGGVLILHDDFGEAFGVNLQRAATRAAGSHGLLEIRCSDDILITQVVGPGEEAHVDTHESFKNDAALSIQMLSVEETQSFSISMETKNDIKSDHVFFQFAIQYSNVYQADISRVITVRLPAVDSVSAYLDSVQDEVAAVLIAKRTLLRAKNHSDAIDMRVTIDERIKDIAQKFGSQIPKSKLCRFPKELSLLPELLFHLKRGPLLGSIVGHEDERSVLRNLFLNASFDLSLRMVAPRCLMHREGGTFEELPAYDLAMQSDTAVVLDHGTDIFIWMGAELAADEGKNAATLAACRTLAEELTESRFPAPRILAFKEGSSQARYFVSRLIPAHKDPPYDQEARFPQLRSLTAEQRTKLKNSFLHFDDPSFCEWMRSLRAVPPEPS

SEQ ID NO: 9199 - protein, 875 aa, Manihot esculenta
MAKQPQPSLAYPLTVAPTNPDTSTPQPEKTPINPSTPMLPGAPRFPSPNLQQDQSPSPSIKTPILQSPFNGIKTGSSIPHLSTPPGPPVFTSPVRPAAVPFRTSPATPQPVAFSSGSSLPTSSPPHFSNGSAQLHHQVPQATEDSISIEELPCVLFSAHKVLKQKKLANVSSLGFGALIFPGREISPGPQIIQRDPHRCQNCGAYANLYCKILLGSGQWQCVICRKLNGSDGEYIAPSKEDLSNLPEISSPMVDYVRTGNKRPGFVPVSDSRMSAPIVLVIDECLDEPHLQHLQSSLHAFVDSLPPAARIGIILYGRTVSVYDFSEESMASADVLPGDKSPSQESLKALIYGTGVYLSPMHASKEVAHQIFSSLRPYKLKIAEASRDRCLGTAVEVALSIIQGPSAEMSRGVVKRAGGNSRIIVCAGGPSTYGPGSVPHSLSHPNYPYMEKTALKWMEHLGHEAYRHNTVVDILCAGTCPVRVPLLQPLAKASGGILVLHDDFGEAFGVNLQRASTRASGSQGLLEIRCSDDILITQVVGPGEEAHIDTHETFKNDVSFSIQMLSVEETQSFSLSMENKGDIKSDCVYFQFAIQYMSLYQADISRVITVRLSTVDSVSAYLESVQDEVAAILIAKRTLLRAKNYSDAIDMRTIIDERIKDIALRFGSQVPKSKLHRFPKELSLLPEFLFHLRRGPLLGNIVGHEDERSVLRNLFLNASFDLSLRMVAPRCLMHREGGTFEELPAYDLAMQSNTAVVLDHGTDVFIWLGAELAADEGRSAAALAACRTLAEELTELRFPAPRILAFKEGSSQARYFVSRLIPAHKDPPYEQEARFPQLRSLTTEQRTKLKCSFIHFDDPSLCEWMRSLKVVPPEPS

SEQ ID NO: 9200 - protein, 874 aa, Vitis vinifera
MANPPQPSLGYSGSLTPTQPDAPTLRPEKNSIPPPFPSPVAARFPPPRLQQEQIPSPSTRTPNLLSPVNGVKTGSPIPHLSTPPGPPVFSSPLRPAAVPFRTSPATPQPVAISSSSSLPTSSPPYYSNGSAELQHRVSDATEESLHLEKSPYVLFSADKVLKRKKQANVPSLGFGALVSPGREISPGPQVIQRDPHRCQNCGAYANLYCNILLGSGQWQCAICRNLNGSGGEYVATSKEELLNYPELSSPMVDYVQTGNKRPGFIPVGDLRISAPIVLVIDECLDEAHLQHLQSSLHAFVDSLPPTTRIGIVLYGRTVSVYDFSEDSFASADVLPGDKSPTQDSLKSLIYGTGIYLSAIHASLPVIHTIFSSLRPYKLNLPEASRDRCLGTAVEVALRIIQGPSAEISRGIVKRSGGNSRIIVCAGGPNTYGPGSVPHSLSHPNYPHMEKSALKWMEHLGQEAHRQNTVVDILCAGTCPVRVPILQPLAKASGGALVLHDDFGEAFGVNLQRASTRAAGSHGLFEIRCSDDILITQVVGPGEEAHTDAHETFKNDTSLSIQMLSVEETQSFALSMETKGDIKSDYVFFQFAIQYSNVYQADISRVITVRLPTVDSVSAYLGSVQDDVAAVLIAKRTLLQAKNYSDAIDMRATIDERVKDITIKFGSQLPKSKLYRFPKELSVLPEHLFHLRRGPLLGSIVGHEDERSVLRNLFLNASFDLSLRMIAPRCLMHREGGTFEELPAYDLAMQSDAAVVLDHGTDVFIWLGAELASDEGKSASALAACRTLAEELTESRFPAPRILAFKEGSSQARYFVSRLIPAHKDPPYEQEARFPQLRTLTADQRVKLKSSFLHFDDPSFCEWMRGLKLVPPEPS

SEQ ID NO: 9201 - protein, 871 aa, Populus trichocarpa
MANPPQPSLGYSVTAVPSNPDSSTPQPEKNYVPPPTMLPGASRFPPPKLHQDQIPSPSFQNPRLLSPANGVKTGSPVPHLSTPPGPPVFTSPVRPAAVPFRTSPATPQPVAFSSGSTLPTSSPPHFSNGSIELQHQVPLATNDSTPFEESSCALFSARKVLKQKKLANVPSLGFGALFSPGGEISPGPQIIQRDPHRCHNCGAYANLYCKILLGSGQWQCVICQKLNGSEGEYVAPSKEELRNLPELSSPIIDYIQIGNKRPGFIPVSDSRMSAPTVLVIDECLDETHLQHLQSSLHAFVDSLPPTARIGIILYGRTVSVYDFSEELMASADVLPGDKSPTRESLKALIYGTGVYLSPMHASKEVAHKIFSSLRPFGLNIAESSRDRCLGTAVEVALAIIQGPSAEMSRGIIKRAGGNSRIIACAGGPNTYGPGSVPHSFSHPNYPHMEKTALKWMENLGREAHRHNTVVDILCAGTCPVRIPVLQPLAKASGGVLVLHDDFGEAFGVNLQRAASRASRFHGLLEIRCSDDILITQVVGPGEEAHVDTHETFKNNNALCIQMLSVEETQSFALSMETKEDIKSDCVFFQFAVRYANVYQADISRVVTVRLPTVDSVSAYLESVQDEVAAILMAKRTLLRAKNHSDVMDMRGTIDERIKDIALKFGSLVPKSKLHQFPKELSALSELLFHLRRGPLLGSIVGHEDERSVLRNLFLNASSDLSLRMVAPRCLMHREGGTFEELPAYDLAMQSDTAVVLDHGTDVFIWLGAELAADEGRSAAALAACRTLAEEITELRFPAPRILAFKEGSSQARYFVSRLIPAHKDPPYEQEARFPQLRSLTIEQRMKLKTSFIHFDDPSFCEWMRSLKVVPP

SEQ ID NO: 9202 - protein, 875 aa, Fragaria vesca
MSNPPPQPSLGYFSPSKSDTSSPDPASNAIPPPPLVSPGQSRFPPPKFQLDQLPPPSIRTPNGPSPASGGLKTGSPIPHLSTPPGPPVFTSPVRPAAVPFRASPVTPQPVAFSPAASLPTSSPVYFSNGSHELERELSNVTDDDTVPVGEPPYVLFSAHKVLKQKKQANVPSLGFGALVSPGREVSPGPQIIQRDPHRCHSCGAYANIYCNILLGSGQWQCVICRELNGSEGEYISSSKEELSNYPELLSPMVDYVQTGNNRPGFVPVSDSRMSAPIVLVIDECLDEPHLWHLQSSLHAFVDSLPPTTRIGIVLYGRTVSVYDFSEESIASADVLPGDKSPCQEYLKALIYGTGIYLSPMHASLPVAHAIFSSLRPYKLNVSEASRARCLGTAVEVALAIIQGPSADISRGVIKRSGGNSRIIVCAGGPNTYGPGSVPHSFSHPNYAHLEKTALKWMERLGQEAHRHNTVVDILCAGQCPVRVPVLQPLAKASGGVFVLHDDFGEAFGVNLQRASARAAGSRGFLAIRCSDDILITQVVGPGEEAHIDTHETFKNDTSLYIQMPSVEETQCFSLSLENKRDIRTEYVYFQFTIQYLNVYQADISRVITVRLPTVDSVSAYLESVQDEVAAVLIAKRTLLRAKNSSDAFDMRSTIDERIKDIALKFGSQVPKSKQYRFPKEISLLPELLFHLRRGPLLGSIVGHEDERSVLRNLFLNASFDLSLRMVAPRCLMHREGGTFEELPAYDLAMQSDAAVVLDHGTDIFIWLGAELSSDEGKSAAALAACRTLAEEISELRFPAPRILSFKEGSSQARYFVSRLIPAHKDPPYEQEARFPQLRTLTIEQRTKLKSSFISFDDPSFCEWVRSLRVVPPEPS

SEQ ID NO: 9203 - protein, 874 aa, Citrus clementina
MANPPQTSLGYSVTIGPSNPDISSPQPEKSLIPPPPMSSAPPRFPPPKLQQDHMTSPSIKTPNLLSPANGVKTGSPIPHLSTPPGPPVFTSPVRPAAVPFRTSPATPQPVALSSGSSFPTSSPPHFSNGSAELQHQVPHAAEETMPVGESSCVLFSAHKVLKKKKQANVPSLGFGALVSPGKEVSPSLQIIQRDPHRCHNCGAFANIYCKILLGSGQWQCVICRNLNGSEGEYVAPSKEELRNFPELSSPMVDYVQTGNNRSSYVPVSDSRMSAPIILVIDECLDEPHLQHLQSSLHAFVESIPPTARIGIILYGRTVSVYDFSEDSIASSDVLAGDKLPTEDSLKALLYGTGVYLSPMHASKQVAHDIFSSLRPYKLNITEASRDRCLGTAVEVALAIIQGPSAEMSRGVVKRPGGNSRIIVCAGGPNTYGPGSVPHSFSHPNYLHMEKMALKWMELLGRKAHQHNAVIDILCAGNCPVRVPVLQPLAKASGGVLVLHDDFGEAFGVNLQRASTRAAGSHGFLEIRCSDDILVTQIVGPGEEAHIDTHETFKNDAALSIQMPSVEETQSFAVSMENKRDIESNHVFFQFAIRYSNVYQADISRVVTVRLPTVDSVSAYLSSFQDEVAAVLIAKRTLLRAKIFSEAIDMRTMIDERVKDIALKFGSQVPKSKLYRFPKELSALSELLFHLRRSPLLGNIIGHDDERSVLRNLFLNASFDLSLRMVAPRCLMYREGGTFEELPAYDLAMQSDKAVVLDHGTDVFIWLGAELAADEGRSAAALAACRTLAEELSEFRFPAPRILAFKEGSSQARYFVTRLIPAHKDPPYEQEARFPQLRSLTPEERIKLKSSFLFFDDPSFCEWMRSLKVVPPEPS

SEQ ID NO: 9204 - protein, 874 aa, Citrus sinensis
MANPPQTSLGYSVTIGPSNPDISSPQPEKSLIPPPPMSSTPPRFPPPKLQQDHMTSPSIKTPNLLSPANGVKTGSPIPHLSTPPGPPVFTSPVRPAAVPFRTSPATPQPVALSSGSSFPTSSPPHFSNGSAELQHQVPHAAEETMPVGESSCVLFSAHKVLKKKKQANVPSLGFGALVSPGKEVSPSLQIIQRDPHRCHNCGAFANIYCKILLGSGQWQCVICRNLNGSEGEYVAPSKEELRNFPELSSPMVDYVQTGNNRSSYVPVSDSRMSAPIILVIDECLDEPHLQHLQSSLHAFVESIPPTARIGIILYGRTVSVYDFSEDSIASSDVLAGDKLPTEDSLKALLYGTGVYLSPMHASKQVAHDIFSSLRPYKLNITEASRDRCLGTAVEVALAIIQGPSAEMSRGVVKRPGGNSRIIVCAGGPNTYGPGSVPHSFSHPNYLHMEKMALKWMELLGRKAHQHNAVIDILCAGNCPVRVPVLQPLAKASGGVLVLHDDFGEAFGVNLQRASTRAAGSHGFLEIRCSDDILVTQIVGPGEEAHIDTHETFKNDAALSIQMPSVEETQSFAVSMENKRDIESNHVFFQFAIRYSNVYQADISRVVTVRLPTVDSVSAYLSSFQDEVAAVLIAKRTLLRAKIFSEAIDMRTMIDERVKDIALKFGSQVPKSKLYRFPKELSALSELLFHLRRSPLLGNIIGHDDERSVLRNLFLNASFDLSLRMVAPRCLMYREGGTFEELPAYDLAMQSDKAVVLDHGTDVFIWLGAELAADEGRSAAALAACRTLAEELSEFRFPAPRILAFKEGSSQARYFVTRLIPAHKDPPYEQEARFPQLRSLTPEERIKLKSSFLFFDDPSFCEWMRSLKVVPPEPS

SEQ ID NO: 9205 - protein, 869 aa, Citrullus lanatus
MAYTPQSSPGFSATQPDTAAPSSETNPIPPPLISTGTSRFPPKFQPDQMPSPSIRTPSAPSPANGIKTGSPIPHLSTPPGPPVFTSPIRPAAVPFRTSPASPQPIIFSSTSSLPASTPPHFLNASAVLQHQISDVAEDSMLVEESPNVLFSSQKVLKMKKQANVPSLGFGALLSPGREISSGPQIIQREPHRCPSCGAYSNLYCKILIGSGQWQCVICRKLNGSEGEYVAPSKEDLSHFPELSSSMVDYVRTGNRRPGFIPASDSRTSAPIVLVIDESLDEPHLQHLQSSLHAFIDSVSPTTRIGIILYGRTVSVYDFSEESVASADVLPGDKSPTPESLKALIYGTGIYLSPMHASLPVAHTIFSSLRPYKSSIPEASRDRCLGTAVEVALAIIQGPSAEVSRGVVRRSGANSRIIVCAGGPNTYGPGSVPHSVSHPNYLHMEKSALNWMEHLGREAHQQNTVVDILCAGTCPVRVPILQPLAKASGGVLVLHDDFGEAFGVNLQRASARAAGSHGLLEVRCSDDIVITQVVGPGEEAHIDTHETFKNDTSLYIQMLSVEESQSFSLSMETKRDIKSDFVFFQFVVQYSNVYQADISRVITVRLPTVDSLSEYLESVQDEIAAVLIAKRTALQAKSQSDAIDMRATIDERVKDIALKFGTPAPKLKIYRFPKELSSMPELLFHLRRGPLLGSIVGHEDERTVLRNLFLNASFDLSLRMVAPRCLMHREGGTFEELPAYDLAMQSDAAVVLDHGTDVFIWLGAELAADEGKSAAALAACRTLAEELTESRFPAPRILAFKEGSSQARYFVSRLIPAHKDPPYEQEARFPQLRTLSTEQRTKLKSSFLHFDDPSFCEWMRSLKLIPPEPS

SEQ ID NO: 9206 - protein, 811 aa, Castanea mollissima
VPSPSNGVKMGSPIPHLSTPPGPPVFTSPVRPAAVPFRSSPASPQPVAFSSGSSLPTSSPPHFSNGSVELQQQVSDDTLDLTPAGDSAYVLFSAHKVLKQKKLANVPSLGFGALLSPGREISSGPQVIQHDPHRCQSCGAYVNFYCKILIGSGQWQCVICHELNGSQGEYIAPNKELLRTFPELSSPMVDYIQTSNNRPGFIPVSDSRMSAPIILVIDECLDEPHLQHLQSSLHAFVDSLHPSTKLGIISYGRTVSVYDFSEESVASADVLPGDKSPTQEALKALIYGSGIYLSQMHASLPVAHAIFSSMRPYKLNFPEASRDRCLGTAVEVALAIIQGPSAELSRGVVKRSGGNSRIIVCAGGPNTYGPGSVPHSFSHPNYPHMEKMALKWMEQLGQEAHRHNTMVDILCAGTCPVRVPVLQPLAKASGGVLVLHDDFGEAFGVNLQRASSRAVGSHGLLEIRCSDDILITQVVGPGEEAHVDTHETYKNDSSLYIQMLSVEETQSFSLSMETKRDIKRDYVFFQFAVQFSNMFQADISRVITVRLPTVDSVSAYLESVQDEVAAVLIAKRTLLRAKNSSDAVDMRTTIDERVKDIALKFGSQIPKSKLYRFPKELSLLPELLFHLRRGPLLGSIIGHEDERSVLRYLFLNASFDLSLRMVAPRCLMHREKGTFEELPAHDLAMQSDAAVVLDHGTDVFIWLGAELAADEGRSASALAACRTLAEEMTELRFPAPRILAFKEGSSQARYFVSRLIPAHKDPPYEQEARFPQLRSLTTEQRMKLKSSFLHFDDPSFCEWMRSLKSVPPEPS

SEQ ID NO: 9207 - protein, 869 aa, Cucumis sativus
MAYTSQSSPGFSATQPDTPAPSSETNSIPPPLISTGSSRFPPKFQQDQMPSPSIKTPGAASPANGIKTGSPIPHLSTPPGPPVFTSPIRPAAVPFRTSPASPQPVVFSSASSLPASTPPHFFNASSGLQHQMSDVSEDSTSVAESPNVLFSSQKVPKTKKLANVPSLGFGALVSPGREMSSGPQILHREPHRCSSCGAYSNLYCNILIGSGQWQCVICRKLNGSEGEYVAPSKEDLCHFPELSSSMVDYVRTGNRRPGFIPASDSRTSAPIVLVIDESLDEPHLQHLQSSLHAFIDSVSPTTRIGIILYGRTVSVYDFSEESVASADVLPGDKSPTPDSLKALIYGTGIYLSPMHASLPVAHTIFSSLRPYKSSVPEASRDRCLGTAVEVALAIIQGPSAEVSRGVVRRSGANSRIIVCAGGPNTYGPGSVPHSVSHPNYLHMEKSALNWMEHLGHEAHQQNTVVDILCAGTCPVRVPILQPLAKASGGVLVLHDDFGEAFGVNLQRASARAAGSHGLLEVRCSDDILITQVVGPGEEAHVDTHETFKNDTSLYIKMLSVEESQCFSLSMETKRDLKSDFLFFQFVVQYSNVYQADISRVITVRLPTVDSLSEYLESVQDEIAAVLIAKRTALQAKSQSDSTDMRVTIDERVKDIALKFGSLAPKSKIYRFPKELSSVPELLFHLRRGPLLGSIVGHEDERSVLRNLFLNASFDLSLRMIAPRCLMHREGGTFEELPAYDLAMQSDAAVVLDHGTDVFIWLGAELAAEEGKSAAALAACRTLAEELTESRFPAPRILAFKEGSSQARYFVSRLIPAHKDPPYEQEARFPQLRTLSTEQRTKLKSSFLHFDDPSFCEWMRSLKLIPPEPS

SEQ ID NO: 9208 - protein, 864 aa, Gossypium raimondii
MATPPQASPGAPNTDKKSPMTPAPPTISPGAPRFTPPNLQQDQIASPSIKNPIMLSPENGVKTGSPVPHLSTPPGPPVFTSPVRPAAVPFRTSPVTPQPVAFSSGSSLPTSSPPHFPNGSAELQQQLPGATEESMPAGESPCVLFSAHKLLKHKKLANVPSLGFGVLVSPGRETSTGPQVIHRDPHRCHNCGAYSNLYSNILIGSGQWQCVICRNLNGSEGEYIASSKEELRNFPELSSPLVDFIQTGNKRPSFVPVTDSRTSAPVVLVIDECLDEAHLQHLQSSLHAFVDSVPPTTRIGIILYGSTVSVYDFTEESIASADVIPGGTSPTQETLKGLIYGTGIYLSPMHASKEVAHLIFSSLRPYKLNVPEVSRDRCLGTAVEVAMAIIQGPSVDMSRGVVKRPGGNSRIIVCAGGPNTYGPGSVPHSYTHPNYPHREKTAIKWMERLGREAHQHNIVVDILCAGTCPVRVPVLQPLANASGGVLVLHDDFGEAFGVNLQRASARAASSHGLLEIRCSDDILVTQVVGPGEEANIDTHETFKNDMAVSIQMLSVEETQCFSISMQNKHDIKSDYVFFQFAIQYSNVYQADIARVITIRLPTVDSVSAYLQSVQDEVAAVIIAKRTLLQAKSYSDAIDMQTTIDERVKDIASKFGSQVPKSKLYRFPKEISLLPELLFHLRRGPLLGSIVGHEDERSVLRNLFLNASFDLSLRMIAPRCLMHREGGTFEELPAYDLAMQSDTAVVLDHGTDVFIWLGAELAADEGRSAAALAACRTLAEELTELRFPAPRILAFKEGSSQARYFVSRLIPANKDPPYEQEARFPQLRTLTIEQRTKLKSSFIHFDDPSFCEWIRGLKAVPPEPI

SEQ ID NO: 9209 - protein, 344 aa, Abies balsamea
MGLFAFVSLFLFIVLSSVEAWRPWPQYFNQTTTALGLKQQPYKADLQFGTSKKNEGSSPYVNMKYHMGPVLTSTINVHTIWYGRWSLKEKRIINEFLLSISNNTKSPSVGQWWQTVQLYTDQTGANISRNIVIASQHEDYYSHGKILSRLTVQEVIKNAITSKSSPLPIDPKNGLYLLLTSSDVAVQDFCRAVCGFHYFTFPSIVGYTLPYAWVGHSGKQCPEVCAYPFAVPSYMTGMKAFKAPNGDVGVDGMISVIAHELAELSSNPLINAWYAGEDPTAPTEIADLCEGLYGTGGGGSYTGQVLTDKFGANYNVHGIRRRYLVQWIWSPIMNACSGPNALDT

SEQ ID NO: 9210 - protein, 344 aa, Pinus pinaster
MGVFACVGLFLFIVLSSVEAWRPWPQYFNQSTTALGLGQQPNKADLQFGTSKKNEGSSPYVNMKYHMGPVLTSAINVHTIWYGRWSKKEKRVINEFLLSISNNTKSPSVGQWWQTVQLYTDQTGANISRNIVITSQHEDYYSHGKVLSRLTVQEVIKNAITAKTSPLPIDPKNGLYLLLTSSDVAVQDFCRAVCGFHYFTFPSIVGYTLPYAWVGHSGKQCPEVCAYPFAVPSYMTGTKAFKAPNGDVGIDGMISVIAHELAELSSNPLINAWYAGEDPTSPTEIADLCEGLYGTGGGGSYTGQVLTDKFGANYNVNGIRRKYLVQWIWSPILNACSGPNALDS

SEQ ID NO: 9211 - protein, 344 aa, Pinus taeda
MGVFACVGLFLFIVLSSVEAWRPWPQYFNQSTTALGLRQQPNKADLQFGTSKKNEGSSQYVNMKYHMGPVLTSTINVHTIWYGRWSKKEKRVINEFLLSISNNTKSPSVGQWWQTVQLYTDQTGANISRNIVITSQHEDYYSHGKVLSRLTVQEVIKNAITAKSSPLPIDPKNGLYLLLTSSDVAVQDFCRAVCGFHYFTFPSIVGYTLPYAWVGHSGKQCPEVCAYPFAVPSYMTGTKAFKAPNGDVGIDGMISVIAHELAELSSNPLINAWYAGEDPTSPTEIADLCEGLYGTGGGGSYTGQVLTDKFGANYNVNGIRRKYLVQWIWSPILNACSGPNALDS

SEQ ID NO: 9212 - protein, 331 aa, Pseudotsuga menziesii
VLSSVEAWRPWPQYFNQTTTALGLKQQPNKADLQFGASKKHEGSSTFVNMRYHMGPVLTSTINVHTIWYGRWSKKEKRIINEFLLSISNNTKSPSVGQWWQTVQFYTDQTGANISRNIVIASQHEDYYSHGKILSRLTVQEVIKNAISAKTSPLPIDPKNGLYLLLTSSDVAVQDFCRAVCGFHYFTFPSIVGYTLPYAWIGHSGKQCPEVCAYPFAVPSYMTGMKAFKPPNGDVGIDGMISVIAHELAELSSNPLINAWYAGEDPTSPTEIADLCEGLYGTGGGGSYTGQVLTDKFGANYNVNGIRRRYLVQWIWSPILNACSGPNALDS

SEQ ID NO: 9213 - protein, 299 aa, Cedrus atlantica
MQFGTSKKNEGSSSYVNMRYHMGPVLTSAINVHTIWYGRWSMKEKRIINEFLLSISNNTQSPSVGQWWQTVQLYTDQTGANISRNIVIANQHEDRYSHGKVLSRLTVQEVIKNAITAKTSPLPIDPKNGLYLLLTSSDVAVQDFCRAVCGFHYFTFPSIVGYTLPYAWVGHSGKQCPEVCAYPFAVPSYMTGMKAFKAPNGDVGIDGMISVIGHELAELSSNPLINAWYAGEDPTSPTEIADLCEGLYGTGGGGSYTGQVLTDKFGANYNVHGIRRRYLVQWIWSPVLNACSGPNALDT

SEQ ID NO: 9214 - protein, 336 aa, Sequoia sempervirens
MGIWATTFLLVVFLVLSVEGWRPWPEHFNQTVKEQSGLLFGSSKKNEGSSPYVKMRYHMGPVLTSAINVHVIWYGRWSNKEKRVIREFLLSISNSSGSSPSVGEWWRTVQLYTDQTGANVSRNVVIASEHQDRYSHGKILSRLTVQEVIKNAITAKPNPLPIDPKNGLYLLLTDSDVQVQDFCRAVCGFHYFTFPSIVGYTLPYAWVGNSGKQCADLCAYPFAVPSYMTGMKAFTPPNGDVGIDGMISVIAHELAELSSNPLINAWYAGEDPTSPTEIADLCEGVYGTGGGGSFTGQVLTDKIGANYNAHGIRRKYLVQWIWNPTMNACAGPNALD

SEQ ID NO: 9215 - protein, 965 aa, Chrysanthemum coronarium
MAGGNNNHPPSTPTDPPTSSDHNDIPNSSQFNGNPPGTPDSPTSAGFNTDQLPRTSDNYSDDSEDEAEVEPRLINDEPDDVVDEDDVDGEDLFNDNFIDDYRDLGEQDQYESAGLDTSFEDERNLDQIIKDRQAAEMELDNRDGVASQRKIPQLLHDQDTDDDSYRPSKRTRARPAPGSPGGGSPGGSPPTSPPRGSRGPPSDTDDTDVPMTDAFEDDDDDEGEFEMYRVQGTLREWVTRDEVRRFIAKKFKEFLLTYENPKSDHRDLEYLRQINEMVSVNKCSLEIDYKQFIYTHPNIAIWLADAPQSVLEVMEEVANKVVFNLHPNYKRIHQKIYIRVTNLPVYDQIRNIRQIHLNTMIRVGGVVTRRSGVFPQLQQVKYDCNKCGSVLGPFVQNSYSEVKVGSCPECQSKGPFTVNIEQTIYRNYQKLTLQESPGIVPAGRLPRYKEVILLNDLIDCARPGEEIEVTGIYTNNFDLSLNTKNGFPVFATVIEANYVTKKQDLFSAYKLTQEDKEDIEKLSKDPRIGERIIKSIAPSIYGHEDIKTAIALAMFGGQEKNVQGKHRLRGDINVLLLGDPGTAKSQFLKYVEKTGQRAVYTTGKGASAVGLTAAVHKDPVTREWTLEGGALVLADKGICLIDEFDKMNDQDRVSIHEAMEQQSISISKAGIVTSLQARCSVIAAANPIGGRYDSSKNFSQNVELTDPIVSRFDVLCVVKDVVDPVMDEMLAKFVVDSHFKSTPKGGKADDKSTNNSQEDIQDFAMPVDPEILSQDMLKKYITYAKLNVFPRLHDADLDKLTQVYAELRRESSHGQGVPIAVRHIESMIRMSEAHARMHLRQHVTQEDVDMAIRVLLDSFISTQKFGVQKALQKSFKKYMTFKKDFNAIVLHLLNQLVKEAVHFEEIMSGANRNIAHIDVKVEELQSKALDYGLTDLNAFFNSPEFARGNFELDEERGVIRHNLVR

SEQ ID NO: 9216 - protein, 948 aa, Chrysanthemum coronarium
TDPPSSDNNDNPNSSQFNGNPPGTPDSPTSAGFNTDQLPRTSENYSDSDDEAEVEPRLINDEPDEVVDEDDVDGEDLFNDNFIDDYRELGEQDQYESAGLDASFEDERNLDQIIRDRQAAEMELDNRDGVASQRKFPQLLHDQDTDDDSYRPSKRTRARPPGSPGGGSPPTSPPRGGPRGPPSDTDDTDVPMTDAFEDDDDDDEGEFEMYRVQGTLREWVTRDEVRRFIAKKFKEFLLTYENAKSDHRDLEYLRQINEMVSVNKCSLEIDYKQFIYIHPNIAIWLADAPQSVLEVMEEVANKVVFNLHPNYKRIHQKIYVRVTNLPVYDQIRNIRQIHLNTMIRVGGVVTRRSGVFPQLQQVKYDCNKCGSVLGPFVQNSYSEVKVGSCPECQSKGPFTVNIEQTIYRNYQKLTLQESPGIVPAGRLPRYKEVILLNDLIDCARPGEEIEVTGIYTNNFDLSLNTKNGFPVFATVIEANYVTKKQDLFSAYKLTQEDKEDIEKLSKDPRIGERIIKSIAPSIYGHEDIKTAIALAMFGGQEKNVQGKHRLRGDINVLLLGDPGTAKSQFLKYVEKTGQRAVYTTGKGASAVGLTAAVHKDPVTREWTLEGGALVLADKGICLIDEFDKMNDQDRVSIHEAMEQQSISISKAGIVTSLQARCSVIAAANPIGGRYDSSKNFSQNVELTDPIVSRFDVLCVVKDVVDPVMDEMLAKFVVDSHFKSTPKGGKADDKSTNNSQEDVQDFAMPVDPEILSQDMLKKYITYAKLNVFPRLHDADLDKLTQVYAELRRESSHGQGVPIAVRHIESMIRMSEAHARMHLRQHVTQEDVDMAIRVLLDSFISTQKFGVQKALQKSFKKYMTFKKDFNAIVLHLLNQLVKEALHFEEIMSGPNRNIAHIDVKVEELQSKVLDYGLTDLNAFFNSPEFARGNFELDEERGVIRHHLIRS

SEQ ID NO: 9217 - protein, 941 aa, Chrysanthemum coronarium
DNNDNPNSSQFNGNPPGTPDSPTSAGFNTDQLPRTSENYSDSDDEAEVEPRLINDEPDEVVDEDDVDGEDLFNDNFIDDYRELGEQDQYESAGLDASFEDERNLDQIIRDRQAAEMELDNRDGVASQRKFPQLLHDQDTDDDSYRPSKRTRARPPGSPGGGSPPTSPPRGGPRGPPSDTDDTDVPMTDAFEDDDDDDEGEFEMYRVQGTLREWVTRDEVRRFIAKKFKEFLLTYENAKSDHRDLEYLRQINEMVSVNKCSLEIDYKQFIYIHPNIAIWLADAPQSVLEVMEEVANKVVFNLHPNYKRIHQKIYVRVTNLPVYDQIRNIRQIHLNTMIRVGGVVTRRSGVFPQLQQVKYDCNKCGSVLGPFVQNSYSEVKVGSCPECQSKGPFTVNIEQTIYRNYQKLTLQESPGIVPAGRLPRYKEVILLNDLIDCARPGEEIEVTGIYTNNFDLSLNTKNGFPVFATVIEANYVTKKQDLFSAYKLTQEDKEDIEKLSKDPRIGERIIKSIAPSIYGHEDIKTAIALAMFGGQEKNVQGKHRLRGDINVLLLGDPGTAKSQFLKYVEKTGQRAVYTTGKGASAVGLTAAVHKDPVTREWTLEGGALVLADKGICLIDEFDKMNDQDRVSIHEAMEQQSISISKAGIVTSLQARCSVIAAANPIGGRYDSSKNFSQNVELTDPIVSRFDVLCVVKDVVDPVMDEMLAKFVVDSHFKSTPKGGKADDKSTNNSQEDVQDFAMPVDPEILSQDMLKKYITYAKLNVFPRLHDADLDKLTQVYAELRRESSHGQGVPIAVRHIESMIRMSEAHARMHLRQHVTQEDVDMAIRVLLDSFISTQKFGVQKALQKSFKKYMTFKKDFNAIVLHLLNQLVKEALHFEEIMSGPNRNIAHIDVKVEELQSKVLDYGLTDLNAFFNSPEFARGNFELDEERGVIRHHLVR

SEQ ID NO: 9218 - protein, 740 aa, Chrysanthemum coronarium
MYRVQGTLREWVTRDEVRRFIAKKFKEFLLTYENAKSDHRDLEYLRQINEMVSVNKCSLEIDYKQFIYIHPNIAIWLADAPQSVLEVMEEVANKVVFNLHPNYKRIHQKIYVRVTNLPVYDQIRNIRQIHLNTMIRVGGVVTRRSGVFPQLQQVKYDCNKCGSVLGPFVQNSYSEVKVGSCPECQSKGPFTVNIEQTIYRNYQKLTLQESPGIVPAGRLPRYKEVILLNDLIDCARPGEEIEVTGIYTNNFDLSLNTKNGFPVFATVIEANYVTKKQDLFSAYKLTQEDKEDIEKLSKDPRIGERIIKSIAPSIYGHEDIKTAIALAMFGGQEKNVQGKHRLRGDINVLLLGDPGTAKSQFLKYVEKTGQRAVYTTGKGASAVGLTAAVHKDPVTREWTLEGGALVLADKGICLIDEFDKMNDQDRVSIHEAMEQQSISISKAGIVTSLQARCSVIAAANPIGGRYDSSKNFSQNVELTDPIVSRFDVLCVVKDVVDPVMDEMLAKFVVDSHFKSTPKGGKADDKSTNNSQEDVQDFAMPVDPEILSQDMLKKYITYAKLNVFPRLHDADLDKLTQVYAELRRESSHGQGVPIAVRHIESMIRMSEAHARMHLRQHVTQEDVDMAIRVLLDSFISTQKFGVQKALQKSFKKYMTFKKDFNAIVLHLLNQLVKEALHFEEIMSGPNRNVAHIDVKVEELQSKVLDYGLTDLNAFFNSPEFARGNFELDEERGVIRHHLIRS

SEQ ID NO: 9219 - protein, 619 aa, Amsonia hubrichtii
MEEQDQYESLGLDDSMEDERDLDQIMADRRAAEVELDTRDVRVVSSQRKLPHLLNDQDTDDDNYRPSKRTRADFRLPTTPRSFDDTDAMQSSPGRSQRGHSKDDVPMTDPTDDDPYEDDDNEEGEFEMYRVQGTLREWVTRDEVRRFIAKKFKEFLFTYVNPKNEHGDFEYLRQINEMVSVNRCSLEIDYKQFIYIHPNIAIWLADAPHSVLEVMEEVANKVVFDLHPNYRQIHKKIYVRITNLPVYDQIRNIRQIHLNTMIRIGGVVTRRSGVFPQLQQVKYDCNKCGAILGPFFQNSYSEVKVGSCPECQSKGPFTVNIEQTIYRNYQKLTLQESPGIVPAGRLPRYKEVILLNDLIDCARPGEEIEVTGIYTNNFDLSLNTKNGFPVFATVIEANHVTKKQDLFSAYKLTQEDKEEIEKLAKDPRIGERIVKSIAPSIYGHEDIKTAISLAMFGGQEKNVEGKHRLRGDINVLLLGDPGTAKSQFLKYVEKTGQRAVYTTGKGASAVGLTAAVHKDPVTREWTLEGGALVLADRGICLIDEFDKMNDQDRVSIHEAMEQQSISISKAGIVTSLQARCSVIAAANPIGGRYDSSKTFSQNVELTDPIISRFVHSLCC

SEQ ID NO: 9220 - protein, 870 aa, Panax ginseng
MEEHDQYESVGLDESLEDERDLDQIMADRRAAEIELEARDAATAAPPTLSHRKLPHLLHDQDTDDDNYRPSKRTRADFKPPTMPRSFDDTDAMQSSPGRSQRGHSREDVHMTDQTDDEPYEDEDNDEAEFEMYRVQGTLREWVTRDEVRRFIGKKFKEFMLTYVNAKSEHRDFEYLRQINEMVSVNRCSLEIDYKQFIYIHPNIAIWLADAPQSVLEVMEEVANNVVFDLHPNYKQIHQKIYVRITNLPVYDQIRNIRQIHLNTMIRIGGVVTRRSGVFPQLQQVKYDCNKCGMILGPFFQNSYAEVKVGSCPECQSKGPFTINIEQTLYRNYQKLTLQESPGIVPAGRLPRYKEVILLNDLIDCARPGEEIEVTGIYTNNFDLSLNTKNGFPVFATVIEANYVTKKQDLFSAYKLTQEDKEEIEKLSKDPRIGERIIKSVAPSIYGHEDIKTAIALAMFGGQEKNVEGKHRLRGDINVLLLGDPGTAKSQFLKYVEKTGQRAVYTTGKGASAVGLTAAVHKDPVTREWTLEGGALVLADKGICLIDEFDKMNDQDRVSIHEAMEQQSISISKAGIVTSLQARCSVIAAANPIGGRYDSSKNFSQNVELTDPIVSRFDILCVVKDVVDPVTDEMLAKFVVDSHFKSQAKGANLDDKSLGHSQENIEATAMTADPEIIPQDLLKKYITYTKLNVFPRLHDADLDKLTQVYAELRRESSHGQGVPIAVRHIESMIRMSEAHARMHLRQHVTQEDVDMAIRVLLDSFISTQKFGVQKALQKSFKKYMTFKRDFNGIVLHLLRQLVKDALHFEEIVSGSTTGLAHVDVKVEELQSKVHDYGITDLKAFFSSVEFSRANFELDEERGVISHRLAR

SEQ ID NO: 9221 - protein, 871 aa, Panax ginseng
MEEHDQYESVGLDESLEDERDLDQIMADRRAAEIELEARDAATAAPPTLSHRKLPHLLHDQDTDDDNYRPSKRTRADFKPPTMPRSFDDTDAMQSSPGRSQRGHSREDVHMTDQTDDEPYEDEDNDEAEFEMYRVQGTLREWVTRDEVRRFIGKKFKEFMLTYVNAKSEHRDFEYLRQINEMVSVNRCSLEIDYKQFIYIHPNIAIWLADAPQSVLEVMEEVANNVVFDLHPNYKQIHQKIYVRITNLPVYDQIRNIRQIHLNTMIRIGGVVDPALWSSFPQLQQVKYDCNKCGMILGPFFQNSYAEVKVGSCPECQSKGPFTINIEQTLYRNYQKLTLQESPGIVPAGRLPRYKEVILLNDLIDCARPGEEIEVTGIYTNNFDLSLNTKNGFPVFATVIEANYVTKKQDLFSAYKLTQEDKEEIEKLSKDPRIGERIIKSVAPSIYGHEDIKTAIALAMFGGQEKNVEGKHRLRGDINVLLLGDPGTAKSQFLKYVEKTGQRAVYTTGKGASAVGLTAAVHKDPVTREWTLEGGALVLADKGICLIDEFDKMNDQDRVSIHEAMEQQSISISKAGIVTSLQARCSVIAAANPIGGRYDSSKNFSQNVELTDPIVSRFDILCVVKDVVDPVTDEMLAKFVVDSHFKSQAKGTNLDDKSLGHSQENIEATAMTADPEIIPQDLLKKYITYTKLNVFPRLHDADLDKLTQVYAELRRESSHGQGVPIAVRHIESMIRMSEAHARMHLRQHVTQEDVDMAIGVLLDSFISTQKFGVQKALQKSFKKYMTFKRDFNGIVLHLLRQLVKDALHFEEIVSGSTTGLAHVDVKVEELQSKVHDYGITDLKAFFSSIEFSRANFELDEERGVISHRLAR

SEQ ID NO: 9222 - protein, 866 aa, Tabernaemontana elegans
MEEQDKYESLGLDDSMEDERDLDQIMADRRAAEVELDARDVRVVSSQRKLPQLLNDQDTDDDNYRPSKRTRADFRPPTTPRSFDDTDAMQSSPGRSQRGHSREDVPMTDPTDDDPYEDDDNEEGEFEMYRVQGTLREWVTRDEVRRFIGKKFKEFLFTYVNPKNEHGDFEYLRQINEMVSVNRCSLEIDYKQFIYIHPNIAIWLADAPHSVLEVMEEVANKVVFDLHPNYKQIHKKIYVRITNLPVYDQIRNIRQIHLNTMIRIGGVVTRRSGVFPQLQQVKYDCNKCGAILGPFFQNSYSEVKVGSCPECQSKGPFTVNIEQTIYRNYQKLTLQESPGIVPAGRLPRYKEVILLNDLIDCARPGEEIEVTGIYTNNFDLSLNTKNGFPVFATVIEANHVTKKQDLFSAYKLTQEDKEEIEKLAKDPRIGERIVKSIAPSIYGHEDIKIAIALAMFGGQEKNVEGKHRLRGDINVLLLGDPGTAKSQFLKYVEKTGQRAVYTTGKGASAVGLTAAVHKDPVTREWTLEGGALVLADRGICLIDEFDKMNEQDRVSIHEAMEQQSISISKAGIVTSLQARCSVIAAANPIGGRYDSSRTFSQNVELTDPIISRFDILCVVKDVVDPVTDEMLAKFVVDSHFKSQPKGANLDDRSMINSQDDDQASTVPTDPEIISQELLRKYITYAKLNVFPRLHDADLDKLTQVYAELRRESSHGQGVPIAVRHIESMIRMSEAHARMHLRQHVTQEDVDMAIRVLLDSFISTQKFGVQKALQKSFKKYMTFKKDFNAIVLHLLRGLVKDVLYFEEIVSGSTANVPHVDIKVEELQSKALDYGITDLKPFFSSTEFSRANFELDETRGVIRHRLAR

SEQ ID NO: 9223 - protein, 863 aa, Vitis vinifera
MDEHDQYESLGLDESLEDERDLDQIMEDRRAAEMELDTRDTRITETKLPRLLLDQDTDDDNHRPSKRSRADFRPPAAARSYDDADAMLSSPGRSRGHSREDVPMTDQTDDEPYEDDDDDDGEFEMYRVQGTLREWVTRDEVRRFIAKKFKEFLLTYVNPKNEHGDFEYVRLINEMVSANKCSLEIDYKQFIYIHPNIAIWLADAPQSVLEVMEDVAKNVVFDLHPNYKNIHQKIYVRITNLPVYDQIRNIRQIHLNTMIRIGGVVTRRSGVFPQLQQVKYDCNKCGMILGPFFQNSYSEVKVGSCPECQSKGPFTVNIEQTIYRNYQKLTLQESPGIVPAGRLPRYKEVILLNDLIDCARPGEEIEVTGIYTNNFDLSLNTKNGFPVFATVVEANYVTKKQDLFSAYKLTQEDKEEIEKLAKDPRIGERIVKSIAPSIYGHEDIKTAMALAMFGGQEKNVEGKHRLRGDINVLLLGDPGTAKSQFLKYVEKTGQRAVYTTGKGASAVGLTASVHKDPVTREWTLEGGALVLADKGICLIDEFDKMNDQDRVSIHEAMEQQSISISKAGIVTSLQARCSVIAAANPIGGRYDSSKTFSQNVELTDPIVSRFDVLCVVKDVVDPVTDEMLAKFVVDSHFKSQPKGTNVEDKSLSNSQDDIQPSARPLDPEILSQDLLKKYLTYAKLNVFPRLHDADLNKLTHVYAELRRESSHGQGVPIAVRHIESMIRMSEAHARMHLRQHVTQEDVDMAIRVLLDSFISTQKFGVQKALQKSFKKYMTFKKDYNELLLYLLRGLVKDALHFEEIVSGSSSGLPHIDVKVEELQSKAQDYEIYDLKPFFSSTQFSRAHFELDAERGVIRHRLAR

SEQ ID NO: 9224 - protein, 871 aa, Petroselinum crispum
MEEHDQYESLGLDESLEDERDLDQIMADRRAAEVELEARDAATTAPPTLSHRKLPHLLHDQDTDEDNFRPHKRTRADFKPPPTTPRSFDDTDAMHSSPGRSQWGNSREDVHMTDQTDDDPYEDEDNDEGEFEMYRVQGTLREWVTRDEVRRFIAKKFKEFILTYANPKNENTELEYLQQINEMVSVNKCSLEIDYKQFIYIHPNIAIWLADAPQSVLEVMEEVANKVVFELHPNYKQIHQKIYVRITNLPVYDQIRNIRQIHLNTMIRIGGVVTRRSGVFPQLQQVKYDCNKCGMVLGPFFQNSYAEVKVGSCPECQSKGPFTINIEQTLYRNYQKLTLQESPGIVPAGRLPRYKEVILLNDLIDCARPGEEIEVTGIYTNNFDLSLNTKNGFPVFATVIEANYVTKKQDLFSAYKLTQEDKEEIENLSKDPRIGERIIKSVAPSIYGHEDIKTAIALAMFGGQEKNVEGKHRLRGDINVLLLGDPGTAKSQFLKYVEKTGQRAVYTTGKGASAVGLTAAVHKDPVTREWTLEGGALVLADKGICLIDEFDKMNDQDRVSIHEAMEQQSISISKAGIVTSLQARCSVIAAANPIGGRYDSSKNFSQNVELTDPIVSRFDILCVVKDVVDPVIDEMLAKFVVDSHFKSQAKGAHLGDKPLGHSQEDAEAFAMTDDPEIIPQDMLKKYITFAKLNVFPRLHDADLDKLTQVYAELRRESSHGQGVPIAVRHIESMIRMSEAHARMHLRQHVTQEDVDMAIRVLLDSFISTQKFGVQKALQKSFKKYMTFKRDFNGIILHLLRQLVKDALHFEEIVSGSTTDLTHVDVKIEELQSKVQDYGITDLKAFFTSSEFTRANFELDEERRLIRHRLAR

SEQ ID NO: 9225 - protein, 954 aa, Sesamum indicum
MAREDDESRSGGDAAAANGNPPSVPDSPTSAGFNTDQLPFNTSQNYTDDDDEASVDPEIIRDEPEEENLNEEEEEGEDLFNDNFMNDYRRLGQQDQYESLGIDDSMEDERDLDQIMADRRAAEIELEAREARVSQRKLPQLLHDQDTDDDNYRPSKRTRADFRPPTTPRSMDDTDGMRSSPGGSQQGNSRDDIPMTDQTDDDPYDDEENDEGEFEMYRVQGTLREWVTRDEVRRFIAKKFKEFLLTYVNPKSDHGDFEYLRQINEMVSVNKCSLEIDYKQFIYIHPNIAIWLADAPQSVLEVMEEVANKIVFDLHPNYRKIHPKIYVRITNLPVYDQIRNIRQIHLNTMIRIGGVVTRRSGVFPQLQQVKYDCTKCGSILGPFFQNSYSEVKVGSCPECLSKGPFTVNIEQTIYRNYQKLTLQESPGIVPAGRLPRYKEVILLNDLIDCARPGEEIEVTGIYTNNFDLSLNTKNGFPVFATVIEANYVTKKHDLFSAYKLTQEDKEEIEKLAKDPRIGERIIKSIAPSIYDHEDIKTAIALAMFGGQEKNVEGKHRLRGDINVLLLGDPGTAKSQFLKYVEKTGQRAVYTTGKGASAVGLTAAVHKDPVTREWTLEGGALVLADRGICLIDEFDKMNDQDRVSIHEAMEQQSISISKAGIVTSLQARCSVIAAANPIGGRYDSSKTFAQNVELTDPIISRFDILCVVKDVVDPVTDEMLAQFVVDSHCKSQPKGANFDDRSMANSQDDVQASTRQTDPEIIPQELLKKYLTYAKLNVFPRLHDADLDKLTQVYAELRRESSHGQGVPIAVRHIESMIRMSEAHARMHLRQHVTQEDVDMAIRVLLDSFISTQKFGVQKALQKSFKKYMIFKKDFNGIVLHLLRRLVKDALHFEEMVSGSTVNLSHVDVKVEELQSKALDYGISDLKAFFNSTEFSSAHFELDEARGIIRHRLSH

SEQ ID NO: 9226 - protein, 861 aa, Ocimum basilicum
MGEQDQYERLGIDDSLEDDRDLDQIMADRRAAEIELDAKEARVSQRKLPQLLHDQDTDDESYRPSKRTRADFRPPATPDDTDGMASSPGRSQRGNSRDDVPMTDQTDDDPYDDEENDEDGYAMYRVQGTLREWVTRDEVRRFIGKKFKDFLLTYVKPKSENEDYEYIRQINEMVSVNKCSLEIDYKQFIFMHPNIAIWLADAPQSVLEVMEEVANKLVFDLYPNYKKIHQKIYVRITNLPVYDQIRNIRQIHLNTMIRIGGVVTRRSGVFPQLQQVKYDCNKCGAILGPFVQNSYSEVKVGSCPECQSKGPFTVNIEQTIYRNYQKLTLQESPGIVPAGRLPRYKEVILLNDLIDCARPGEEIEVTGIYTNNFDLSLNTKNGFPVFATVVEANYVAKKQDLFSAYKLTQEDKEEIEKLAKDPRIGERIIKSIAPSIYGHEDIKTAIALAMFGGQEKNVEGKHRLRGDINVLLLGDPGTAKSQFLKYVEKTGQRAVYTTGKGASAVGLTAAVHKDPVTREWTLEGGALVLADRGICLIDEFDKMNDQDRVSIHEAMEQQSISISKAGIVTSLQARCSVIAAANPIGGRYDSSKTFSQNVELTDPIVSRFDILCVVKDVVDPVIDEMLAQFVVDSHFKSQPKGANFDDRSVNNSQDDIQASAGQTDPEIIPQELLKKYLTYAKLNVFPRLHDADLDKLTQVYAELRRESSHGQGVPIAVRHIESMIRMSEAHARMHLRQHVIQEDVDMAIRVLLDSFISTQKFGMQKALQKSFKRYMIFKKDFNGIVLHLLRELVKDALQFEEIVSGSTANLSHVDVKVEELENKARDYGISDLKAFFNSREFRNAHFELDEERGMIRHPLAR

SEQ ID NO: 9227 - protein, 867 aa, Vinca minor
MEEHDQYESLGLDESMEDERDLDQIMADRRAAEVELDTREARVVPSSQRKLPQLFHDQDTDDDNYRPSKRTRADFRPQTAQRSFDDTDAMQSSPGRSQRGHSKEDVPMTDATDDDPYEDDDNEEGEFEMYRVQGTLREWVTRDEVRRFIAKKFKEFLFTYVNPKNEHGDFEYLRQINEMVSVNRCSLEIDYKQFIYIHPNIAIWLADAPHSVLEVMEDVANKVVFDLHPNYKQIHKKIYVRITNLPVYDQIRNIRQIHLNTMIRIGGVVTRRSGVFPQLQQVKYDCNKCGTILGPFFQNSYSEVKVGSCPECQSKGPFTVNIEQTIYRNYQKLTLQESPGIVPAGRLPRYKEVILLNDLIDCARPGEEIEVTGIYTNNFDLSLNTKNGFPVFATVIEANHVTKKQDLFSAYKLTQEDKEEIEKLAKDPRIGERIVKSIAPSIYGHEDIKTAIALAMFGGQEKNVQGKHRLRGDINVLLMGDPGTAKSQFLKYVEKTGQRAVYTTGKGASAVGLTAAVHKDPVTREWTLEGGALVLADRGICLIDEFDKMNDQDRVSIHEAMEQQSISISKAGIVTSLQARCSVIAAANPIGGRYDSSKTFSQNVELTDPIISRFDILCVVKDVVDPVTDEMLATFVVDSHFKSQPKGANLDDRSMINSEEDDQASAVPNDPEIISQELLKKYIIYAKLNVFPRLHDADLDKLTQVYAELRRESSHGQGIPIAVRHIESMIRMSEAHARMHLRQHVTQEDVDMAIRVLLDSFISTQKFGVQKALQKSFKKYMTFKKDFNAIVLHLLRGLVKDALYYEEILSGSTTNASHVDIKVEELQSKALDYGITDLKPFFTSTAFSRANFELDETRGVIRHRLTR

SEQ ID NO: 9228 - protein, 860 aa, Solanum phureja
MGEADQYESLGLDDSMVDERDLDQIMADRQAAEVELDNRDVHVSNRKLPQLLHDQDTDDDNYRPSKRTRADFRRNFDDTDAMPSSPGASQRVNSSQDVPMTDQTDDDPYEDDENDEGEFEMYRVQGTLREWVTRDEVRRFIAKKFKEFLLTYVNPKNEHGDFEYLRQINEMVSVNKCSLEIDYKQFIYVHPNIAIWLADAPQSVLEVMEEVANKVVFDLHPNYKQIHQKVYVRITNLPVYDQIRNIRQIHLNTMIRIGGVVTRRSGVFPQLQQVKYDCNKCGAVLGPFFQNSYSEVKVGSCPECQSKGPFSVNVEQTIYRNYQKLTLQESPGIVPAGRLPRYKEVILLNDLIDCARPGEEIEVTGIYTNNFDLSLNTKNGFPVFSTVIEANYVTKKQDLFSAYKLTQEDKEEIEKLAKDPRIGERIFKSIAPSIYGHEDIKTAIALAMFGGQEKNVEGKHRLRGDINILLLGDPGTAKSQFLKYVEKTGQRAVYTTGKGASAVGLTAAVHKDPVTREWTLEGGALVLADRGICLIDEFDKMNDQDRVSIHEAMEQQSISISKAGIVTSLQARCSVIAAANPIGGRYDSSKNFTQNVELTDPIISRFDVLCVVKDVVDPVTDEMLAKFVVDSHFRSQAKGATIDEKSFTDSRDDARATMAATDPEIIPQELLKKYLTYAKLNVFPKLHDADLDKLTQVYAELRRESSHGQGIPIAVRHIESMIRMSEAHARMHLRQHVTQEDVDMAIRVLLDSFISTQKFGVQKALQKSFKKYMTYKKDFNAIILHLLRGLVKDALQFEEIVSGSAANLDHIDVKVEELQSKALDYGMTDLKAFFSSNEFTKANFELYEDQGIIRHRLPAR

SEQ ID NO: 9229 - protein, 860 aa, Solanum lycopersicum
MGEADQYESLGLDDSMVDERDLDQIMADRQAAEVELDNRDVHVSNRKLPQLLHDQDTDDDNYRPSKRTRADFRRNFDDTDAMPSSPGASQRVNSSQDVPMTDQTDDDPYEDDENDEGEFEMYRVQGTLREWVTRDEVRRFIAKKFKEFLLTYVNPKNEHGDFEYLRQINEMVSVNKCSLEIDYKQFIYVHPNIAIWLADAPQSVLEVMEEVANKVVFDLHPNYKQIHQKVYVRITNLPVYDQIRNIRQIHLNTMIRIGGVVTRRSGVFPQLQQVKYDCNKCGAVLGPFFQNSYSEVKVGSCPECQSKGPFSVNVEQTIYRNYQKLTLQESPGIVPAGRLPRYKEVILLNDLIDCARPGEEIEVTGIYTNNFDLALNTKNGFPVFSTVIEANYVTKKQDLFSAYKLTQEDKEEIEKLAKDPRIGERIFKSIAPSIYGHEDIKTAIALAMFGGQEKNVEGKHRLRGDINILLLGDPGTAKSQFLKYVEKTGQRAVYTTGKGASAVGLTAAVHKDPVTREWTLEGGALVLADRGICLIDEFDKMNDQDRVSIHEAMEQQSISISKAGIVTSLQARCSVIAAANPIGGRYDSSKNFTQNVELTDPIISRFDVLCVVKDVVDPVTDEMLAKFVVDSHFRSQAKGATIDEKSFTDSRDDARATMAATDPEIIPQELLKKYLTYAKLNVFPKLHDADLDKLTQVYAELRRESSHGQGIPIAVRHIESMIRMSEAHARMHLRQHVTQEDVDMAIRVLLDSFISTQKFGVQKALQKSFKKYMTYKKDFNAIILHLLRGLVKDALQFEEIVSGSAANLDHIDVKVEELQSKALDYGMTDLKAFFSSNEFTKANFELYEDQGIIRHRLPAR

SEQ ID NO: 9230 - protein, 834 aa, Panax ginseng
MEEHDQYESVGLDESLEDERDLDQIMADRRAAEIELEARDAATAAPPTLSHRKLPHLLHDQDTDDDNYRPSKRTRADFKPPTMPRSFDDTDAMQSSPGRSQRGHSREDVHMTDQTDDEPYEDEDNDEAEFEMYRVQGTLREWVTRDEVRRFIGKKFKEFMLTYVNAKSEHRDFEYLRQINEMVSVNRCSLEIDYKQFIYIHPNIAIWLADAPQSVLEVMEEVANKVVFDLHPNYKQIHQKIYVRITNLPVYDQIRNIRQIHLNTMIRIGGVVTRRSGVFPQLQQVKYDCNKCGMILGPFFQNSYAEVKVGSCPECQSKGPFTINIEQTLYRNYQKLTLQESPGIVPAGRLPRYKEVILLNDLIDCARPGEEIEVTGIYTNNFDLSLNTKNGFPVFATVIEANYVTKKQDLFSAYKLTQEDKEEIEKLSKDPRIGERIIKSVAPSIYGHEDIKTAIALAMFGGQEKNVEGKHRLRGDINVLLLGDPGTAKSQFLKYVEKTGQRAVYTTGKGASAVGLTAAVHKDPVTREWTLEGGALVLADKGICLIDEFDKMNDQDRVSIHEAMEQQSISISKAGIVTSLQARCSVIAAANPIGGRYDSSKNFSQNVELTDPIVSRFDILCVVKDVVDPVTDEMLAKFVVDSHFKSQAKGANLDDKSLGHSQENIEATAMTADPEIIPQDLLKKYITYTKLNVFPRLHDADLDKLTQVYAELRRESSHGQGVPIAVRHIESMIRMSEAHARMHLRQHVTQEDVDMAIRVLLDSFISTQKFGVQKALQKSFKKYMTFKRDFNGIVLHLLRQLVKDALHFEEIVSGSTTGLAHVDVKVEELQSKVV

SEQ ID NO: 9231 - protein, 865 aa, Nicotiana benthamiana
MEEHDQYESLGLDDSMEDERDLDQIMADRRAAEVELDTRDVQVTNRKLPQLLHDQDTDDDNYRPSKRTRADFKPTNSQRNIDDTDAMPSSPGASQRVNSSQDVPMTDQTDDDAYEDDENDEGEFEMYRVQGTLREWVTRDEVRRFIAKKFKEFLLTYVNPKSEHGDFEYLRQINEMVSVNKCSLEIDYKQFIYVHPNIAIWLADAPQSVLEVMEEIANKVVFDLHPNYKQIHQKVYVRITNLPVYDQIRNIRQIHLNTMIRIGGVVTRRSGVFPQLQQVKYDCNKCGTILGPFFQNSYSEVKVGSCPECQSKGPFTVNVEQTIYRNYQKLTLQESPGIVPAGRLPRYKEVILLNDLIDCARPGEEIEVTGVYTNNFDLSLNTKNGFPVFATVIEANYVTKKQDLFSAYKLTQEDKEEIEKLAKDPRIGEWISKSIAPSIYGHEDIKTALALAMFGGQEKNVEGKHRLRGDINILLLGDPGTAKSQFLKYVEKTGQRAVYTTGKGASAVGLTAAVHKDPVTREWTLEGGALVLADRGICLIDEFDKMNDQDRVSIHEAMEQQSISISKAGIVTSLQARCSVIAAANPIGGRYDSSKTLTQNVELTDPIISRFDVLCVVKDVVDPVIDEMLAKFVVDSHFRSQAKGATLDEKSFTDSRDDARAAMAPTDPEIIPQELLKKYITYAKLNVFPKLHDGDLDKLTQVYAELRRESSHGQGVPIAVRHIESMIRMSEAHARMHLRQHVTQEDVDMAIRVLLDSFISTQKFGVQKALQKSFKKYMTYKKDFNAIILHLLRGLVNDAMQFEEIVSGSTANLDHIDIKVDELQSKALDYGITDLKAFFTSNDFSKANFELDEERGIIRHKRASS

SEQ ID NO: 9232 - protein, 865 aa, Nicotiana tabacum
MEEHDQYESLGLDDSMEDERDLDQIMADRRAAEVELDTRDVQVTNRKLPQLLHDQDTDDDNYRPSKRTRADFRPTNTQRNFDDTDAMPSSPGASQRVNSSQDVPMTDQTDDDAYEDDENDEGEFEMYRVQGTLREWVTRDEVRRFIAKKFKEFLLTYVNPKSEHGDFEYLRQINEMVSVNKCSLEIDYKQFIYVHPNIAIWLADAPQSVLEVMEEIANKVVFDLHPNYKQIHQKVYVRITNLPVYDQIRNIRQIHLNTMIRIGGVVTRRSGVFPQLQQVKYDCNKCGAILGPFFQNSYSEVKVGSCPECQSKGPFTVNVEQTIYRNYQKLTLQESPGIVPAGRLPRYKEVILLNDLIDCARPGEEIEVTGVYTNNFDLSLNTKNGFPVFATVIEANYVTKKQDLFSAYKLTQEDKEEIEKLAKDPRIGERISKSIAPSIYGHEDIKTALALAMFGGQEKNVEGKHRLRGDINILLLGDPGTAKSQFLKYVEKTGQRAVYTTGKGASAVGLTAAVHKDPVTREWTLEGGALVLADRGICLIDEFDKMNDQDRVSIHEAMEQQSISISKAGIVTSLQARCSVIAAANPIGGRYDSSKTLTQNVELTDPIISRFDVLCVVKDVVDPVIDEMLAKFVVDSHFRSQAKGATLDEKSFTDSRDDARGAMAPTDPEIIPQELLKKYITYAKLNVFPKLHDGDLDKLTQVYAELRRESSHGQGVPIAVRHIESMIRMSEAHARMHLRQHVTQEDVDMAIRVLLDSFISTQKFGVQKALQKSFKKYMTYKKDFNAIILHLLRGLVNDSMQFEEIVSGSTANLDHIDIKVDELQSKALDYGITDLKAFFTSNDFSKANFELDKERGIIRHKRASS

SEQ ID NO: 9233 - protein, 864 aa, Mimulus guttatus
MGEQDQYERVGLDDSAEDERDLDQIMADRRAAEVELDAREGRVSQRKLPQLLHDQDTDDDNYRPSKRTRADFRPPNTPRSTDDTDGIPSSPGRSQRGNSRDDVPMTDQTDDDPYDDDENDEGEFEMYRVQGTLREWVTRDEVRRFIGKKFKDFLLTYVNPKSENGDFEYLRQISEMVSVNKCSLEIDYKQFIYIHPNIAIWLADAPQSVLEVMEDVANKIVFQLHPNYNKISQKIYVRITNLPVYDQIRNIRQIHLNTMIRIGGVVTRRSGVFPQLQQVKYDCNKCGAILGPFFQNSYSEVKVGSCPECQSKGPFTVNVEQTVYRNYQKLTLQESPGIVPAGRLPRYKEVILLNDLIDCARPGEEIEVTGIYTNNFDLSLNTKNGFPVFATVIEANYVTKKQDLFSAYKLTQEDKEEIEKLAKDPRIGERIVKSIAPSIYGHEDIKTAIALAMFGGQEKNVEGKHRLRGDINVLLLGDPGTAKSQFLKYVEKTGQRAVYTTGKGASAVGLTAAVHKDPVTREWTLEGGALVLADRGICLIDEFDKMNDQDRVSIHEAMEQQSISISKAGIVTSLQARCSVIAAANPIGGRYDSSKTFLQNVELTDPIISRFDILCVVKDVVDPVIDEMLAQFVVDSHSKSQAKGGNFDDRNLNNSQDDGQASARQTDSEIIPQQLLKKYLTFAKLNVFPRLHDADLDKLTLVYAELRKESSHGQGIPIAVRHIESMIRMSEAHARMHLRQHVTQEDVDMAIRVLLDSFISTQKFGVQKALHKSFKRYMIFKKDFNAIVLHLLRGLVKDSMHFEDIVSGSTANLSYVDVKVEELQSKALDYGISDLKAFFNSSEFSSAHFELDEARGIIRHRLAH

SEQ ID NO: 9234 - protein, 857 aa, Prunus persica
MDEHDQYESLGLDDSVEDERDLDQIMADRRAAEIELDTRDGVQTTRKLPHLLHDQDTDDDSYRPSKRARADFRPPRSYDDNDGMQSSPGRSQCGNSREDVPMTDQTDDDGYEDDDDQEAEFEMYRVQGTLREWVTRDEVRRFIAKKFKEFLLTFVKKGSSDIEYVRLINEMVLANKCSLEIDYKQFIGTHPNIAIWLADAPQSVLEVMEDVAKNVVFSLHPNYKRIHQKIYVRITNLPVYDQIRNIRQIHLNTMIRIGGVVTRRSGVFPQLQQVKYDCNKCGAILGPFFQNSYSEVKVGSCPECQSKGPFSVNIEQTIYRNYQKLTLQESPGIVPAGRLPRYKEVILLNDLIDCARPGEEIEVTGIYSNNFDLSLNTKNGFPVFATVVEANYITKKQDLFSAYKLTQEDKDEIEKLSKDPRIGERIVKSIAPSIYGHEDIKTAIALAMFGGQEKNVEGKHRLRGDINVLLLGDPGTAKSQFLKYVEKTGQRAVYTTGKGASAVGLTAAVHKDPVTREWTLEGGALVLADKGICLIDEFDKMNDQDRVSIHEAMEQQSISISKAGIVTSLQARCSVIAAANPVGGRYDSSKTFSQNVELTDPIVSRFDILCVVKDVVDPVTDEMLAKFVVDSHFKSQAKGANMDNMPLSNSEEDTSDSPVDPEILSQDMLKKYLTYAKLNVFPRLHDADLEKLTLVYAELRRESSHGQGVPIAVRHIESMIRMSEAHARMHLRQHVIQEDVDMAIRVLLDSFISTQKFGVQKALQKSFRKYMTFKKDYNNVLLHLLRQLVKDAIHFEEIVSGSSSALTHIDVRVGDLQRMAQEHEIFDLKPFFTSALFSSAGFVLDEQQGLIRHHLPR

SEQ ID NO: 9235 - protein, 856 aa, Cannabis sativa
MDENDNYESVGLDDSLEDERDLDQIMADRKAAESELDARDVRLTSRKLPHLLHDQDTDDDSYRPSKRARADFRPPSDADGLQSSPGRSQRAHSREDLPTTDQTDDDPFEDDDDEDGEFEMYRVQGTLREWVTRDEVRRFIAKKFKEFLLTYVNPKNESTDYEYVRLINEMVSANKCSLEIDYKQFIYIHPNIAIWLADAPQSVLEVMEDVAKNVVFSLHPNYKNIHQKIYVRITNLPVYDQIRNIRQIHLNTMIRIGGVVTRRSGVFPQLQQVKYDCNKCGTILGPFFQNSYSEVKVGSCPECQSKGPFTINIEQTIYRNYQKLTLQESPGIVPAGRLPRYKEVILLNDLIDCARPGEEIEVTGIYTNNFDLSLNTKNGFPVFATVVEANYVTKKQDLFSAYKLTQEDKKEIEKLAKDPRIGERIVKSIAPSIYGHEDIKTALALAMFGGQEKNVEGKHRLRGDINVLLLGDPGTAKSQFLKYVEKTGQRAVYTTGKGASAVGLTAAVHKDPVTREWTLEGGALVLADRGLCLIDEFDKMNDQDRVSIHEAMEQQSISISKAGIVTSLQARCSVIAAANPVGGRYDSSKTFSQNVELTDPIISRFDILCVVKDVVDPIADEMLAKFVVDSHFKSQAKGAHIEDKTFSESQDDVQMSGEPADPEILSQDMLKKYITYAKLNVFPRLHDADMEKLTHVYAELRRESSNGQGVPIAVRHIESMIRMSEAHARMHLRQHVTEEDVDMSIRVLLDSFISTQKFGVQKALRKSFRKYMTFKKDFNEFLLYLLRELVKNALHFEEIVSGTTSGLTQIDVKVEDLQIKAQEHEIYDLKPFFTSTHFSRANFVLDEQRGVITHRL

SEQ ID NO: 9236 - protein, 962 aa, Capsicum annuum
MAGDDSNGDSPRRRPANSPSSSDHVNGNPPSTPDSPTSVGFNTDQLPYNTSQNYSEEDEASVDRDIIRDDPDDADVEEEEDGEDLFNDNYLDDYRVMGEADQYESFGLDDSMVDERDLDQIMADRQAAEVELDNRDNVHVSNRKLPELLQDQDTDDDNYRPSKRTRADFRRNFDDTDGMPSSPGASQRVNSSQDVPMTDQTDDDPYEDDENDEGEFEMYRVQGTLREWVTRDEVRRFIAKKFKEFLLTYVNPKSEHGDFEYLRQINEMVSVNKCSLEIDYKQFIYVHPNIAIWLADAPQSVLEVMEEVANKVVFDLHPNYKQIHQKVYVRITNLPVYDQIRNIRQIHLNTMIRIGGVVTRRSGVFPQLQQVKYDCNKCGAILGPFFQNSYSEVKVGSCPECQSKGPFSVNVEQTIYRNYQKLTLQESPGIVPAGRLPRYKEVILLNDLIDCARPGEEIEVTGVYTNNFDLSLNTKNGFPVFSTVIEANYVTKKQDLFSAYKLTQEDKEEIEKLAKDPRIAERIFKSIAPSIYGHEDIKTAIALAMFGGQEKNVEGKHRLRGDINILLLGDPGTAKSQFLKYVEKTGQRAVYTTGKGASAVGLTAAVHKDPVTREWTLEGGALVLADRGICLIDEFDKMNDQDRVSIHEAMEQQSISISKAGIVTSLQARCSVIAAANPIGGRYDSSKNFTQNVELTDPIISRFDVLCVVKDVVDPVTDEMLAKFVVDSHFRSQAKGATIDEKSFTDSRDDDRSAAAATDPEIIPQDLLKKYLTYAKLNVFPKLHDADLDKLTQVYAELRRESSHGQGIPIAVRHIESMIRMSEAHARMHLRQHVTQEDVDMAIRVLLDSFISTQKFGVQKALQKSFKKYMIYKKDFNAIILHLLRGLVKDALQFEKIISGATANLNYIEVKVDELQSKALDYGMTDLRAFFTSNEFASANFELDEVRSVIRHRLAPEMTAEV

SEQ ID NO: 9237 - protein, 859 aa, Cichorium intybus
GNLNSSQFNGNPPSTPDSPTSAGFNTDQLPFNSRTSENYSDYDDDEAAVDPNIIRDELEEGDEDEGEGEDLFNDNYIEDYRRMDEHDQYESAGLDDSHEDERDLDQIMADRRAAEIELDTRDGVASRRKVPHLLHDQDTDDDSYRPSKRTRAPPGPRGGDDTDAMQSSPGRPQRDNSDVHMTDATDDDQYEDDDNDEGEFEMYRVQGTLREWVTRDEVRRFIAKKFKDFLITYENPKSQNAEFPYLIQINEMVSANKCSLEIDYKQFIYVHPNIAIWLADAPQSVLEVMEEVANKVVFNIHSNYKNIHQKIYVRVTNLPVYDQIRNIRQIHLNTMIRIGGVVTRRSGVFPQLQQVKYDCNKCGAVLGPFIQNSYSEVRVGSCPECQSRGPFTVNIEQTIYRNYQKLTLQESPGIVPAGRLPRHKEVILLNDLIDCARPGEEIEVTGIYTNNFDLSLNTKNGFPVFATIIEANHVTKKQDLFSAYKLTDEDKKEIEKLSKDPRIGERIVKSIAPSIYGHEDIKTAIALAMFGGQEKNVEGKHRLRGDINVLLLGDPGTAKSQFLKYVEKTGQRAVYTTGKGASAVGLTAAVHKDPVTREWTLEGGALVLADKGICLIDEFDKMNDQDRVSIHEAMEQQSISISKAGIVTSLQARCSVIAAANPIGGRYDSSKNFSQNVELTDPIVSRFDVLCVVKDVVDPVMDEMLAQFVVDSHFKSQPKGANLDDKSMNNSQEDIQASAMMMDPEILPQDMLKKYITYAKLHVFPRLHDADLDKLTQVYAELRRESSHGQGVPIAVRHIESMIRMSEAHARMHLRQHVTQEDVDMAIRVLLDSFISTQKFGVQKALQKSFKKYMTFKRD

SEQ ID NO: 9238 - protein, 170 aa, Ambrosia trifida
MQTLQQKATEWSGVKQEDAFAIDEVNLFEKLGLQAFINLSTDFYTRVYDDQEEWFRSIFADSKKEDAIQNQYEFFVQRMGGPPLYSQRKGHPALIGRHRPFPVTHKAAERWLHHMQQALDNAADIDHESKTRMLNFFRHTAYFLVAGNDLKNESQGPPPCKHGDSKPVAD

SEQ ID NO: 9239 - protein, 170 aa, Echinacea purpurea
MQTLQQKASEWSGVKQEDAFAIDEVNLFQKLGLQTFINLSTDFYTRVYEDEEEWFRSIFADSKKEDAIQNQYEFFVQRMGGPPLYSQRKGHPALIGRHRPFPVTHKAAERWLHHMQQALDNTTDIDHDSKTRMLNFFRHTAYFLVAGNDLKNESKGAPPCKHGENKPAAD

SEQ ID NO: 9240 - protein, 170 aa, Flaveria ramosissima
MQTLQQKASEWSGVKQEDAFAIDEVNLFEKLGLQTFIDLSTDFYTRVYDDQEEWFRSIFADSKKEDAIQNQYEFFVQRMGGPPLYSQRKGHPALIGRHRPFPVTHKAAERWLHHMQQALDNTTDIDHDSKTRMLNFFRHTAYFLVAGNDLKNESQGTPPSKQGDNKPAAV

SEQ ID NO: 9241 - protein, 170 aa, Flaveria ramosissima
MQTLQQKASEWSGVKQEDAFAIDEVNLYEKLGLQTFIDLSTDFYTRVYDDQEEWFRSIFADSKKEDAIQNQYEFFVQRMGGPPLYSQRKGHPALIGRHRPFPVTHKAAERWLHHMQQALDNTTDIDHDSKTRMLNFFRHTAYFLVAGNDLKNESQGTPPSKQGDNKPAAV

SEQ ID NO: 9242 - protein, 171 aa, Cirsium arvense
MQTLQQKASEWSGVDQQDAFAIDEINLFEKLGLQTFIDLSTDFYTRVYDDEEEWFRSIFANSKKEDAIQNQYEFFVQRMGGPPLYSQRKGHPALIGRHRPFPVTHKAAERWLHHMQQALDNTTEIDQDSKTRMLNFFRHTAYFLVAGNDLKNQSQGAPPPCKHGANKPAAV

SEQ ID NO: 9243 - protein, 170 aa, Carthamus tinctorius
MQTLQQKASEWSGVDQKDAFAIDDINLFQKLGLQTFIDLSTDFYTRVYDDEEEWFRSIFANSKKEDAIQNQYEFFVQRMGGPPLYSQRKGHPALIGRHRPFPVTHKAAERWLHHMQQALDNTTDIDQDSKTRMLNFFRHTAYFLVAGNDLKNQSEGTPPCKHGANKPAAV

SEQ ID NO: 9244 - protein, 170 aa, Cichorium intybus
MQTLQQKASEWSGVDQEDAFAIDEVNLYEKLGLQTFINLSTDFYTRVYDDEEEWFRSIFTNSKKEDAIQNQYEFFVQRMGGPPMYSQRKGHPALIGRHRPFPVTHRAAERWLHHMQQALDNTTDIDHDSKTRMLNFFRHTAYFLVAGNDLKNQSQGAPPCKHGTNKPAAE

SEQ ID NO: 9245 - protein, 170 aa, Cichorium intybus
MQTLQQKASEWSGVDQEDAFAIDEVNLYEKLGLQTFINLSTDFYTRVYDDEEEWFRSIFTNSKKEDAIQNQYEFFVQRMGGPPMYSQRKGHPALIGRHRPFPVTHRAAERWLHHMQQALDNTTDIDLDSKTRMLNFFRHTAYFLVAGNDLKNQSQGAPPCKHGTNKPAAG

SEQ ID NO: 9246 - protein, 86 aa, Flaveria ramosissima
MGGPPLYSQRKGHPALIGRHRPFPVTHKAAERWLHHMQQALDNTTDIDHDSKTRMLNFFRHTAYFLVAGNDLKNESQELHLLSMEI

SEQ ID NO: 9247 - protein, 170 aa, Lactuca sativa
MQSLQQKASEWSGVDQEDAFSIDEVNLFEKLGLQTFINLSTDFYTRVYDDEEEWFRSIFADSKKEDAIQNQYEFFVQRMGGPPLYSQRKGHPALIGRHRPFPVTHKAAERWLHHMQQALDNTTDIDHDSKTRMLNFFRHTAYFLVAGNDLKSQSQGAPPCKNGTNKQAAE

SEQ ID NO: 9248 - protein, 507 aa, Centaurea maculosa
MQTSSISLNPSISLPTSTSSSSTSIVTTSRISCFYAFKPKPICFTPSKTRLFRYERRARTPIVVSSGEQVKIEELSRDDDKDEDEEGPPSQVESEVTTKPRRIALFVEPSPFAYVSGYKNRFQNFIKYLREMGDEVMVVTTHEGVPQEFHGAKLVGSRSFPCPWYQNVPLSLALSPRIINEVKQFKPDIIHVTSPGIMVFGALAIAKMLCVPIVMSYHTHVPVYIPRYTFSWLVTPMWLVLKFLHRAADLTLVPSAAIAKDLRQARVTAANKIRLWNKGVDSDSFNPVFRSQEMRVRLTNGEPDRPLVVHVGRLGVEKSLDFLKGVMEKIPEARIAFIGDGPHREDLEKLFVGMPAVFTGMLQGEELSQAYASGDVFVMPSESETLGFVVLEAMSSGLPVVAARAGGIPDIIPEEQEGKTGYLYTPGDLDDCLNKLVPLLHDAKLRESIGQAARVEVEKFDWRAATKMIRNQQYNAAIWFWRKKRAQLLKPVQWVAKTFSRFNDNGN

SEQ ID NO: 9249 - protein, 170 aa, Cirsium arvense
MQTLQQKASEWSGVDQKDAFAIDDINLFQKLGLQTFIDLSTDFYTRVYDDEEEWFRSIFANSTKEDAIQNQYEFFVQRMGGPPLYSQRKGHPALIGRHRPFPVTHKAAERWLHHMQQALDNTTDIDQDSKTRMLNFFRHTAYFLVAGNDLKNQSEGAPPCKHAANKPAAV

SEQ ID NO: 9250 - protein, 170 aa, Artemisia annua
MQTLQEKASEWSGVDHEDAFAIDQTNLYQKLGLQTFINLSTDFYTRVYEDEEEWFRSIFADSKKEDAIQNQYEFFVQRMGGPPLFSQRRGHPALIGRHRPFDVTHKAAERWLHHMQQALDNATDIDQDSKTRMLNFFRHTAYFLVAGNDLKNQSQGAPPCKHAANKTAPE

SEQ ID NO: 9251 - protein, 170 aa, Chrysanthemum coronarium
MQTLQEKAAEWSGVDHEDAFAIDQTNLYQKLGLQTFINLSTDFYTRVYEDEEEWFRSIFADSKKEDAIQNQYEFFVQRMGGPPLFSQRRGHPALIGRHRPFEVTHKAAERWLHHMQQALDNATDIDQDSKTRMLNFFRHTAYFLVAGNDLKNQSQGAPPCKHAANKAAPE

SEQ ID NO: 9252 - protein, 148 aa, Flaveria ramosissima
MQTLQQKASEWSGVKQEDAFAIDEVNLYEKLGLQTFIDLSTDFYTRVYDDQEEWFRSIFADSKKEDAIQNQYEFFVQRMGGPPLYSQRKGHPALIGRHRPFPVTHKAAERWLQHMQQALDNTTDIDHDSKTRMLNFLQAYCITFGGWK

SEQ ID NO: 9253 - protein, 161 aa, Cirsium arvense
EWSGVDQKDAFAIDDINLFQKLGLQTFIDLSTDFYTRVYDDEEEWFRSIFANSTKEDAIQNQYEFFVQRMGGPPLYSQRKGHPALIGRHRPFPVTHKAAERWLHHMQQALDNTTDIDQDSKTRMLNFFRHTAYFLVAGNDLKNQSEGAPPCKHGANKPAAV

SEQ ID NO: 9254 - protein, 163 aa, Taraxacum officinale
MQTLQQKASEWSGVDREDAFAIDEVNLFEKLGLQTFINLSTDFYTRVYDDEEEWFTSIFANSKKEDAIQNQYEFFVQRMGGPPMYPQRKGHPALIGRHRPFPVTHRAAERWLHHMQQALDNTTDIDTDSKTRMLNFFRHTAYFLVAGNDLKGQSQEANKPTAE

SEQ ID NO: 9255 - protein, 169 aa, Daucus carota
MQSLQQKASGWSGVATEDAFGIDETNLFQKLGLQPFINLSTDFYTRVYDDEEEWFRSIFANSKKEDAIQNQYEFFVQRMGGPPLYSQRKGHPALIGRHRPFPVTHRAAERWLHHMQQALDNSTDIDAQSKIKMMNFFRHTAFFLVAGDELKNSNHGVSPKPGASKPAAA

SEQ ID NO: 9256 - protein, 169 aa, Petroselinum crispum
MQSLQQKASEWSGVATEDAFGIDATNLFQKLGLQPFINLSTHFYTRVYDDEEEWFRSIFANSKKEDAIQNQYEFFVQRMGGPPLYSQRKGHPALIGRHRPFPVTHRAAERWLYHMQQALDNSTDIDAESKVKMMNFFRHTAFFLVAGDELKNPYHGVSPKPGASKPATA

SEQ ID NO: 9257 - protein, 152 aa, Bupleurum chinense
MHSQLMKPIFLRRLGSNLFINLSTDFYTRVYDDEEEWFRSIFANSKKEDAIQNQYEFFVQRMGGPPLYSQRKGHPALIGRHRPFPVTHRAAERWLHHMYQALNNSTDIDAPSKIKMMNFFRHTAFFLVAGDELKNPNQGVSPKPGSNRPAEV

SEQ ID NO: 9258 - protein, 173 aa, Cynara scolymus
CISICRPCTEGVEWSRVDQQDAFAIDEINLFDKLGLQTFIDLSTDFYTRVYDDEEEWFRSIFANSKKEDAIQNPYEFFVQRMGGPPLYSHRKGHPALIGRHRPFPVTHEAAERWLLHIQQALDNTTDIDQDSKTRMLNFFRHTAYFLVAGNDLKNQSQGAPPCKHGANKPAAV

SEQ ID NO: 9259 - protein, 169 aa, Vitis vinifera
MQSLQEKASEWSGVSQNDAFEIDNTNLFQKLGLQTFINLSTNFYTRVYDDEEEWFRLIFANSKKEEAIQNQYEFFVQRMGGPPLYSQRKGHPALIGRHRPFPVTHQAAERWLHHMQQALDSVTEIDADSKTKMMNFFRHTAFFLVAGDELKNRNQGVPCKHGASKPAAV

SEQ ID NO: 9260 - protein, 164 aa, Panax ginseng
MQSLQQKASEWSGVATDDAFAIDKTNLFQKLGLQAFINLSTNFYTRVYDDDEEWFRSIFANSKKEDAIQNQYEFFVQRMGGPPLYSQRKGHPALIGRHRPFPVTHRAAERWLHHMQQALDDGTDIDADSKTKMMHFFRHTAYFLVAGDELKNPNQGVPPKPGAS

SEQ ID NO: 9261 - protein, 168 aa, Tabernaemontana elegans
MQSLQQKASEWSGVSNDDAFAIDDENLYEKLGLQTFINLSTNFYTRVYDDEEEWFRSIFANSKKEDAIQNQYEFFVQRMGGPPLYSRRKGHPALIGRHRPFPVTHRAAERWLHHMQQALDSSTDIDLASKTKMMNFFKHTAFFLVAGDELKNQNQGVPCKHAASKPAT

SEQ ID NO: 9262 - protein, 170 aa, Chelidonium majus
MQSLQEKASEWSGVKSSDAFAIDETNLFQKLGLQTFINLSTNFYTRVYDDEEEWFRSIFADSKKEDAIQNQYEFFVQRMGGPPLYSQRKGHPALIGRHRPFPVTHQAAERWLHHMQLAVDSVPEIDSDSKIKMMNFFRHTAFFLVAGDELKNQNQQGPPCKHAATKPTAV

SEQ ID NO: 9263 - protein, 260 aa, Helianthus annuus
MAKIRAFFILALLLLSSSFFLQVARSQSDPDSEADAELVAETVEEGSHVGDDVEDIGIGNYNPAPGVETVAVFPKNFAKLVVAGQETELLIGLKNEGEQNVKVFAVHASIHLPFDHRMLVQNLSTVAFNDASVPASVQATFPYTFAVSKFLQPGTFDLVGTIVYEIDQLPYQNVFYNGTIEVTEAGGLVSVETVFLVSLGLALLVLFGLWVRTQLQSLSKKTKKITKVEVGTRTVDASMDEWLQGTAYTQSQSNKLKKKK

SEQ ID NO: 9264 - protein, 261 aa, Helianthus annuus
MAKIRVFSILALLLLLSSSFFLQVARSQSDPDSEADAELVAETVEEGSHVGDDVEDIGVGNYKPAPGVETVSVFPKNFAKLVVAGQETELLIGLKNEGEQNVKVFAVHASIHLPFDHRMLVQNLSTVAFNDASVPASVQATFPYTFAVSKFLQPGTFDLVGTIVYEIDQLPYQNVFYNGTIEVTEAGGLVSVETVFLVSLGLALLVLFGLWVRTQLQSLSKKTKKITKVEVGTRTVDASMDEWLQGTAYTQSQSNKLKKKK

SEQ ID NO: 9265 - protein, 240 aa, Helianthus annuus
LQVARSQSDPDAEADAELVAETVEEGSHVGDDVEDIGIGNYKPAPGVETVSVFPKNFAKLVVAGQETELLIGLKNEGEQNVKVFAVHASIHLPFDHRMLVQNLSTVAFNDASVPASVQATFPYTFAVSKFLQPGTFDLVGTIVYEIDQLPYQNVFYNGTIEVTEAGGLVSVETVFLVSLGLALLVLFGLWVRTQLQSLSKKTKKITKVEVGTRTVDASMDEWLQGTAYTQSQSNKLKKKK

SEQ ID NO: 9266 - protein, 261 aa, Lactuca sativa
MTKIRVSFILALILLLSSSFFIQVARSQSDSDSDSDSNADLVAETVAEGAVSDETQDFGVGNFSPSPDVETVCVFPKNSAKLVVAGQETELLIGMKNEGEQNVKVLAVYSSVHLPFDHKMLVQNLTTQTFNNASVPSSVQATFPYMFAVSKFLQPGTFDLVGTIVYEIGEVPYQNTFYNGTIEVTEAGGLVSVETVFLVSLGFALLVLLGLWVRGQLQNLSKKTKRVKVEVGTKTVDASMDEWLQGTAYTQSQSFKLKKKK

SEQ ID NO: 9267 - protein, 170 aa, Flaveria ramosissima
MSLVTEEIKASASEVYHGDAICQEKSKFLLTEMGLPNGLLPLEDIEECGYVKDTGFVWLKQKKSKVHKFEKIGKLVSYATEVTAVIEKFKIKKLTGVKSKELLMWITLSEISVDDPPTGKITFTATSGLYRTFPVSAFQIEDVKKDVGGEEVKKDVAQVDVAKEAQVKEV

SEQ ID NO: 9268 - protein, 758 aa, Helianthus annuus
MASASKTTSHSSDHHSLPIASASADVIVVDDWSNDDRPLPINSPVINSSDPSSTASTKGIQVLTRAQSSHPLDPLSAAEIKVAVATVRAAGATPEVRDGMRFVEVVLSEPDKSVVALADAYFFPPFQSSLLPRSKGGAVIPTKLPPRRARLVVYNKKSNETSVWIVELSEVHAATRGGHHRGKVISSQVIPDVQPPMDAVEYAECEAVVKDYPPFREAMKKRGIDDMDLVMVDAWCVGYHSKADAPSRRLAKPLIFCRTESDSPMENGYARPVEGIYVLVDMQNMAVLEFEDRKLVPLPPADPLRNYTPGHTRGGVDRSDVKPLHILQPDGPSFRVNGHYVEWQKWNFRIGFTPREGLVIHSVAYVDGNRGRRPIAHRLSFVEMVVPYGDPNDPHYRKNAFDAGEDGLGKNAHSLKKGCDCLGYIKYFDAHFTNFIGGVETIENCVCMHEEDHGILWKHQDWRTGLAEVRRSRRLTVSFICTVANYEYGFYWHFYQDGKIEAEVKLTGILSLGALQPGEVRKYGTTIAPGLYAPVHQHFFVSRMDMAVDCKPGEAYNQVVEVDVKVEEPGNNNVHNNAFYTQETLLKSESQAMRDCNPLSARHWIVRNTRTVNRTGQLTGYKLVPGSNCLPLAGSEAKFLRRAAFLKHNLWVTPYAAGEEFPGGEFPNQNPRVGEGLASWVQKNRSLEETDIVLWYVFGITHVPRLEDWPVMPVERIGFMLQPHGFFNCSPAVDVPPGACESDVKDTKAVSNGLLAKL

SEQ ID NO: 9269 - protein, 730 aa, Lactuca sativa
MASTSQKASHSTDDSLPIHRQAVSADVVVVENWHNNDQKTPIKNTSIATLINTTDPSASSKGIQILTRAQTSHPLDPLSAAEIKVAVATVRAAGATPEVRDGMRFVEVVLSEPDKSVVALADAYFFPPFQPSLLPRSKGGAVIPSKLPPRRARLVVYNKKSNETSIWIVELSEVHATTRGGHHRGKVVSSRTIQDVQPPMDAVEYAECEAVVKEYFPFQEAMKKRGIEDMDLVMVDAWCVGYHSEADAPSRRLAKPLIFCRTESDSPMENGYARPVEGIYILVDMQNMVVIDFEDRKLVPLPPADPLRNYTPAHTRGGVDRSDVKPLQILQPDGPSFRVNGQYVEWQKWNFRIGFTPREGLVIHSVAYVDGSRGRRPIAHRLSFVEMVVPYGDPNDPHYRKNAFDAGEDGLGKNAHSLKKGCDCLGYIKYFDAHFTNFTGGVETIENCVCMHEEDHGILWKHQDWRTGLAEVRRSRRLTVSFICTVANYEYGFYWHFYQDGKIEAEVKLTGILSLGALQPGEVRKYGTTIAPGLYAPVHQHFFVARMDMAVDCKPGEAYNQVVEVNVKVEESGKDNVHNNAFYTEETLLKTENEAMRDCNQLSARHWIIRNTRTVNRTGQLTGYKLVPGSNCLPLAGSEAKFLRRAEFLKHNLWVTPYALDENFPGGEFPNQNPRVGEGLASWVKQNRSLEETDIVLWYVFGITHVPRLEDWPVMPVEHIGFMLQVIIYL

SEQ ID NO: 9270 - protein, 756 aa, Chrysanthemum coronarium
MASASKTTSHSTNASDLVVVVDDRNPVAVTNSAVVADPSANANSTKGIQVLTRAQSSHPLDPLSAAEIKVAVATVRAAGATPEVRDGMRFVEVVLSEPDKNVVALADAYFFPPFQPSLLPRSKGGALIPIKLPARRARLVVYNKKSNETSVWIVELSEVHAATRGGHHRGKVISSRVVPDVQPPMDAVEYAECEAVVKDHPPFIEAMKKRGIEDMDLVMVDAWCVGYHSDADAPSRRLAKPLIFCRTESDSPMENGYARPVEGIYVLVDMQNMVVLEFEDRKLVPLPPADPLRNYTPGHTRGGVDRSDVKALQILQPDGPSFRVNGNYVEWQKWNFRIGFTPREGLVIHSIAYVDGSRGRRPIAHRLSFVEMVVPYGDPNEPHYRKNAFDAGEDGLGKNAHSLKKGCDCLGYIKYFDAHFTNFIGGVETIENCVCMHEEDHGMLWKHQDWRTGLAEVRRSRRLTVSFVCTVANYEYGFYWHFYQDGKIEAEVKLTGILSLGALQPGEVRKYGTTIAPGLYAPVHQHFFVARMDMAVDCKPGEAHNQVVEVNVEVEEPGKDNVHNNAFYTQETLLKSESQAMRDCNQLSARHWIVQNTRNVNRTGQLTGYKLVPGSNCLPLAGSEAKFLRRAAFLKHNLWVTQYASGEDFPGGEFPNQNPRVGEGLASWVQQNRSLEETDIVLWYVFGITHVPRLEDWPVMPVERIGFMLQPHGFFNSSPAVDVPPGACESDAKDCHVKDKDTIVPKSVSNGLMAKL

SEQ ID NO: 9271 - protein, 771 aa, Helianthus annuus
MASASQKTSHSSVDSVTIRRQIAPAAASAATAVVGDWNNDDRPLPIKNSVINPPDPSANASSKGIQVLTRAQTSHPLDPLSAAEIKVAVATVRAAGATPEVRDGMRFVEVVLLEPEKNVVALADAYFFPPFQPSLLPRSKGGVVIPTKLPPRRARLVVYNKKSNETSVWIVELSQVHAATRGGHHRGKVISSRVVLDVQPPMDAVEYAECEAVVKDYPPFREAMKKRGIDDMDLVMVDAWCVGYHSKADAPSRRLAKPLIFCRTESDSPMENGYARPVEGIRVLVDMQNMVVLEFEDHKLVPLPPADPLRNYTPGHTRGGVDRSDVKPLQILQPDGPSFRVNGHYVEWQKWNFRIGFTPREGLVLHSVAYVDGNRGRRSIAHRLSFVEMVVPYGDPNDPHYRKNAFDAGEDGLGKNAHSLKKGCDCLGYIKYFDAHFTNFIGGVETIENCVCMHEEDHGILWKHQDWRTGLAEVRRSRRLTVSFICTVANYEYGFYWHFYQDGKIEAEVKLTGILSLGALQPGEVRKYGTTIAPGLYAPVHQHFFVARMDMAVDCKPGETCNQVVEVDVKVEEPGKDNVHNNAFYTQETLLKSESHAMRDCNPLSARHWIVRHTRTVNRTGQLTGYKLVPGSNCLPLAGSEAKFLRRAAFLKHNLWVTPYAPGEDFPGGEFPNQNPRVGEGLASWVQKDRSLEETDIVLWYVFGITHVPRLEDWPVMPVERIGFMLQPHGFFNCSPAVDVPPGACESDVKESHVKDTVGPKPVPNGLIAKL

SEQ ID NO: 9272 - protein, 769 aa, Daucus carota
MASIKKTPSFSSSDDSPVVSRRAEVAPEWIVSSSDDRPIKASAIASLIRPDSSASSTASTKGIQIMLRAQSSHPLDPLSSAEISVAVATVRAAGATPEVRDGMRFVEVVLSEPSKNIVALADAYFFPPFQPSLLPRTKGGAVIPSKLPPRRARLVVYNKKSNETSIWIVELSEVHAATRGGHHRGKVISSQVVPDVQPPMDAMEYAECEAVVKEYPPFREAMKKRGIEDMDLVMVDAWCVGYYSDTDAPNRRLAKPLIFCRTESDCPMENGYARPVEGIYLLVDMQNMVVIEFEDRKLVPLPPADPLRNYTPGETRGGVDRSDVKPLQIVQPEGPSFRVSGHYVEWQKWNFRIGFTPREGLVIHSIAYVDGSRGRRPIAHRLSFVEMVVPYGDPNDPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFYWHFYQDGKIEAEVKLTGILSLGALQPGESRKYGTTIAPGLYAPVHQHFFIARMDMAVDCKPGEAYNQVVEVDVKVEEPGNDNVHNNAFYTEETLLKSELQAMRDCNFPAARHWIVRNTRTVNRTGQLTGYKLVPGSNCLPLAGPEAKFLRRASFLKHNLWVTPYAQDENFPGGEFPNQNPRVGEGLASWVKQDRSLEETNIVLWYVFGITHVPRLEDWPVMPVERIGFMLQPHGFFNCSPAVDVPPNACELDVKDGDPKESGDTKSVSDGLMAKL

SEQ ID NO: 9273 - protein, 762 aa, Petroselinum crispum
MATASKTTTLLPCHDSSSSSRKASSELADDHSVSPAAIASLIRTDSSSNVSSTKGIPIMLRAQSSHPLDPLSAAEISVAVATVRAAGATPEVRDGMRFVEVVLSEPDKNVVALADAYFFPPFQPSLLPRTKGGAVIPSKLPARRARLVVYNKKSNETSVWIVELSEVHAATRGGHHRGKVISSQVVRDVQPPMDAVEYAECEAVVKEYPPFREAMKKRGIEDMDLVMVDAWCVGYHSNADAPSRRLAKPLIFCRTESDCPMENGYARPVEGIYALVDMQNMVVIEFEDRKLVPLPPADPLRNYTPGETRGGVDRSDVKPLQIVQPEGPSFRVSGHYIEWQKWNFRIGFTPREGLVIHSIAYVDGSRGRRPIAHRLSFVEMVVPYGDPNDPHYRKNAFDAGEDGLGKNAHSLKKGCDCLGYIKYFDAHFTNFTGGVDTIENCVCLHEEDHGILWKHQDWRTGLAEVRRSRRLTVSFICTVANYEYGFYWHFYQDGKIEAEVKLTGVLSLGALQPGEVRKYGTTIAPGLYAPVHQHFFVARMDMAVDCKPGEAFNQVVEVDVKVEEAGKDNVHNNAFYTEETVLKSELQAMRDCNFSSARHWIVRNTRTVNRTGQLTGYKLVPGSNCLPLAGPEAKFLRRAAFLKHNLWVTPYTRDEDFPGGEFPNQNPRAGEGLASWVKQNRSLEETNIVLWYVFGITHVPRLEDWPVMPVERIGFMLQPHGFFNCSPAIDVPPNPCQLEAKDSDTKDNGQAKPSPSGLIAKL

SEQ ID NO: 9274 - protein, 768 aa, Daucus carota
MAAAKKTTTFPSCHDSSSSSSSPSISRRASSELVDDHSISPAAIASLIRTDSVSSSASAKGIPIMLRAQSSHPLDPLSAAEISVAVATVRAAGATPEVRDGMRFVEVVLSEPDKNVVALADAYFFPPFQPSLLPRTKGGAVIPSKLPARRARLVVYNKKSNETSVWIVELSEVHAATRGGHHRGKVISSQVVKDVQPPMDAVEYAECEAVVKEYPPFREAMKKRGIEDMDLVMVDAWCVGYHSDADAPSRRLAKPLIFCRTESDCPMENGYARPVEGIYALVDMQNMVVIEFEDRKLVPLPPADPLRNYTPGETRGGVDRSDVKPLQIVQPEGPSFRVSGHYIEWQKWNFRIGFTPREGLVIHSIAYVDGSRGRRPIAHRLSFVEMVVPYGDPNDPHYRKNAFDAGEDGLGKNAHSLKKGCDCLGYIKYFDAHFTNFTGGVDTIENCVCLHEEDHGILWKHQDWRTGLAEVRRSRRLTVSFICTVANYEYGFYWHFYQDGKIEAEVKLTGVLSLGALQPGEVRKYGTTIAPGLYAPVHQHFFVARMDMAVDCKPGEAFNQVVEVDVKVEEAGKDNVHNNAFYTEETVLKSELQAMRDCNFSSARHWIVRNTRTVNRTGQLTGYKLVPGSNCLPLAGSEAKFLRRAAFLKHNLWVTPYTRDEDFPGGEFPNQNPRAGEGLASWVKQNRSLEETNIVLWYVFGITHVPRLEDWPVMPVERIGFMLQPHGFFNCSPAIDVPPNPCQLEAKDSDTKDNGQAKPSPSGLIAKL

SEQ ID NO: 9275 - protein, 785 aa, Valeriana officinalis
MATTSQKTTHSCHASSQSPPVPRQASSLMSPPTGDAPEVVQNWPKLSNERLSDDRPIKKSPMPTLIHPDSSTTASTKGLPIMLRAQSSHPLDPLSAAEISVAVATVRAAGATPEVRDGMRFVEVVLLEPDKNVIALADAYFFPPFQPSLLPRVKGGAVIPSKLPPRRARLVVYNKKSNETSIWIVELSEVHAATRGGHHRGKVISSKIIHDVQPPMDAVEYAECEAVVKDHPPFIEAMKKRGIEDMDLVMVDAWCVGYYSEADAPSRRLAKPLIFCRTESDCPMENGYARPVEGIYVLVDMQNMVILEFEDRKLVPLPPADPLRNYTPGETRGGVDRSDVKPLQIVQPEGPSFRVNGHYVEWQKWNFRIGFTPREGLVIHSVAYVDGSRGRRQIAQRLSFVEMVVPYGDPNEPHYRKNAFDAGEDGLGKNAHSLKKGCDCLGYIKYFDAHFTNFTGGVDTFENVVCLHEEDHGMLWKHQDWRTGLAEVRRSRRLTVSFICTVANYEYGFYWHFYQDGKIEAEVKLTGVLSLGALQPGESRIYGTTIAPGLYAPVHQHFFVARMDMAVDCKPGEPYNQVVEVNVKVEEPGQNNVHNNAFYTEETLLKSELQASRDFNPFSARHWIVRNTRTVNRTGQLTGYKLVPGSNCLPLAGPEAKFLRRAAFLKHNLWVTPYAQDETFPGGEFPNQNPRAGEGLASWVKQDRSLEETDIVLWYVFGITHVPRLEDWPVMPVEHIGFMLQPHGFFNCSPAVDVPPGTCESDVKDGDVKDSGVAKPIPNGLLSKL

SEQ ID NO: 9276 - protein, 769 aa, Amaranthus tuberculatus
MATTSQKATSPCCDSTEIGKSSIVSDPNSSAIGDRVSDERSSNLIRNVEVLPESQTAGAAVIAKGIPIPLRAQSSHPLDPLSATEIKVAVATVRAAGATPEERDAMRFIEVVLLEPEKRVIAMADAYFFPPFQPSLLPRTKGKAVIPSKLPPRQARLVVYSKKSNETSVWIVELTEVHATTRGGHHRGKVISSKVVPDVQPPMDAVEYAECEAVVKDYPPFREAMKKRGIDDMELVMVDAWCVGYHSEADAPSRRLAKPLIFCRNESDCPMENGYARPVEGIYVLVDMQNMVVVEFEDRKFVPLPPADPLRNYTPGETRGGVDRSDVKPLLILQPEGPSFRVNGHFVEWQKWSFRVGFTPREGLVIHSVAYVDGSRGRRAVAQRLSFVEMVVPYGDPNEPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFYWHFYQDGKIEAEVKLTGILSVGALQPGEVRKYGTTIAPGLYAPVHQHFFVARMDMAVDCKPGEALNQVVELNVKVEEPGKSNVHNNAFYAEEKVLKSESQAMRDCNPLTARHWIVRNTRTVNRTGQLTGYKLMPGSNCLPLAGPEAKFLRRATFLKHNLWVTPYARDEMFPGGEFPNQNPRAGEGLATWVKQNRPLEEADIVLWYVFGLTHIPRLEDWPVMPVEHLGFMLMPHGFFNCSPAVDVPPNTHESDVKENNGVVAKPVQNGLIAKL

SEQ ID NO: 9277 - protein, 774 aa, Vitis vinifera
MAAATEKATTCCIEDAKPAPVRKASNVLQDWSVAGSAPSEDQISKRATVATLIRSVDSLPQPAANPTATKGIPIMLRAQTSHPLDPLSAAEISVAVATVRAAGATPEVRDSMRFVEVVLVEPEKHVVALADAYFFPPFQPSLLPRTKGGPVIPSKLPPRQARLVVYNKRSNETSIWIVELSEVHAATRGGHHRGKVISSKVVADVQPPMDAVEYAECEAVVKDFPPFREAMKKRGIEDMDLVMVDPWCVGYHSDADAPSRRLAKPLIFCRTESDCPMENGYARPVEGIYVLVDMQNMVVVEFEDRKLVPLPPADPLRNYTPGETRGGVDRSDVKPLQIIQPEGPSFRVNGYFVEWQKWNFRIGFTPREGLVIYSVAYIDGSRGRRSVAHRLSFVEMVVPYGDPNDPHYRKNAFDAGEDGLGKNAHSLKKGCDCLGYIKYFDAHFTNFTGGIETIENCVCLHEEDHGMLWKHQDWRTGLAEVRRSRRLTVSFVCTVANYEYGFFWHFYQDGKIEAEVKLTGILSLGALQPGEIRKYGTTIAPGLYAPVHQHFFVARMDMAVDCKPGETFNQVVEVNVKVEEPGKNNVHNNAFYAEEKLLRSEMQAMRDCNPLSARHWIIRNTRTVNRTGQLTGYKLVPGSNCLPLAGSEAKFLRRAAFLKHNLWVTPYARDEMYPGGEFPNQNPRVGEGLATWVNQNRSLEETDIVLWYVFGVTHIPRLEDWPVMPVEHIGFRLMPHGFFNCSPAVDVPPSTCDLDLKDNGVTGKPIQNGLLAKL

SEQ ID NO: 9278 - protein, 784 aa, Prunus mume
MASASKKTSSSCCFRSDSAPIPREAAPAPNAVVSASVVQDWTAIAGSEDRRDDQRPKKIGMASLITEPSANASTTGIPIMLRPQTRHPLDPLSAAEISVAVATVRAAGATPEVRDSMRFVEVVLLEPDKHVVGLADAYFFPPFQPSLLPRTKGGPIIPTKLPPRRARLVVYNKKSNETSTWVVELSEVHAATRGGHHRGKVISSQVVPDVQPPMDAVEYAECEAVVKDFPPFREAMKKRGIEDMDLVMVDAWCVGYHSDADAPSQRLAKPLIFCRTESDCPMENGYARPVEGIYVLVDMQNMVVVEFEDRKLVPLPPADPLRNYTPGETRGGVDRSDVKPLQILQPEGPSFRVNGYFVEWQKWNFRIGFTPREGLVIYSVAYVDGSRGRRPVAHRLSFVEMVVPYGDPNDPHYRKNAFDAGEDGLGKNAHSLKKGCDCLGYIKYFDAHFTNFTGGIETIENCVCLHEEDHGILWKHQDWRTGLAEVRRSRRLTVSFICTVANYEYGFFWHFYQDGKIEAEVKLTGILSLGALQPGEVRKYGTVIAPGLYAPVHQHFFVARMDMAVDCKPGETYNQVVELDVKVEKPGDNNVHSNAFYAEETLLRTELQAMRDCNPLTARHWIVRNTRTVNRTGQLTGYKLVPGSNCLPLAGSEAKFLRRAAFLKHNLWVTPYAQDEMFPGGEFPNQNPRVSEGLATWVNKNRSLEETDIVLWYVFGITHVPRLEDWPVMPVERIGFMLMPHGFFNCSPAVDVPPSACELEAKDNDVKDNGVAKSIPNGLLAAKL

SEQ ID NO: 9279 - protein, 758 aa, Trifolium pratense
MATVEEKTTPICCSKAAVTATSTSSNVPKQKQQPSFVSAVDSRLDPPPKSASSKGITVMAKAQTLHPLDPLTAAEISVAVATVRAAGATPEVRDSMRFIEVDLVEPEKQVVALADAYFFPPFQPSLLPRTKGGPVIPSKLPPRKARLVVYNKKSNETSIWIVELTEVHATTRGGHHRGKVISSTIVPDVQPPMDAVEYAECEAVVKDYPPFREAMKKRGIEDMDLVMVDPWCAGYHSEGDAPSRRLAKPLFFCRTESDCPMENGYARPVEGIHVLVDMQNMVVLEFEDRKLVPLPQADPLRNYTSGETRGGVDRSDVKPLQIIQPDGPSFRVNGNFVQWQKWNFRIGFTPREGLVVYSVAYIDGSRGRRPVAHRLSFVEMVVPYGDPNDPHYRKNAFDAGEDGLGKNAHSLKKGCDCLGYIKYFDAHFTNFYGSVETIENCVCMHEEDHGMLWKHQDWRTGLAEVRRSRRLTVSFICTVANYEYGFYWHFYQDGKIEAEVKLTGILSLGALQQGETRKYGTTIAPGLYAPVHQHFFVARMDMAVDCKPGEAFNQVVEVNVKVEEPGKNNVHNNAFYAEEKLLKSELEAMRDCDPLSARHWIVRNTRSVNRTGHLTGYKLVPGSNCLPLAGSEAKFLRRAAFLKHNLWVTAYARDELHPGGEFPNQNPRVGEGLASWVKLNRSLEEADIVLWYVFGVTHIPRLEDWPVMPVEHIGFMLMPHGFFNCSPAVDVPPSPSDLDDKENGMPAKPSQNGLIAKL

SEQ ID NO: 9280 - protein, 766 aa, Glycine max
MATAQEKTTPCCATQNNNKVALAAPPTSSSSAPQQQSQSQQRPSVATFISAIDSPPKTASAKGITVMVRAQTSHPLDPLTAAEISVAVATVRAAGATPEVRDGMRFIEVDLVEPEKQVVALADAYFFPPFQPSLLPRTKGGPVIPTKLPPRKARLVVYNKKSNETSTWIVELREVHATTRGGHHRGKVISSTVVPDVQPPMDAVEYAECEAVVKDFPPFREAMKKRGIEDMDLVMVDPWCAGYHSEADAPSRRLAKPLIFCRTESDCPMENGYARPVEGIHVLVDMQNMVVLEFEDRKLVPLPPADPLRNYTSGETQGGVDRSDVKPLQIIQPEGPSFRVNGHFIEWQKWNFRIGFTPREGLVIHSVAYIDGSRGRRPVAHRLSFVEMVVPYGDPNDPHYRKNAFDAGEDGLGKNSHSLKKGCDCLGYIKYFDAHFTNFYGGVETIENCVCLHEEDHGILWKHQDWRTGLAEVRRSRRLTVSFICTVANYEYGFFWHFYQDGKIEAEVKLTGILSLGALQPGETRKYGTTIAPGLYAPVHQHFFVARMDMAVDCKPGEAFNQVVEVNVKVEKPGDNNVHNNAFYAEEKLLKSEMEAMRDCDPLSARHWIVRNTRTVNRTGHLTGYKLVPGSNCLPLAGSEAKFLRRAAFLKHNLWVTPYARDEMHPGGEFPNQNPRVGEGLATWVKQNRSLEEADIVLWYVFGVTHIPRLEDWPVMPVERIGFMLMPHGFFNCSPAVDVPPNQSDLDDKENGLPAKPIQNGLIAKL

SEQ ID NO: 9281 - protein, 758 aa, Trifolium pratense
MATVEEKTTPICCSKAAVTATSTSSNVPKQKQQPSFVSAVDSRLDPPPKSASSKGITVMAKAQTLHPLDPLTAAEISVAVATVRAAGATPEVRDSMRFIEVDLVEPEKQVVALADAYFFPPFQPSLLPRTKGGPVIPSKLPPRKARLVVYNKKSNETSIWIVELTEVHATTRGGHHRGKVISSTIVPDVQPPMDAVEYAECEAVVKDYPPFREAMKKRGIEDMDLVMVDPWCAGYHSEGDAPSRRLAKPLFFCRTESDCPMENGYARPVEGIHVLVDMQNMVVLEFEDRKLVPLPQADPLRNYTSGETRGGVDRSDVKPLQIIQPDGPSFRVNGNFVQWQKWNFRIGFTPREGLVVYSVAYIDGSRGRRPVAHRLSFVEMVVPYGDPNDPHYRKNAFDAGEDGLGKNAHSLKKGCDCLGYIKYFDAHFTNFYGSVETIENCVCMHEEDHGMLWKHQDWRTGLAEVRRSRRLTVSFICTVANYEYGFYWHFYQDGKIEAEVKLTGILSLGALQQGETRKYGTTIAPGLYAPVHQHFFVARMDMAVDCKPGEAFNQVVEVNVKVEEPGKNNVHNNAFYAEEKLLKSELEAMRDCDPLSARHWIVRNTRSVNRTGHLTGYKLVPGSNCLPLAGSEAKFLRRAAFLKHNLWVTAYARDELHPGGEFPNQNPRVGEGLATWVKQNRPLEEADIVLWYVFGVTHIPRLEDWPVMPVEHIGFMLMPHGFFNCSPAVDVPPSPSDLDDKENGMPAKPSQNGLIAKL

SEQ ID NO: 9282 - protein, 760 aa, Glycine max
MATTQEQKATPNILNNTTTTTSSWADPLRNRPSVATVISAVDSFSDPPPNTTSTTKGIPVMTRAQTCHPLDPLSAAEISVAVATVRAAGATPEVRDSMRFVEVVLVEPDKQVVALADAYFFPPFQPSLLPRTKGGPLIPTKLPPRKARLVVYNKRSNETSIWIVELREVHAATRGGHHRGKVISSKVVPNVQPPMDAVEYAECEAAVKDFPPFREAMKRRGIEDMDLVMVDAWCVGYHSEADAPSRRLAKPLIFCRTESDCPMENGYARPVEGIHILVDMQNMEILEFEDRKLIPLPPADPLRNYTSGETRGGVDRSDVKPLQIIQPEGPSFRVNGHFIQWQKWNFRIGFTPREGLVIYSVAYIDGSRGRRPVAHRLSFVEMVVPYGDPNDPHYRKNAFDAGEDGLGKNAHSLKKGCDCLGYIKYFDAHFTNFNGGVETIENCVCLHEEDHGILWKHQDWRTGLAEVRRSRRLTVSFICTVANYEYGFFWHFYQDGKIEAEVKLTGILSLGALQPGESRKYGTTIAPGLYAPVHQHFFVARMDMAVDCKPGEAFNQVVEVDVKIEEPGKNNVHNNAFYAEEKLLKSESEAMRDCNPLSARHWIVRNTRTVNRTGQLTGYKLVPGSNCLPLAGSEAKFLRRAAFLKHNLWVTPYVPGEMHPGGEFPNQNPRVGEGLATWVQKNRSLEEADIVLWYVFGITHIPRLEDWPVMPVERIGFMLMPHGFFNCSPAVDVPPSASDLDDKENGMSAKPIQNGMIAKL

SEQ ID NO: 9283 - protein, 777 aa, Populus trichocarpa
MASTSKKTTSSPSCCDSSATTPPLPIRRDATKTSALVRQDWTIPVPSPEHRPVVDSLPEPSRTASATKTAIPVMLRAQTSHPLDPLSAAEISVAVATVRAAGATPELRDSMRFIEVVLLEPDKHVVALADAYFFPPFQPSLLPRTKGGPIIPMKLPPRRARLVVYNKRSNETSIWIVELSEVHAATRGGHHRGKVISSQVVPDVQPPMDAVEYAECEAVVKDFPPFREAMKKRGIEDMELVMVDAWCVGYHSDADAPSRRLAKPLIFCRTESDCPMENGYARPVEGIHVLVDMQNMKVVEFEDHKLVPLPLADPLRNYTPGETRGGVDRSDVKPLQIIQLEGPSFRVKGHYIEWQKWNFRIGFTPREGLVIHSVAYVDGSRGRRPVAHRLSFVEMVVPYGDPNEPHYRKNAFDAGEDGLGKNAHSLKKGCDCLGFIKYFDAHFTNFTGGVETIENCVCLHEEDHGILWKHQDWRTGLAEVRRSRRLTVSFICTVANYEYGFFWHFYQDGKIEAEVKLTGILSLGALQPGETRKYGTTIAPGLYAPVHQHFFVARMDMAVDCKSGEAFNQVVEVNVEVEKPGEKNVHNNAFYAKETLLQSELQAMRDCNPQTARHWIVRNTRTVNRTGQLTGYKLVPGSNCLPLAGPEAKFLRRAAFLNHNLWVTPYTHGEMFPGGEFPNQNPRVGEGLATWVKQNRPLEETDIVLWYVFGITHVPRLEDWPVMPVERIGFMLMPHGFFNCSPAVDVPPSACELDAKDNDAKDNSVSKPLQNGVLAKL

SEQ ID NO: 9284 - protein, 779 aa, Euphorbia peplus
MASATQKTTSSSCCSVQTDSVTPLRRDAAPAPSASVVANAVQDQQLGTKKPAIASLIRPVDSLPEASTKASIPVMLRAQTSHPLDPLTAAEISVAVATVRAAGATPEVRDSMRFMEVVLLEPEKNVVALADAYFFPPFQPSLLPRLKGGGPVIPTKLPPRRAKLIVYNKRSNETSVWIVELSEVHAVTRGGHHRGKVISSEVVPDVQPPMDAVEYAECEAVVKDFPPFREAMKKRGIEDMELVMVDAWCVGYHSDADAPSKRLAKPLIFCRTESDCPMENGYARPVEGIYVLVDMQNMTVIEFEDRKLVPLPPADPLRNYTPGETRGGVDRSDVKPLQIIQPEGPSFRVNGHFVEWQKWNFRIGFTPREGLVIHSVAYVDGSRGRRPVAHRLSFVEMVVPYGDPNDPHYRKNAFDAGEDGLGKNAHALKKGCDCLGVIKYFDAHFTNFTGGVETIENCVCLHEEDHGILWKHQDWRTGLAEVRRSRRLTVSFVCTVANYEYGFFWHFYQDGKIEAEVKLTGILSLGALQPGETRKYGTTIAPGLYAPVHQHFFVARMNMAVDCKPGEALNQVVEVDVKVEEPGENNIHNNAFYAEERLLGSELEAMRDCNPLRARHWVVRNTRTVNRTGQLTGYKLVPGSNCLPLAGPEAKFLRRAAFLKHNLWVTPFSNEQMFPGGEFPNQNPRVGEGLSTWVKKNRSLEETDVVLWYVFGITHVPRLEDWPVMPVERIGFMLMPHGFFNCSPAVDVPPSSCEMDTKDNDVKENTIVKPLQNGLLAKL

SEQ ID NO: 9285 - protein, 775 aa, Citrus sinensis
MATTQEKTTPTCCINNSSKPSATEPVKDWKVSGSDPSLDPVRKRDSVTTLIRPVESLPDPPPPPNTISSTKGIPMMVRAQTSHPLDPLSAAEISVAVATVRAAGATPEVRDSMRFVEVVRVEPDKQVVALADAYFFPPFQPSLIPRTKGGPIIPTKLPPRRARLVVYNKRSNETSIWVVELSEVHAATRGGHHRGKVISSKVVPDVQPPMDAVEYAECEAVVKDFPPFREAMKKRGIEDMDLVMVDPWCVGYHSDADAPSRRLAKPLIFCRTESDCPIENGYARPVEGIHVLVDMQNMVVIEFEDRKLVHLPPADPLRNYTAGETRGGVDRSDIKPLQIVQPEGPSFRVNGHFVEWQKWNFRIGFTPREGLIIYSVAYVDGSRGRRPVAHRLSFVEMVVPYGDPNDPHYRKNAFDAGEDGLGKNAHSLKKGCDCLGYIKYFDAHFTNFAGGVDTIENCVCLHEEDHGILWKHQDWRTGLAEVRRSRRLSVSFICTVANYEYAFFWHFYQDGKIEAEVKLTGILSLGALQPGEVRKYGTIIAPGLYAPVHQHFFVARMDMAVDCKPGEAHNQVVEMNVKVEEPGKNNVHNNAFYAEEELLKSELQAMRDCNPLTARHWIIRNTRTVNRTGQLTGYKLVPGSNCLPLAGSEAKVLRRAAFLKHNLWVTPYAHDEMYPGGEFPNQNPRVGEGLATWVEQNRSLEETDIVLWYVFGVTHIPRLEDWPVMPVDRIGFMLMPHGFFNCSPAVDVPPNESDLDLKDTAIAEKPVQNGLLAKL

SEQ ID NO: 9286 - protein, 764 aa, Glycine max
MATTQEKTTPCCAPQNNNKVAATSSSSSAPPQQQSQQQQRPSVATFISAIDSPPKTASAKGITVMVRAQTSHPLDPLTAAEISVAVATVRAAGATPEVRDSMRFIEVDLVEPEKQVVALADAYFFPPFQPSLLPRTKGGPVIPTKLPPRKARLVVYNKRSNETSIWIVELREVHAATRGGHHRGKVVSSTVVPDVQPPMDAVEYAECEAVVKDFPPFREAMKKRGIEDMDLVMVDPWCAGYHSEVDAPSRRLAKPLIFCRTESDCPMENGYARPVDGIHVLVDMQNMVVLEFEDRKLVPLPPADPLRNYTSGETRGGVDRSDVKPLQIIQPEGPSFRVNGHFIEWQKWNFRIGFTPREGLVIHSVAYIDGSRGRRPVAHRLSFVEMVVPYGDPNDPHYRKNAFDAGEDGLGKNAHSLKKGCDCLGYIKYFDAHFTNFYGGVETIENCVCLHEEDHGILWKHQDWRTGLAEVRRSRRLTVSFICTVANYEYGFFWHFYQDGKIEAEIKLTGILSLGSLQPGETRKYGTTIAPGLYAPVHQHFFVARMDMAVDCKPGEAFNQVVEVNVKVEKPGDNNVHNNAFYAEEKLLKSELEAMRDCDPLSARHWIVRNTRTVNRTGHLTGYKLVPGSNCLPLAGSEAKFLRRAAFLKHNLWVTPYARDEMHPGGEFPNQNPRVGEGLATWVKQNRSLEEADIVLWYVFGVTHIPRLEDWPVMPVERIGFMLMPHGFFNCSPAVDVPPNPSDLDDKENGLPAKPIQNGLIAKL

SEQ ID NO: 9287 - protein, 777 aa, Prunus mume
MAATQEKATPCCLDAAPAKSSALLRKASDPMRDWTVSGSDPSQDPIRNRAAVPTLIRPIETLPAPSTNTTATKGIPVMLRAQTSHPLEPLSAAEISVAVATVRAAGATPEVRDSMRFVEVALVEPDKHVVALADAYFFPPFQPSLLPRTKGGPMIPSKLPPRQARLVVYNKKSNETSIWIVELSEVHAATRGGHHRGKVISSEVVPDVQPPMDAMEYAECEAVVKDFPPFREAMKKRGIEDMDLVMVDPWCAGYHSEADAPSRRLAKPLIFCRTESDCPMENGYARPVEGIHVLVDMQNMVVLEFEDRKLVPLPPADPLRNYTPGETRGGVDRSDVKPLQIIQPEGPSFRVNGHFVEWQKWNFRIGFTSKEGLVIYSVAYIDGSRGRRPVAHRLSFVEMVVPYGDPNAPHYRKNAFDAGEDGLGKNAHSLKKGCDCLGYIKYFNAHFTNFTGGVETIENCVCLHEEDHGILWKHQDWRTGLAEVRRSRRLTVSFICTVANYEYGFYWHFYQDGHIEAEVKLTGILSLGALQPGETRKYGTTIAPGLYAPVHQHFFVARMDMAVDSKPGETFNQVVEVNVKVEEPGKNNVHNNAFYAEEKLLKSELQAMRDCNPLSARHWIVRNTRNVNRTGQLTGYKLVPGSNCLPLAGSEAKFLRRAAFLKHNLWVTSYARDEVYPGGEFPNQNPRIGEGLATWVKKNRSLEEADIVLWYVFGVTHIPRLEDWPVMPVERIGFTLMPHGFFNCSTAVDVPPNTCDLDLKDNGMTAKPIQNGLLAKL

SEQ ID NO: 9288 - protein, 771 aa, Gossypium hirsutum
MASTQEKATHKNNTPSPSSSSSAQVLQNWSLAAPSEDPIPKAASMAALIRPAETIADPPATKTTTSKGISIMPRAQTSHPLDPLSAAEISVAVATVRAAGATPEVRDSMRFIEVVLVEPDKHVVALADAYFFPPFQPSLLPRTKGGPVIPSKLPPRKARLVVYNKRSNETSIWIVELSEVHAATRGGHHRGKVISSKVVPNVQPPMDAMEYAECEAVVKDFPPFREAMKKRGIEDMDLVMVDPWCAGYHSSADAPSRRLAKPLIFCRTESDCPMENGYARPVEGIHVLVDMQNMVVIEFEDRKLVPLPPADPLRNYTAGETRGGVDRSDVKPLQIIQTEGPSFRINGNFIAWQKWNFRIGFTPREGLVIYSVAYIDGSRGRRPVAHRLSFVEMVVPYGDPNDPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFFWHFYQDGKIEAEVKLTGILSLGALQPGETRKYGTTIAPGLYAPVHQHFFVARMDMAVDCKPGEAFNQVVEVNLKVEEPGKDNVHNNAFYAEEELLRSELQAMRDCNPLTARHWIVRNTRNVNRTGQLTGFKLVPGSNCLPLAGSEAKFLRRAAFLKHNLWVTPYAHDEMYPGGEFPNQNPRVGEGLATWVKQNRSLEEADVVLWYVFGVIHIPRLEDWPVMPVDRIGFMLMPHGFFNCSPAVDVPPSTTDLELKDNDIATKPIQNVIIAKL

SEQ ID NO: 9289 - protein, 784 aa, Olea europaea
MATTAKKATPTNVCCAADGGKSAAAVAGVRREAASAFASAVDWSVPSVTAEDLQDKKAAAMTSVIRPEPSSNAATKGIQVMPRAQTVHPLDPLSAAEISVAVATVMAAGATPEVRDGMRFIEVVLLEPDKHVVALADAYFFSPFQPSLLPRTKGGLTIPSKLPPRRARLVVYNKKSNETSIWIVELTQVHATTRGGHHRGKVISSTVVLDVQPPMDAVEYAECEAVVKDYPPFIEAMKKRGIDDMDLVMVDPWCVGYHRESDSPSRRLAKPLIFCRTESDRPLENGYARPVEGIHVLVDMQNMVVIEFEDRKFVPLPPADPLRNYTPGETRGGVDRSDVKPLQIVQPEGPSFRVNGRYVEWQKWNFRVGFTPREGLVIHSVAYVDGSRGRRPIAHRLSFVEMVVPYGDPNDPHYRKNAFDAGEDGLGKNAHSLKKGCDCLGYIKYFDAHFTNFTGGVETTENCVCLHEEDYGILWKHQDWRTGLAEVRRSRRLTVSFICTVANYEYGFYWHFYQDGKIEAEVKLTGILSLGALQPGESRKYGTTIAPGLYAPVHQHFFVARMDMAVDCKPGEAHNQVVEVNVKVEEPGKDNVHNNAFYAEETLLRSELEAMRDCDPFSARHWIIRNTRTVNRNGQLTGYKLVPGSNCLPLAGPEAKFMRRAAFLKHNLWVTQYERGEDFPGGEFPNQNPRVGEGLASYVKQNRSLEEADIVLWYVFGITHVPRLEDWPVMPVERIGFMLQPHGFFNCSPAVDVPPNACETDAKENDAKDNSGAKSIPSAVMAKL

SEQ ID NO: 9290 - protein, 771 aa, Gossypium raimondii
MASTQEKATHKNNTPSPSSSSSAQVLQNWSLAAPSEDPIPKAASMAALIRPAETIADPPATKTTTSKGISIMPRAQTSHPLDPLSAAEISVAVATVRAAGATPEVRDSMRFIEVVLVEPDKHVVALADAYFFPPFQPSLLPRTKGGPVIPSKLPPRKARLVVYNKRSNETSIWIVELSEVHAATRGGHHRGKVISSKVVPNVQPPMDAMEYAECEAVVKDFPPFREAMKKRGIEDMDLVMVDPWCAGYHTNADAPSRRLAKPLIFCRTESDCPMENGYARPVEGIHVLVDMQNMVVIEFEDRKLVPLPPADPLRNYTAGETRGGVDRSDVKPLQIIQTEGPSFRINGNFIAWQKWNFRIGFTPREGLVIYSVAYIDGSRGRRPVAHRLSFVEMVVPYGDPNDPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFFWHFYQDGKIEAEVKLTGILSLGALQPGETRKYGTTIAPGLYAPVHQHFFVARMDMAVDCKPGEAFNQVVEVNLKVEEPGKDNVHNNAFYAEEELLRSELQAMRDCNPLTARHWIVRNTRNVNRTGQLTGFKLVPGSNCLPLAGSEAKFLRRAAFLKHNLWVTPYAHDEMYPGGEFPNQNPRVGEGLATWVKQNRSLEEADVVLWYVFGVIHIPRLEDWPVMPVDRIGFMLMPHGFFNCSPAVDVPPSTTDLELKDNDIATKPIQNVIIAKL

SEQ ID NO: 9291 - protein, 775 aa, Malus domestica
MATTQEKATPRDAASAESSALLRKAGEPVRNWTGSASDLDSDPIRTRASVPTLIRPMESLPAPSTNTAATKGIPVMLRAQSSHPLEPLSAAEISVAVATVRAAGATPEVRDSMRFVEVALVEPDKRVVALADAYFFPPFQPSLLPRTKGGPMIPSKLPPRQARLVVYNKKSNETSIWIVELSEVHAATRGGHHRGKVISSEVVPDVQPPMDAVEYAECEAVVKNFPPFREAMKKRGIEDMDLVMVDPWCTGYHSGADAPSRRLAKPLIFCRTESDCPLENGYARPVEGIRVLVDMQNMVVLEFEDRKLVPLPPADPLRNYTPGETRGGVDRSDVKPLQIIQPEGPSFRVNGHFVEWQKWNFRIGFTSKEGLVIYSVAYIDGSRGRRPVAHRLSFVEMVVPYGDPNDPHYRKNAFDAGEDGLGKNAHSLKKGCDCLGYIKYFDANFTNFTGGVETIENCVCLHEEDHGILWKHQDWRTGLAEVRRARRLTVSFICTVANYEYGFYWHFYQDGHIEAEVKLTGILSLGALQPGETRKYGTTIAPGLYAPVHQHFFVARMDMAVDSKPGETFNQVVEVNVKVDEPGKNNVHNNAFYAEEKLLKSELQAMRDCNPLSARHWIVRNTRNVNRTGQLTGYKLVPGSNCLPLAGSEAKFLRRAAFLKHNLWVTSYARDEMYPGGEFPNQNPRIGEGLATWVQKNRSLEEADIVLWYVFGVTHIPRLEDWPVMPVERIGFTLMPHGFFNCSPAVDVPPSTCELDLKDNGMAAKPIQSGLLAKL

SEQ ID NO: 9292 - protein, 771 aa, Cocos nucifera
MATTEEKATPCCASATSGGDGGLRREAAGAVREWTAGEKQSVATAAMSSLIHPVEEIPDPSAKPSAKGLPMMMRAQTKHPLDPLSAAEISVAVATVRAAGATPEVRDSMRFVEVVLLEPEKHVVALADAYFFPPFQPSLLPRMKGGPVIPSKLPARRARLVVYNKQSNETSIWIVELSEVHAATRGGHHRGKVISSEVVPDVQPPMDAVEYAECEAVVKSYPPFIEAMKKRGIEDMDLVMVDAWCAGYHSEADAPSRRLAKPLIFCRTESDCPMENGYARPVEGIHILVDIQNNVVIEFEDRKLVPLPPADPLRNYTPGETRGGVDRSDVKPLHILQPEGPSFRVNGHFVEWQKWNFRIGFTPREGLVIYSVAYIDGSRGRRPVAHRLSFVEMVVPYGDPNEPHYRKNAFDAGEDGLGKNAHSLKKGCDCLGYIKYFDAHFTNYTGGIETIENCVCLHEEDHGILWKHQDWRTGLAEVRRSRRLTVSFICTVANYEYGFFWHFYQDGKIEAEVKLTGILSLGALLPGESRKYGTTIAPGLYAPVHQHFFVARMDMAVDCKPSEAFNQVVEVNVKVEGPGQNNVHNNAFYAEEKLLRSELQAMRDCDPSSARHWIVRNTRTVNRTGQPTGYKLVPGSNCLPLAGPEAKFLRRAAFLKHNLWVTPYNRDEMYPGGEFPNQNPRPNEGLATWVKKNRSLEETDIVLWYVFGVTHIPRLEDWPVMPVERIGFMLMPHGFFNCSPAVDVPPGPSEVEVKDNNGTPKLIQNGLLAKL

SEQ ID NO: 9293 - protein, 766 aa, Populus trichocarpa
MATAQEKATPTSFASAAGKAAAADGVLQSWTDPSQDPITKRSPTSVSLIRPVSSLSPDPNTKGITIMTRAQTCHPLEPLTAAEISVAVATVRAAGATPEVRDSMRFVEVVLVEPVKHVVALADAYFFPPFQPSLLPRTKGGPVIPTKLPPRRARLVVYSKRSNETSIWIVELAEVRATTRGGHHRGKVISSEVVPNVQPPMDAVEYAECEAVVKDFPPFREAMKKRGIDDMDLVMVDPWCAGYHSDSDAPSRRLAKPLIFCRTESDCPMENGYARPVEGIHVLVDMQNMVVIEFEDRKLIPLPPADPLRNYTSGETRGGVDRSDIKPLQIIQPEGPSFRVSGHFIEWQKWNFRIGFTPREGLVIYSVAYVDDGRGRRPVAHRLSFVEMVVPYGDPNDPHYRKNAFDAGEDGLGKNAHSLKKGCDCLGYIKYFDAHFTNFTGGVETIENCVCLHEEDHGILWKHQDWRTGLAEVRRSRRLSVSFVCTVANYEYGFFWHFYQDGKIEAEVKLTGILSLGALPPGETRKYGTTIAPGLYAPVHQHFFVARMDMAVDCRPGETFNQVVEVNVKIEEPGKDNVHNNAFYAEEELLRSELQAMRDCNPLSARHWIIRNTRTVNRSGQLTGYKLMPGSNCLPLAGSEAKFLRRAAFLKHNLWVTPYARDEMYPGGEFPNQNPRVGEGLATWVKQNRSLEETDVVLWYVFGVTHIPRLEDWPVMPVERIGFMLMPHGFFNSSPAVDVPPSASDLDLKDNVVAAKPIQNGLLAKL

SEQ ID NO: 9294 - protein, 775 aa, Arabidopsis lyrata
MASASKKTTACPHHGGSVSPPKLVSAAPDTVAVWSDGDDQRASKVVLESVIRPVDSLPDTAKKPANKGISVMPRTETKHPLDPLSAAEISVAVATVRAAGANPEVRDGMRFIEVASVEPDKQVVALADAYFFPPFQPSLLPRTKSGPVIPMKLPPRRARLVVYNQKSNETSVWIVELSEVHAVTRGGHHRGRVVSSQVIPDVQPPMDAAEYAECEAIVKDFPPFIEAMKRRGIEDMDLVMVDPWCVGYHSEADAPSRRLAKPLIYCRTDSDSPMENGYARPVEGIYVLVDMQNMVVIEFEDRKFVPLPPPDPLRNYTPGESRGGVDRSDVKPLQIIQPEGPSFRVRGYFVEWQKWNFRIGFTPREGLVIHSVAYVDGSRGRRPVAHRLSFVEMVVPYGDPNEPHYRKNAFDAGEDGLGKNAHSLKKGCDCLGSIKYFDAHFTNFTGGVETIENCVCLHEEDHGILWKHQDWRTGLAEVRRSRRLTVSFLCTVANYEYGFYWHFYQDGKIEAEVKLTGILSLGALQPGETRKYGTTIAPGLYAPVHQHFFIARMDMSVDCKPGEAFNQVVEVNVRVDEPGENNVHSNAFYAEEKLLRSEAVAMRDCDPLSARHWIVRNTRTVNRTGQLTGYKLVPGSNCLPLARPEAKFLRRAAFLKHNLWVTRYAPDEKFPGGEFPNQNPRAGEGLATWVKQNRSLEESDVVLWYVFGITHVPRLEDWPVMPVEHIGFTLMPHGFFNCSPAVDVPPNPCELETKDSEVKEVVAPKPLQTGLLSKL

SEQ ID NO: 9295 - protein, 778 aa, Triphysaria pusilla
MATTPKEATVAVSFGQKVVVESASAAVVRRENASASAAADWGVSSAAENLQSKNLASLFRPDPSTKAPTKGIQSMPRAQTKHPLDPLSAAEIYVAVATVRAAGATPEVRDSMRFVEVVLLEPEKNVVALADAYFFPPFQPSLLPRTKGGQAIAIKLPPRRARLVVYNKRSNETSLWIVELAEVHATTRGGHHRGKVISSTVVPDVQPPMDAVEYAECEAVVKDYPPFIEAMKKRGIDDMDLVMVDPWCAGYHSEADSPSRRLAKPLIFCRTESDCPLENGYARPVEGIHVLVDMQNMVLIEFEDRKIVPLPPADPLRNYTPGETRGGVDRSDVKSLQLVQPEGPSFRVNGHYIEWQKWNFRIGFTPREGLVIHSVAYVDGSRGRRPIAHRLSFVEMVVPYGDPNDPHYRKNAFDAGEDGLGKNAHSLKKGCDCLGYVKYFDAHFTNFTGGAETIENCVCLNEEDHGILWKHQDWRTGLAEVRRSRRLTVSFICTVANYEYGFYWYFYQDGKIEAEVKLTGILSLGALQPGESRKYGTTIAPGLYAPVHQHFFVARMDMAVDCKPGEMHNQVVEVNVRVEEVGNDNVHNNAFYAEKTLLRSELEAMRDCDPLSARHWIIRNTRTVNRNGQLTGYKLVPGSNCLPLAGPKAKFLRRAAFLKHNLWVTPYAHGEDFPGGEFPNQNPRVGEGLASWVKKNRPLEETNIVLWYVFGITHVPRLEDWPVMPVEHIGFVLQPHGFFNCSPAVDVPPNACDADAKENDVKDNGVSKSIPSGLIAKL

SEQ ID NO: 9296 - protein, 776 aa, Arabidopsis thaliana
MASASKKTSACPHHGGSLPPPKLVSAAPDTVAVWSDADDQRASKVSLESVIRPVDSFPDNTAKKPANKGISVMPRTETKHPLDPLSAAEISVAVATVRAAGANPEVRDGMRFIEVASVEPDKQVVALADAYFFPPFQPSLLPRTKSGPVIPMKLPPRRARLVVYNQKSNETSVWIVALSEVHAVTRGGHHRGRVVSSQVIPDVQPPMDAAEYAECEAIVKDFPPFIEAMKRRGIEDMDLVMVDPWCVGYHSEADAPSRRLAKPLIYCRTDSDSPMENGYARPVEGIYVLVDMQNMVVIEFEDRKFVPLPPPDPLRNYTPGESRGGVDRSDVKPLQIIQPEGPSFRVRGYFVEWQKWNFRIGFTPREGLVIHSVAYVDGSRGRRPVAHRLSFVEMVVPYGDPNEPHYRKNAFDAGEDGLGKNAHSLKKGCDCLGSIKYFDAHFTNFTGGVETIENCVCLHEEDHGILWKHQDWRTGLAEVRRSRRLTVSFLCTVANYEYGFYWHFYQDGKIEAEVKLTGILSLGALQPGETRKYGTTIAPGLYAPVHQHFFIARMDMSVDCKPAEAFNQVVEVNVRVDERGENNVHNNAFYAEEKLLKSEAVAMRDCDPLSARHWIVRNTRTVNRTGQLTGYKLVPGSNCLPLARPEAKFLRRAAFLKHNLWVTRYAPDEKFPGGEFPNQNPRAGEGLATWVKQNRSLEESDVVLWYVFGITHVPRLEDWPVMPVEHIGFTLMPHGFFNCSPAVDVPPNPCELETKESEVKEVVAPKALQTGLLSKL

SEQ ID NO: 9297 - protein, 761 aa, Cicer arietinum
MASAQEKATPPNNSPSSSAPPPPPPPSSTWPDPTQDPTRNTTSLDSFPPKTTPTTKGIPVMMRAQTCHPLDPLTAAEISVAVATVRAAGATPEVRDSMRFVEVVLVEPVKQVVALADAYFFPPFQPSLLPRTKGGGPLIPTKLPTRKARLVVYNKKSNETSIWIVELREVHAATRGGPHRGKVISSQVVPNVQPPMDAMEYAECEAVVKDFPPFREAMKRRGIEDMDLVMVDAWCVGYHSEADSPNRRLAKPLIFCRSESDCPMENGYARPVEGIYVLVDMQNMVVLEFEDRKLIPLPPTDPLRNYTSGETRGGVDRSDVKPLQIIQPEGPSFRVNGHFIQWQKWNFRIGFTPREGLVIYSVAYIDGSRGRRPVAHRLSFVEMVVPYGDPNDPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFFWHFYQDGKIEAEVKLTGILSLGAMQPGEARKYGTTIAPGLYAPVHQHFFVARMDMSVDCKPGEAFNQVVEVDVKVEDPGKNNVHNNAFYAEEKLLKSELEAMRDCNPLSARHWIVRNTRTVNRTGQLTGYRLVPGSNCLPLAGSEAKFLRRAAFLKHNLWVTPYVHNEMHPGGEFPNQNPRVGEGLATWVKQNRSLEEADIVLWYVFGVTHIPRLEDWPVMPVEHIGFMLMPHGFFNCSPAVDVPPSAGDLDDKENVMSAKPIQNGLIAKL

SEQ ID NO: 9298 - protein, 769 aa, Eucalyptus grandis
MASAPQKATPSSRFLQDVPPAVSGWAAPPGADPRDGQLPRKASVIRPVDSLPEPSATALTKGVAVMQRAQTSHPLDPLSAAEISVAVATVRAAGSTPEIRDGMRFVEVVLLEPGKHVVALADAYFFPPFQPSLLPRTKSGPVLPAKLPPRRARLIVYNKKSNETSVWIVELSEVHAATRGGHHRGKVISSKIIPNVQPPMDASEYAECEAAVKEFPQFREAMKKRGIEDMDLVMVDAWCAGYHSDADAPSRRLAKPLIFCRTESDCPMENGYARPVEGIHILVDMQNMVVIEFEDRKLVPLPPADPLRNYTAGETRGGVDRSDVKPLLIVQPEGPSFRVNGHYVAWQKWNFRIGFTPREGLVIHSVAYVDGSRGRRPVAHRLSFVEMVVPYGDPNDPHYRKNAFDAGEDGLGKNAHSLKKGCDCLGYIKYFDAYLPNFTGGVDTIENCICLHEEDHGILWKHQDWRTGLAEVRRSRRLSVSFICTVANYEYGFFWHFYQDGKIEAEVKLTGILSLGALLPGESRKYGTMIAPGLYAPVHQHFFVARMDMAVDCKPGESFNQVVEVDVKVEEPGEKNVHNNAFYAEETLLRSELQAMRDCNPLTARHWIVRNTRTVNRTGQLTGYKLVPGSNCLPLAGSEAKFLRRAAFLKHNLWVTAYAPDEMFPGGEFPNQNPRVGEGLSTWVKRNRPLEETDVVLWYVFGITHVPRLEDWPVMPVERIGFMLMPHGFFNCSPAVDVPPSTCDMDAKDNEVKDNGENKQVPGVIPAKL

SEQ ID NO: 9299 - protein, 797 aa, Theobroma cacao
MASAKKKATLFSSASSSPSSSSSPSSCCAVDSAVSAAPAAAAAANVVQEWTVASRDRRDDQRATKAAMASLIHPVDSLPDTSTAAPSTKGIQILPRAQTSHPLDPLSAAEISVAVATVRAAGATPEVRDGMRFVEVVLLEPDKHVVALADAYFFPPFQPSLLPRTKGGPVIPTKLPPRRARLIVYNKKSNETSVWIVELSEVHAVTRGGHHRGKVISSKVVPDVQPPMDAMEYAECEAVVKDFPPFREAMKKRGIEDMELVMVDPWCVGYHSDADAPSRRLAKPLIFCRTESDCPMENGYARPVEGIYVLVDMQKMKVIEFEDCKFVPLPLADPLRNYTPGETRGGVDRSDVKPLQIVQPEGPSFRVNGCFVEWQKWNFRIGFTPKEGLVIYSVAYVDGSRGRRPVAHRLSFVEMVVPYGDPNDPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFYWHFYQDGKIEAEVKLTGILSLGALQPGEFRKYGTMIAPGLYAPVHQHFFVARMDMAVDCKPGEAFNQVVEVNAKVEEPGENNVHNNAFYAEETLLKTELQAMRDCNPFTARHWIVRNTRTVNRTGQLTGYKLVPGSNCLPLAGSEAKFLRRAAFLKHNLWVTRYAPDEMFPGGEFPNQNPRAGEGLATWVKQDRPLEETDIVLWYVFGITHVPRLEDWPVMPVEHIGFMLMPHGFFNCSPAVDVPPNACELDTKDNEIKENVVPKSTQNGLLAKL

SEQ ID NO: 9300 - protein, 767 aa, Cicer arietinum
MASASQKTTSPPCCPPGDSSRLAVSSIVKPQDRIANNVALIRPLDSLPESSTTNAPTAKGITSLTRPQSSHPLDPLSAAEISVAVATVRAAGATPELRDSMRFIEVVLLEPDKHVVALADAYFFPPFQPSLLPRSKGGPVIPTKLPPRCSRLVVYNKKSNETALWIVELSQVHAVTRGGHHRGKVISSHVVPDVQPPMDAEEYAECEAVVKSYPPFIEAMKKRGIEDMEVVMVDPWCVGYHSEADAPGRRLAKPLIFCRSESDCPMENGYARPVEGIYVLVDMQNMVVIEFEDRKLVPLPPVDPLRNYTPGESRGGSDRSDVKPLQIVQPEGPSFRVNGYYVEWQKWNFRIGFTPKEGLVIYSVAYVDGSRGRRPVAHRLSFVEMVVPYGDPNDPHYRKNAFDAGEDGLGKNAHSLKKGCDCLGYIKYFDAHFTNFTGGVETIENCVCMHEEDRGILWKHQDWRTGLAEVRRSRRLSVSFVCTVANYEYAFFWHFYQDGKIEADVKLTGILSLGALMPGEYRKYGTMIAPGLYAPVHQHFFVARMDMSVDSRPGEALNQVVEVNMKVEEPGENNIHNNAFYAEETLLKSESEAMRDCNPLTARHWIVRNTRTGNRTGQLTGYKLVPGSNCLPLAGSEAKFLRRAAFLKHNVWVTAYSRDEMFPGGEFPNQNPRVGEGLATWIKQDRSLEETNIVLWYVFGITHVPRLEDWPVMPVEHIGFMLMPHGFFNCSPAVDVPPSSCEAESKDNDIKDNGAPKPIPSGLASKL

SEQ ID NO: 9301 - protein, 779 aa, Papaver somniferum
MATIKKEKTPSSSFCCKNGGSIQREITSSASVVEVPNTNDPKKNSRPSVSTTMETVIRSVDSLPETSTNTSIKGIQIMMRAQSSHPLDPLSGAEISVAVGTVRAAGATPEVRDSMRFVEVVLLEPDKQVVALADAYFFPPFQPSLLPKTKGGPFIPSKLPPRRARLVVYNKRSNETSVWIVELTEVHAATRGGHHRGRVISSEVVPDVQPPMDAEEYAECEAIVKDYPPFREAMKKRGIEDMDLVMVDAWCVGYHSEHDAPSHRLAKPLIFCRTESDCPMENGYARPVEGIHLVVDMQNMVILEFEDRKLVPLPPADPLRNYTAGETRGGVDRSDVKPLQIIQPEGPSFRVSGHFIEWQKWNFRIGFTPREGLVIHSVAYIDGSRGRRAVAHRLSFVEMVVPYGDPNEPHYRKNAFDAGEDGLGKNAHSLKKGCDCLGYIKYFDAHFTNFSGGVETIENCVCLHEEDHGILWKHQDWRTGLAEVRRSRRLTVSFICTVANYEYGFFWHFYQDGKIEAEVKLTGILSLGALQPGEFRKYGTTIAPGLYAPVHQHFFVARMDMAVDCKPGEKHNQVVEVNVKVEKPGQNNVHNNAFYAEEELLRTEQQAMRDCNPLSARHWIIRNTRSVNRTGQLTGYKLVPGSNCLPLAGAEAKFLRRATFLQHNLWVTSYAPGEMYPGGEFPNQNPRAGEGLGTWIKQNRSLEETDIVLWYVFGITHIPRLEDWPVMPVEHIGFMLQPHGFFNRSPAVDVPPSTCELVDLKENGSSKPTIQNAVLTAKL

SEQ ID NO: 9302 - protein, 791 aa, Gossypium hirsutum
MASAKKKTTLHSSSSSSPSSCCASHSVVSAAPPASSSASATASNLLHEWTLGSTDRRDDSSVTKAAMASLIRPVDSLPDTSTKGIQIFTRPQTSHPLDPLSAAEISVAVATVRAAGATPEVRDSMRFVEVVLLEPDKHVVALADAYFFPPFQPSLLPRTKNGPVIPTKLPLRRARLVVYNKKSNETSIWIVELSEVHAVTRGGHHRGKVISSQVVPDVQPPMDAMEYAECEAVVKDFPPFREAMKKRGIEDMDLVMVDPWCVGYHSDADSPSRRLAKPLIFCRTESDCPMENGYARPVEGIYVLVDMQKMKVIEFEDRKFVPLPPADPLRNYTSGETRGGVDRSDVKPLQIVQPEGPSFRVNGCFVEWQKWNFRIGFTPKEGLVIYSVAYVDGSRGRRPVAHRLSFVEMVVPYGDPNDPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFYWHFYQDGKIEAEVKLTGILSLGALQPGESRKYGTMIAPGLYAPVHQHFFVARMDMAIDCKPGEAFNQVVEVNAKVEEPGENNIHNNAFYAEETLLKTELQAMRDCNPLTARHWIVRNTRTVNRSGQLTGYKLVPGSNCLPLAGSEAKFLRRAAFLKHNLWVTQCAPNEMFPGGEFPNQNPRAGEGLATWVKQDRSLEETDIVLWYVFGITHVPRLEDWPVMPVERIGFMLMPHGFFNCSPAVDVPPNACELDTKDNDIKENVVPKSIQNGLMSKL

SEQ ID NO: 9303 - protein, 791 aa, Gossypium raimondii
MASAKKKTTLHSSSSSSPSSCCASHSVVSAAPPASSSASATASNLLHEWTLGSTDRRDDSSATKAAMASLIRPVDSLPDTSTKGIQIFTRPQTSHPLDPLSAAEISVAVATVRAAGATPEVRDSMRFVEVVLLEPDKHVVALADAYFFPPFQPSLLPRTKNGPVIPTKLPLRRARLVVYNKKSNETSIWIVELSEVHAVTRGGHHRGKVISSQIVPDVQPPMDAMEYAECEAVVKDFPPFREAMKKRGIEDMDLVMVDPWCVGYHSDADSPSRRLAKPLIFCRTESDCPMENGYARPVEGIYVLVDMQKMKVIEFEDRKFVPLPPADPLRNYTSGETRGGVDRSDVKPLQIVQPEGPSFRVNGCFVEWQKWNFRIGFTPKEGLVIYSVAYVDGSRGRRPVAHRLSFVEMVVPYGDPNDPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFYWHFYQDGKIEAEVKLTGILSLGALQPGESRKYGTMIAPGLYAPVHQHFFVARMDMAIDCKPGEAFNQVVEVNAKVEEPGENNIHNNAFYAEETLLKTELQAMRDCNPLTARHWIVRNTRTVNRSGQLTGYKLVPGSNCLPLAGSEAKFLRRAAFLKHNLWVTQCAPNEMFPGGEFPNQNPRAGEGLATWVKQDRSLEETDIVLWYVFGITHVPRLEDWPVMPVERIGFMLMPHGFFNCSPAVDVPPNACELDTKDNDIKENVVPKSMQNGLMSKL

SEQ ID NO: 9304 - protein, 769 aa, Phaseolus vulgaris
MATAQEKATPNNLSNNPTASNSSAVPSSWAHPTADPFRNRPSVSALVSAVDSFPDPPPKTTSTTKGIPVMMRVQTCHPLDPLSAAEISVAVATVRAAGATPEVRDSMRFVEVVLVEPAKQVVALADAYFFPPFQPSLLPRTKGGPVIPSKLPPRRARLVVYNKRSNETSVWIVELREVHAATRGGHHRGKVISSKVVPNVQPPMDAVEYAECEAVVKDFPAFREAMKRRGIEDMDLVMVDAWCVGYHRETDAPSRRLAKPLIFCRTESDCPMENGYARPVEGINILVDMQHMEILEFEDRKLIPLPPADPLRNYTSGETRGGVDRSDVKPLQIIQPEGPSFRVNGHFIQWQKWNFRIGFTPREGLVIYSVAYIDGSRGRRPVAHRLSFVEMVVPYGDPNDPHYRKNAFDAGEDGLGKNAHSLKKGCDCLGYIKYFDAHFTNFNGGVETIENCVCLHEEDHGILWKHQDWRTGLAEVRRSRRLTVSFICTVANYEYGFFWHFYQDGKIEAEVKLTGILSLGALQPGETRKYGTTIAPGLYAPVHQHFFVARMDMAVDCKPGEAFNQVVEVDVIVEEPGKNNVHNNAFYAEERLLKSELEAMRDCNPLSARHWIVRNTRTVNRTGQLTGYKLVPGSNCLPLAGSEAKFLRRAAFLKHNLWVTPYVPEEMHPGGEFPNQNPRVGEGLATWVQQNRSLEEADIVLWYVFGVTHIPRLEDWPVMPVERIGFLLMPHGFFNCSPAVDVPPSASDLDDKDNGMSAKPIQNGVIAKL

SEQ ID NO: 9305 - protein, 789 aa, Gossypium raimondii
MASTQEKATHCCIPKTNDDIKNNNKAPPPPPPSSSTKVLQNWSVALVSGSNPSEDTISKRASMATLIRPVEPISDPPATNTTTSKGISIMPRAQTSHPLDPLSAAEISVAVATVRAAGKTPEVRDSMRFIEVALVEPEKHVVALADAYFFPPFQPSLLPRTKGGPVIPSKLPPRQARLVVYNKRSNETSIWIVELSEVHAATRGGHHRGKVISSKVVPDVQPPMDAMEYAECEAVVKDFPPFREAMKKRGIEDMDLVMVDPWCVGYHSDADAPTRRLAKPLIFCRTESDCPIENGYARPVEGIHVLVDMQNMVVIEFEDRKLVPLPPADPLRNYTAGETRGGVDRSDVKPLQIIQPEGPSFRVSGNFVEWQKWNFRIGFTPREGLVIYSVAYVDGSRGRRPIAHRLSFVEMVVPYGDPNEPHYRKNAFDAGEDGLGKNAHSLKKGCDCLGYIKYFDAHFTNFTGGVETIENCVCLHEEDHGVLWKHQDWRTGLAEVRRSRRLTVSFICTVANYEYGFFWHFYQDGKIEAEVKLTGILSLGALQPGETRKYGTTIAPGLYAPVHQHFFVARMDMAVDCKPGEAFNQVVEVNLKVEEPGKNNVHNNAFYAEEELLKSELQAMRDCDPLSARHWIVRNTRNVNRTGQLTGFKLVPGSNCLPLAGSEAKFLRRATFLKHNLWVTPYSREEMHPGGEFPNQNPRVGEGLATWVKQNRSLEEADIVLWYVFGVTHVPRLEDWPVMPVERIGFMLMPHGFFNCSPAVDVPPSATDLELKDTDIATKPIQNGIIAKL

SEQ ID NO: 9306 - protein, 797 aa, Ricinus communis
MASTSQKTTSSCCVSKTPTDSSASFLLRREASSAPAPAAPSSTVVANVLQDWIDRPINKGADDNKLPAKNAAVASLIPEPSTTNSTNKGIPVMLRAQTSHPLDPLSAAEISVAVATVRAAGATPEVRDSMRFVEVVLLEPDKQVVALADAYFFPPFQPSLLPRTKGGGPVIPTKLPPRRARLVVYNKRSNETSVWIVELSEVHAVTRGGHHRGKVISSQVIPDVQPPMDAVEYAECEAVVKDFPPFREAMKKRGIDDMELVMVDAWCVGYHSAADAPSKRLAKPLIFCRTESDCPMENGYARPVEGIYVLVDMQNMKVIEFEDRKLVPLPPADPLRNYTPGETRGGVDRSDVKPLQIVQPEGPSFRVNGYFVEWQKWNFRIGFTPREGLVIHSVAYVDGSRGRRPVAHRLSFVEMVVPYGDPNEPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFYWHFYQDGKIEAEVKLTGILSLGALQPGETRKYGTNIAPGLYAPVHQHFFVARINMAVDCKPGEAFNQVVEMDVKVEKPGENNVHNNAFYAEETLLKSELQAMRACNPLTARHWIVRNTRTVNRMGQLTGYKLVPGSNCLPLAGPEAKFLRRAAFLKHNLWVTPYARDEMFPGGEFPNQNPRVAEGLSTWVKQNRSLEETDVVLWYVFGITHVPRLEDWPVMPVERIGFMLMPHGFFNCSPAVDVPPNVCELDIKENDVKENGVAKPLQNGLLAKL

SEQ ID NO: 9307 - protein, 771 aa, Elaeis guineensis
MATTEEKATPCCASAPAGGDGGLRREAAGVVREWTAGEKQTVATAAMSSLIRPVEEIPEPSAKPSTKGLPMMMRAQTKHPLDPLSAAEISVAVATVRAAGATPEVRDSMRFVEVVLLEPEKHVVALADAYFFPPFQPSLLPRTKGGPVIPSKLPARRARLVVYNKQSNETSIWIVELSEVHAATRGGHHRGKVISSEVVPDVQPPMDAVEYAECEAAVKSYPPFIEAMKKRGIEDMDLVMVDAWCAGYHSEADAPSRRLAKPLIFCRTESDCPMENGYARPVEGIHILVDIQNNVIIEFEDRKLVPLPPADPLRNYTPGETRGGVDRSDVKPLHILQPEGPSFRVNGHFVEWQKWNFRIGFTPREGLVIYSVAYIDGSRGRRPIAHRLSFVEMVVPYGDPNEPHYRKNAFDAGEDGLGKNAHSLKKGCDCLGFIKYFDAHFTNYTGGIETIENCVCLHEEDHGILWKHQDWRTGLAEVRRSRRLTVSFICTVANYEYGFFWHFYQDGKIEAEVKLTGILSLGALLPGESRKYGTTIAPGLYAPVHQHFFVARMDMAVDCKPSEAFNQVVEVNVKVEGPGQNNVHNNAFYAEEKLLRSELQAMRDCDPSSARHWIVRNTRTVNRTGQPTGYKLVPGSNCLPLAGPEAKFLRRAAFLKHNLWVTPYNRDEMYPGGEFPNQNPRPNEGLATWVKKNRPLEETDIVLWYIFGVTHIPRLEDWPVMPVERIGFMLMPHGFFNCSPAVDVPPGHSEVEVKDNNGTPKLIQNGLLAKL

SEQ ID NO: 9308 - protein, 769 aa, Medicago truncatula
MASASQKTTSSPSSSCCTPLDSSRLAAVSAAPAVAQSDHVALIRPLDSLPEPSSTNAPTSKGITSMTRPQSSHPLDPLSAAEISVAVATVRAAGATPELRDSMRFIEVVLLEPDKHVVALADAYFFPPFQPSLLPRSKGGPVIPTKLPPRCARLVVYNKKSNETTLWIVELSQVHAVTRGGHHRGKVISSNVVPDVQPPMDAEEYAECEAVVKSFPPFIEAMKKRGIEDMDLVMVDPWCVGYHSEADAPGRRLAKPLLFCRSESDCPMENGYARPVEGIYVLVDMQNMVVIEFEDRKLVPLPPVDPLRNYTPGESRGGSDRSDVKPLQIIQPEGPSFRVNGYYVEWQKWNFRIGFTPKEGLIIYSVAYVDGSRGRRPVAHRLSFVEMVVPYGDPTEPHYRKNAFDAGEDGLGKNAHSLKKGCDCLGYIKYFDAHFTNFTGGVETIENCVCLHEEDHGILWKHQDWRTGLAEVRRSRRLSVSFVCTVANYEYAFFWHFYQDGKIEAEVKLTGILSLGALMPGEVRKYGTMIAPGLYAPVHQHFFVARMDMSVDSRPGEALNQVVEVNMKVEEPGEKNIHNNAFYAEETLLRSELEAMRDCNPLTARHWIVRNTRTGNRTGQLTGYKLVPGSNCLPLAGSEAKFLRRAAFLKHNVWVTAYSRDEMFPGGEFPNQNPRVGEGLATWIKQNRSLEETNIVLWYVFGITHVPRLEDWPVMPVEHIGFMLMPHGFFNCSPAVDVPPNSCEVESKDSDIKDNGASKPIQGGIASKL

SEQ ID NO: 9309 - protein, 784 aa, Citrus sinensis
MASTSKKATLSSFSAQALAQDSVSVSAPRASMVRDWSSDQPPKNAAIASLIRPVDPLAETSLNPSSKGITAMPRPQTSHPLDPLSPAEISVAVATVRAAGPTPEVRDSMRFVEVVLVEPDKNVVALADAYFFPPFQPSLLPRTKGGPVIPSKLPPRRARLVVYNKKSNETSIWIVELSQVHAVTRGGHHRGKVVSSRVVPDIQPPMDAEEYAQCEAAVKAFPPFKEAMKKRGIEDMDLVMVDAWCVGYYSDADAPSRRLAKPLIFCRTESDCPMENGYARPVEGIYVLVDMQNMVVIEFEDRKLVPLPPADPLRNYTRGETRGGVDRSDVKPLQIVQPEGPSFRVNGYFVQWQKWNFRIGFTPREGLVIYSVAYLDGSRGRRSVAHRLSFVEMVVPYGDPNEPHYRKNAFDAGEDGLGKNAHSLKKGCDCLGYIKYFDAHFTNFTGGVETIENCVCLHEEDHGMLWKHQDWRTGFAEVRRSRRLTVSFICTVANYEYGFYWHFYQASGKSYGFCDGKIEAEVKLTGVLSLGALQPGESRKYGTMIAPSLYAPVHQHFFIARMDMEVDCKPGEAFNQVVEVDVKVEKPGGSNVHNNAFYAEETLLKSEMQAMRDCNPLTARHWIVRNTRTVNRTGQLTGYKLVPGSNCLPLAGPDATVFRRAAFLKHNLWVTAYARDEMFPGGEFPNQNPRIGEGLPAWVKQNRPLEESDIVLWYVFGITHVPRLEDWPVMPVERIGFMLMPHGFFNCSPAVDVPPSACELDAKDNDVKDNTVPKPIREGLLAKI

SEQ ID NO: 9310 - protein, 784 aa, Citrus clementina
MASTSKKATLSSFSAQALAQDSVSVSAPRASMVRDWSSDQPPKNAAIASLIHPVDPLAETSLNPSSKGITAMPRPQTSHPLDPLSPAEISVAVATVRAAGPTPEVRDSMRFVEVVLVEPDKNVVALADAYFFPPFQPSLLPRTKGGPVIPSKLPPRRARLVVYNKKSNETSIWIVELSQVHAVTRGGHHRGKVVSSRVVPDIQPPMDAEEYAQCEAAVKAFPPFKEAMKKRGIEDMDLVMVDAWCVGCYSDADAPSRRLAKPLIFCRTESDCPMENGYARPVEGIYVLVDMQNMVVIEFEDRKLVPLPPADPLRNYTRGETRGGVDRSDVKPLQIVQPEGPSFRVNGYFVQWQKWNFRIGFTPREGLVIYSVAYLDGSRGRRSVAHRLSFVEMVVPYGDPNEPHYRKNAFDAGEDGLGKNAHSLKKGCDCLGYIKYFDAHFTNFTGGVETIENCVCLHEEDHGMLWKHQDWRTGFAEVRRSRRLTVSFICTVANYEYGFYWHFYQASGKSYGFCDGKIEAEVKLTGVLSLGALQPGESRKYGTMIAPSLYAPVHQHFFIARMDMEVDCKPGEAFNQVVEVDVKVEKPGGSNVHNNAFYAEETLLKSEMQAMRDCNPLTARHWIVRNTRTVNRTGQLTGYKLVPGSNCLPLAGPDATVFRRAAFLKHNLWVTAYARDEMFPGGEFPNQNPRIGEGLPAWVKQNRPLEESDIVLWYVFGITHVPRLEDWPVMPVERIGFMLMPHGFFNCSPAVDVPPSACELDAKDNDVKDNTVPKPIREGLLAKI

SEQ ID NO: 9311 - protein, 768 aa, Aquilegia formosa
MSITPEKATYCCINNTKKSNLSNLPMLTDQNKQQQEQQQKKVSAMASLINPVESIPEPSTHLPTKDLQIMMRAQSSHPLDPLSAAEISVAVGTVRAAGATPEVRDSMRFIEVVLLEPDKHVVALADAYFFPPFQPSLLPKTKGGPVIASKLPPRRARLVVYNKKSNETSIWIVELSEVHAATRGGHHRGKVISSEIVPDVQPPMDAVEYAECEAVVKDFPPFREAMKKRGIEDMDLVMVDPWCVGYYSDSDAPSRRLAKPLIFCRTESDCPMENGYARPVEGIYIVVDMQNMVVVEFEDRKLVPLPPIDPLRNYTSGETRGGVDRSDVKPLQIIQPEGPSFRVHGHFVEWQKWSFRIGFTPKEGLVLYSVAYTDGCRGRRPVAHRLSFVEMVVPYGDPSEPHYRKNAFDAGEDGLGKNAHSLKKGCDCLGYIKYFDAHFTNFTGGVETTENCVCLHEEDHGMLWKHQDWRTGLAEVRRSRRLTVSFVCTIANYEYGFFWHFYQDGKIEAEVKLTGILSLGALQPGESRKYGTTIAPGLYAPVHQHFFVARMDMAVDCKPGETFNQVVEVNVKVEEPGKNNVHNNAFYAEEELLTSELDAIRDCSPLTARHWIVRNTRTVNRTGQLTGYKLVPGSNCLPLAGSEAKFLRRAAFLKHNLWVTSYAPGEMYPGGEFPNQNPRVGEGLATWVKQNRSLEETNIVLWYVFGVTHIPRLEDWPVMPVEHIGFKLIPHGFFNCSPAIDVPPSSSDLEVKENGVSKPFQNGLLAKL

SEQ ID NO: 9312 - protein, 776 aa, Eutrema parvulum
MASTSKKTTACTHHGGSAPPPKLASAMANTVAGWSEGENQRASKVALESVIRPVDSLPDTAKKPANKGISVMPRTETKHPLDPLSAAEISVAVATVRAAGANPEVRDSMRFIEVASVEPEKHVVALADAYFFPPFQPSLLPRIKAGPVIPMKLPPRRARLVVYNKTSNETSVWIVELSEVHAVTRGGHHRGKVVSSQVIPDVQPPMDAAEYAECEAIVKDFPPFIEAMKRRGIEDMDLVMVDPWCVGYHSESDAPSRRLAKPLIYCRTDSDSPMENGYARPVEGVYVLVDMQNMVVIEFEDRKFVPLPPPDPLRNYTPGETRGGVDRSDLKPLQIIQPEGPSFRVRGYFVEWQKWNFRIGFTPREGLVIHSVAYVDGSRGRRPVAHRLSFVEMVVPYGDPNEPHYRKNAFDAGEDGLGKNAHSLKKGCDCLGSIKYFDAHFTNFTGGVETIENCVCLHEEDHGILWKHQDWRTGLAEVRRSRRLTVSFLCTVANYEYGFYWHFYQDGKIEAEVKLTGILSLGALQPGETRKYGTTIAPGLYAPVHQHFFIARMDMSVDCKPGEAFNQVVEVNARVDEPGENNVHNNAFYAEEKLLKSEAEAMRDCDPFSARHWIVRNTRTVNRTGQLTGYKLVPGSNCLPLARPEAKFLRRAAFLKHNIWVTRYAPEEKFPGGEFPNQNPRAGEGLATWVKQNRSLEESDVVLWYVFGIIHVPRLEDWPVMPVEHIGFTLMPHGFFNCSPAVDVPPNPACELDTKESEVKEVVAPKPLQTGLLSKL

SEQ ID NO: 9313 - protein, 782 aa, Silene vulgaris
MASTSKKASSPSPSVCCSQLNSVSMSVASSAVSAAAAADKVVDKSAVGVSVDQNPVTEVSAQLIRPIDSLSDAAKPKGIPLSLRAQTSHPLDPLSATEIKVAVATVRAAGATPEVRDGMRFIEVVLWEPEKHVVAMADAYFFPPFQPSLLPRIKGRPVIPAKLPPRQARLVVYNKKSNETTLWTVELTEVHATTRSGHHRGKVISSVVVPDVQPPMDAVEYAECEAVVKDYPPFSEAMKKRGIEDMDLVMVDAWCVGYHSEVDSPSRRLAKPLIFCRTESDCPMENGYARPVEGIYILVDMQNMVVVEFEDRKFVPLPPADPLRNYTPGETRGGVDRSDVKPLHILQPEGPSFRVNGHFVEWQKWSFRIGFTPREGLIIHSVAYVDGSRGRRSVAHRLSFVEMVVPYGDPNEPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFYWHFYQDGKIEAEVKLTGILSLGALLPGEVRKYGTTIAPGLYAPVHQHFFVARMDMAVDCKPGEALNQVVELNVKVEDPGKDNVHNNAFYAEEKILKSELQAMRDCNPLTARHWIVRNTRTVNRTGQLTGYKLVPGSNCLPLAGPEAKFLRRAAFLKHNLWVTPYALNEMYPGGEFPNQNPRAGEGLSTWVKQNRSLEEADIVLWYVFGVTHIPRLEDWPVMPVERLGFMLMPHGFFNCSPAVDVPPNTHESDIKESAVVVAKPAQNELIAKL

SEQ ID NO: 9314 - protein, 783 aa, Manihot esculenta
MASTTQKTTPPPSSCCASPSDSASVRLEAATAPSSVVPNAVQDWSDRRLEDQLGEKAAIASLIRPADSLPEPSTNATAKAGIPVMLRAQTRHPLDPLSAAEISVAVATVRAAGATPEVRDGMRFIEVVLLEPDKHVVALADAYFFPPFQPSLLHRTKGGPVIPTKLPPRRARIVVYNKRSNETSKWIVELSEVHAVTRGGHHRGKVISSQVVPDVQPPMDAVEYAECEAVVKDFPPFREAMKKRGIEDMELVMVDAWCVGYHSEADAPSKRLAKPLIFCRTESDCPMENGYARPVEGIYVLVDMQNMKVIEFEDHKLVPLPPADPLRNYTPGETRGGVDRSDVKPLQIVQPEGPSFRINGYFVEWQKWNFRIGFNPREGLVIHSVAYVDGSGGRRPVAHRLSFVEMVVPYGDPNDPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFFWHFYQASWISDGKIEAEVKLTGILSLGAVQPGETRKYGTIIAPGLYAPVHQHFFVARMNMAVDCKPGEALNQVVEVDVKVEKPGENNVHNNAFYAEETLLRSELQAMRDCNPLTARHWIVRNTRTVNRMGQLAGYKLVPGSNCLPLAGPKAKVLRRAAFLKHNLWVTPYARHEMFPGGEFPNQNPRVGEGLATWVKQNRYVFGIIHVPRLEDWPVMPVERIGFMLMPHGFFNCSPAVDVPPNACELDTKDTDIKDNGVAKPLQSGLLAKL

SEQ ID NO: 9315 - protein, 775 aa, Centaurea maculosa
MASASEKATSLLLREVASSSAAAADVVQDWTTDPSVGDQIRHRGTAAAVGELIRPVVNQSSAAATAAKGTGPTSMVRAQTRHPLDPLAAAEISIAVATVRAAGATPEVRDSMRFIEVVLVEPAKSVVALADAYFFPPFQPSLLPRTKGGPIIPTKLPPRQARLIVYNKKSNETSIWIVELSEVHALTRGGHHRGKVISSKVVPDVQPPMDAVEYAECEAIVKDFPPFREAMKRRGIEDMDLVMVDPWCVGYHSEADAPNRRLAKPLIFCRTESDCPMENGYARPVEGIDVLVDMQNMVVIEFKDRKLVPLPPADPLRNYTAGETRGGVDRSDVKPLNIVQPDGPSFRVDGHFVQWQKWNFRIGFTPREGLVIYSVAYVDGSRGRRPVAHRLSFVEMVVPYGDPNDPHYRKNAFDAGEDGLGKNAHSLKKGCDCLGYVKYFDAHLTNFTGGVETIEDCVCLHEEDHGILWKHQDWRTGLAEVRRSRRLVVSFICTVANYEYGFYWYFYQDGKIEAEVKLTGILSLGALQPGEARKYGTMIAPGLYAPVHQHFFVARMDMSVDCKPGESHNQVVELDVKVEGPGDANVHNNAFYAEEKLLKSELEAMRDCNPSSARHWVIRNTRTVNRTGQLTGYKLVPGSNCLPLGGAEAKFLRRAAFLMHNLWVTPYEPNEMFPGGEFPNQNPRVGEGLATWVKQNRSLEETDLVLWYVFGITHVPRLEDWPVMPVEHIGFVLMPHGFFNCSPAVDVPPSSMADLELKENGLVEKACHNGLVSKM

SEQ ID NO: 9316 - protein, 773 aa, Cichorium intybus
MASSSEKATALLLRDVTSSSAADVVQDWTSDPSVGDQIRHRGTATSVGNLIGPVVTQTSAATAAAKGTGPTSMVRMQSRHPLDPLAAAEISIAVATVRAAGATPEVRDSMRFIEVVLVEPSKSVVALADAYFFPPFQPSLLPRTKGGPIIPTKLPPRQARLIVYNKKSNETSIWIVELSEVHALTRGGHHRGKVISSKVVPDVQPPMDAVEYAECEAIVKDFPPFREAMKRRGIEDMDLVMVDPWCVGYHSEADAPNRRLAKPLIFCRTESDCPMENGYARPVEGIDVLVDMQNMVVIEFKDRKLVPLPPADPLRNYTAGETRGGVDRSDVKPLNIVQPDGPSFRVNGHFVQWQKWNFRIGFTPREGLIIYSVAYVDGSRGRRPVAHRLSFVEMVVPYGDPNDPHYRKNAFDAGEDGLGKNAHSLKKGSDCLGYVKYFDAHLTNFTGGVETIEDCVCLHEEDHGILWKHQDWRTGLAEVRRSRRLVVSFICTVANYEYGFYWYFYQDGKIEAEVKLTGILSLGALQPGEARKYGTMIAPGLYAPVHQHFFVARMDMSVDCKPGESHNQVVELDVKVEGPGESNVHNNAFYAEEKLLKTELEAIRDCNPSSARHWVIRNTRTVNRTGQLTGYKLVPGSNCLPLGGAEAKFLRRAAFLMHNLWVTPYVPEEMFPGGEFPNQNPRVGEGLATWVKQNRSLEETDLVLWYVFGITHVPRLEDWPVMPVEHIGFVLMPHGFFNCSPAVDVPPSSLADLEMKENGMVDKPCHNGLVSKM

SEQ ID NO: 9317 - protein, 767 aa, Allium cepa
MATTAEKATVCCNTNNRSNDKSLIKSSGVVDKKGSDVVRAAAAMNSLIGTVDAPPAAKAPASKGIPIMMRAQSSHPLDPLSAAEISVAVATVRAAGKTPEVRDSMRFVEVVLFEPEKSIVALADAYFFPPFQPSLVPRTKGGPVIPSKLPPRRARLVVYNKQSNETSVWIVELNEVHAATRGGHHRGKVISSEVVPDVQPPMDAVEYAECEAVVKEYPPFQDAMKRRGIEDMDLVMVDAWCVGYHSESDAPNRRLAKPLIFCRTESDCAMENGYARPVEGIHVLVDIQHVEIIEFEDKKLVPLPPSDPLRNYTPGETRGGVDRSDVKPLQIIQPEGPSFRVSGHFVEWQKWNFRVGFTPREGLVIYSVAYVDGNRGRRPVAHRLSFVEMVVPYGDPNEPHYRKNAFDAGEDGLGKNAHSLKKGCDCLGYIKYFDAHFTNYTGGVETIENCVCLHEEDHGILWKHQDWRTGLAEVRRSRRLTVSFICTVANYEYGFFWHFYQDGKIEAEVKLTGILSLGALPPGESRKYGTTIAPGLYAPVHQHFFVARMDMAVDCKPNETYNQVVEVNVKVEEPGQNNVHNNAFYAEETLLRSEQQAMRNCDPLAARHWIVRNTRTVNRTGQLTGYKLVPGSNCSPLAGPEAMFLRRAAFLKHNLWVTPYKRDEMYPGGEFPNQNPRQNEGLATWVKKNRSLEETNIVLWYVFGVTHIPRPEDWPVMPVEHIGFMLMPHGFFNCSPAVDVPPSSTDMEMKENGGSKPISNGVLLAKL

SEQ ID NO: 9318 - protein, 775 aa, Brassica oleracea
MASASKTATVCAHGGGGSSKLVSVAADTVAGRSEGEDRRDSSKFGLESVIRPVDSMPDTAKKPATKGISVMPMPRTETKHPLDPLSAAEISVAVATVRAAGANPEVRDSMRFIEVASVEPEKNVVALADAYFFPPFQPSLLPRTKAGPVIPMRLPPRRAKLVVYNKKSNETSVWIVELSEVHAVTRGGHHRGRVVSSEVIPDVQPPMDAAEYAECEAIVKDFPPFIEAMKRRGIDDMDLVMVDPWCVGYHSEADAPSRRLAKPLIYCRTDSDSPMENGYARPVEGIYVLVDMQNMVVIEFEDRKFVPLPPPDPLRNYTPGESRGGVDRSDVKPLQIIQPEGPSFRVRGYFVEWQKWNFRIGFTPREGLVIHSVAYVDGSRGRRPVAHRLSFVEMVVPYGDPNEPHYRKNAFDAGEDGLGKNAHSLKKGCDCLGTIKYFDAHFTNFTGGVETIENCVCLHEEDHGILWKHQDWRTGLAEVRRSRRLTVSFLCTVANYEYGFYWHFYQDGKIEAEVKLTGILSLGALQPGETRKYGTTIAPGLYAPVHQHFFIARMDMSVDCKPGEAFNQVVEVNVRVDEPGENNIHNNAFYAEEKLLRSEAEAMRDCDPFSARHWIVRNTRTVNRTGQLTGYKLVPGSNCLPLARPEAKFLRRAAFLKHNLWVTRYDPGEKFPGGEFPNQNPRSGEGLATWVKQNRSLEESDVVLWYVFGIIHVPRLEDWPVMPVEHIGFTLMPHGFFNCSPAVDVPPNPACELETKDSEVKEVVAAPKPGLLSKL

SEQ ID NO: 9319 - protein, 774 aa, Glycine max
MASVSQKTTSPSSSSCSATNAAAAIPRLAAAPSPAPATAAAVPQDWTAAVTDVPRISSTNASAAKGVVAAMPRAQSSHPLDPLSAAEISVAVATVRAAGSTPELRDSMRFIEIVLLEPDKNVVALADAYFFPPFQPSLLPRARGGPLIPAKLPPRCARLVVYSRKTNETSIWIVELSQVHAVTRGGHHRGKVISSHVVPDVQPPMDAEEYAECEAVVKSFPPFIEAMKKRGIEDMDLVMVDPWCVGYHSEADAPGKRLAKPLIFCRSESDCPMENGYARPVEGIYVLVDMQNMVVLEFEDRKLVPLPPVDPLRNYTPGETRGGSDRSDVKPLQIIQPEGPSFRVNGYFVEWQKWNFRIGFTPKEGLVIYSVAYVDGSHGRRPVAHRLSFVEMVVPYGDPNDPHYRKNAFDAGEDGLGKNAHSLKKGCDCLGYIKYFDAHFTNFTGGVETIENCVCLHEEDHGMLWKHQDWRTGLAEVRRSRRLTVSFICTVANYEYGFFWHFYQDGRIEAEVKLTGILSLGALLPGEFRKYGTMIAPGLYAPVHQHFFVARMDMSVDSKPGEALNQVVEVNMKVEEPGEKNVHNNAFYAEETLLRSELEAMRDCNSLTARHWVVRNTRTCNRTGQLTGYKLVPGSNCLPLAGSEAKFLRRAAFLKHNFWVTTYSRDELFPGGEFPNQNPRVGEGLATWVKQNRSLEETNVVLWYIFGITHVPRLEDWPVMPVERIGFMLTPHGFFNCSPAVDVPPNACEMDSKDNDIKDNGSSKPIQSGLTAKL

SEQ ID NO: 9320 - protein, 776 aa, Chenopodium quinoa
MASTSQKTTSSSSSPICCNSGEIRDSSPSSVVVDRSPVTDDRIVGERQASLIHPVESLPESPTVTAASKAKGASLPWRGRTSHPLDPLSATEIKVAVATVRAAGATPEERDSMRFIEVVLVEPEKLVIAMADAYFFPPFQPSLLPRVKGRPVIPSKLPPRQARLIVYNKKSNETSIWIVELLEIHATTRGGHHKGKVISSKVVPDVQPPMDAVEYAECEAVVKDYPPFREAMKKRGIDDMDLVMVDAWCVGYHSEADSPSRRLAKPLIFCRTESDCPMENGYARPVEGIHVLVDMQNMVLVEFEDKKFVPLPPADPLRNYTPGETRGGVDRSDVKPLHILQPEGPSFRVKGHFVEWQKWSFRVGFTPREGLVIHSVAYVDGSRGRRSVAQRLSFVEMVVPYGDPNEPHYRKNAFDAGEDGLGKNAHSLKKGCDCLGSIKYFDSHFTNFTGGVETIENCVCLHEEDHGILWKHQDWRTGLAEVRRSRRLTVSFICTVANYEYGFYWHFYQDGKIEAEVKLTGILSVGALLPGEVRKYGTTIAPGLYAPVHQHFFVARMDMAVDCKPGEALNQVVELNVKVEEPGKDNVHNNAFYAEEKLLRSELQAVRDCNPLTARHWIVRNTRTVNRTGQLTGYKLMPGSNCLPLAGPEAKFLRRAAFLKHNLWVTQYAPNEMFPGGEFPNQNPRAGEGLASWVKQNRSLEEADVVLWYVFGLTHIPRLEDWPVMPVEHLGFTLMPHGFFNCSPAVDVPPNTHESDMKEANVVGAKPIQNAMIAKL

SEQ ID NO: 9321 - protein, 585 aa, Chrysanthemum coronarium
MVNAKDLLITFINNRWLVFIAAMWIQSCAGIGYLFGSISPVIKSSLNYNQKQVARLGVAKDLGDSVGFLAGSMSEILPLWALLLVGAIQNFVGYGWVWLVVTGKAPMLPLWVMCLLIFIGTNGETYFNTAALVSCVQNFPKSRGPVVGILKGFAGLSGAILTQIYALINSPDKASIIFMVAVGPSMVVIALMFIVRPVGGHRQLRASDASNFSVIYCVCLILASYLMGVMLVEDLVDLKQTIVKIFTAILFVLLVCPIGIPIYLTFSSDRRTPEQEALLSEPQHKEPETSHDPNEIIFSEVEEEKPHDVDLLPASERQKRIAQLQSKLAQAAAEGAVRIKRTRGPHRGEDFDLTQALIKADFWLLFCTLLLGSGSGLTVIDNLGQMSESLGYDNTHIFVSMISIWNFLGRVGGGYVSEIVVRDYAYPRPVALAVAQAIMAIGHLFFAMGWPGAMYIGTLLIGLGYGFHWAIIPATASELFGVKKFGALYNFLTLANPAGSLVFNGLIASHIYDSEAEKQAGLHTSSASYLTKLFDTDDALKCSGSICFFLTYMIMSGLCIIACILSLILVRRTKTVYQNLYGKRT

SEQ ID NO: 9322 - protein, 586 aa, Chrysanthemum coronarium
MGIKAKELLITFINNRWLVFIAAMWIQSCAGIGYLFGSISPVIKSSLNYNQKQVARLGVAKDLGDSVGFLAGSMSEILPLWALLLVGAIQNFVGYGWVWLVVTGKAPVLPLWLMCLLIFIGTNGETYFNTAALVSCVQNFPKSRGPVVGILKGFAGLSGAILTQIYALINSPDKASLIFMVAVGPTMVVIALMFIVRPVGGHRQLRLSDASNFSIIYCICLILAAYLMGVMLVEDLVDLKQTIVKIFTAILFVLLVCPIGIPIYLTFSSDRRTPEQEALLSEPQHKEPETSHDPNEIIFSEVEEEKPHDVDLLPASERQKRIAQLQSKLAQAAAEGAVRIKRTRGPHRGEDFDLTQALIKADFWLLFCTLLLGSGSGLTVIDNLGQMSESLGYDNTHIFVSMISIWNFLGRVGGGYVSEIVVRDYAYPRPVALAVAQAIMAIGHLFFAMGWPGAMYIGTLLIGLGYGFHWAIIPATASELFGVKKFGALYNFLTLANPAGSLVFNGLIASHIYDSEAEKQAGLHTSSASYLTKLFDTDDALKCSGSICFFLTYMIMSGLCIIACILSLILVRRTKTVYQNLYGKRT

SEQ ID NO: 9323 - protein, 586 aa, Chrysanthemum coronarium
MGIKAKELLITFINNRWLVFIAAMWIQSCAGIGYLFGSISPVIKSSLNYNQKQVARLGVAKDLGDSVGFLAGSMSEILPLWALLLVGAIQNFVGYGWVWLVVTGKAPVLPLWLMCLLIFIGTNGETYFNTAALVSCVQNFPKSRGPVVGILKGFAGLSGAILTQVYALINSPDKASLIFMVAVGPTMVVIALMFIVRPVGGHRQLRLSDASNFSIIYCICLILAAYLMGVMLVEDLIDLNETIVQIFTAILFVLLVVPIGIPIYLTFSSDRRTPEQEALLSEPQHKEPETSHDPNEIIFSEVEEEKPHDVDLLPASERQKRIAQLQSKLAQAAAEGAVRIKRTRGPHRGEDFDLTQALIKADFWLLFFTLLLGSGSGLTVIDNLGQMSESLGYDNTHIFVSMISIWNFLGRVGGGYVSEIVVRDYAYPRPVALAVAQAIMAIGHLFFAMGWPGAMYIGTLLIGLGYGFHWAIIPATASELFGLKKFGALYNFLTLANPAGSLVFNGLIASYIYDSEAEKQAQLHTSSASYLTKLFDTDDALKCSGSICFFLTYMIMSGLCIIACILSLILVRRTKSVYQHLYGKRT

SEQ ID NO: 9324 - protein, 345 aa, Cirsium arvense
MCSKLSQKPWSCCRNTKGICRSERCHIDTDICVVNSPDNASLIFMVAVGPFMVIIALMFIVRPVGGHRQIRLLDGSSFSLIYCVCLVLAAYLMGVMLVEDLVDLNETIVQIFTAILFVLIVCPIGIPLWLTFSSDPRTPEEESLLSEPQNKEPERVLEHDPNEIIFSEVEDEKPREVDLLPASERQKRIAQLQSKLAQAAAEGAVRIKRRRGPHRGEDFDLTQALIKADFWLIFVSLLLGSGSGLTVIDNLGQMSQSLGYDNTHIFVSMISIWNFLGRVGGGYFSEIVVKDYAYPRPVAIAVAQAIMAIGHLFFALGWPGAMHSRHPFDRSRLWSSLGYCTGYSL

SEQ ID NO: 9325 - protein, 391 aa, Cichorium intybus
LSFLFLLSISATVHGHNITRILAKHPEFSTFNHYLTITHLANEINRRQTITVCAVDNAAMSSLLSKGLSIQTIKNVLSLHVFADYFGSKKLHQVTKGSTSTATMYQATGEAPGTAGYVHITDVKGGKVRFTPEDNPSQTDTTYVKSILEMPYNISVIQISAILQSPEAEAPTAAPDLNLTSLLQRDGCQAFYDLLTTSGAIGTFLSNADGGVTVFCPGDDAIAAFAPKYKNLTAEGKTSLLLYHGVPTYNSMGMLRSSNGLMNTLATEGANKYDFTVQNDGEDVKLKTKVVTAAITGTVIDEEPVALYKINKVLLPRELFKGAVEADEPAAAPKAAKKKKKAAKKGDDAEAPGPDSSDDYGGGDAADQTANSGRRLVASAGSVLCLALVFV

SEQ ID NO: 9326 - protein, 453 aa, Flaveria ramosissima
MPTDQADLNSDQVLRRDIPWETYMTTKLITGTALQLLRRYDKKTENERAPLLENDGPSYIRVFISILRDIQKEDTVEYVLALIDEMLTANPNRAKLFHDKSLADEDIYEPFLRLLWKGSWFVQEKSSKILTLVVSARSNKNGLTANGEATNSKKKITTSDDVLKGLVEWLCVQLKKPSHPNRSIPASINCLAALLKEPVVRSSFVQADGVKLLVPLISPASTQQSMQLLYETCLCVWLLSYYEPAIEYLATSRALPRLLEVVKGSTKEKVVRLIVLTFKNLLSKGTFGAQMVDLGLPQIVQSLKAQAWSDEDLLDALNHLEDGLKDNIKKLSSFDKYKQEVLLGHLDWSPMHKDPSFWRDNITYFEDNDFQTLRVLLTILETSSDPRALAVACFDLSQFIQYHPAGRVIVTDLKAKERVMKLMNHESAEVTKNALLCIQRLFLGAKYASFLQA

SEQ ID NO: 9327 - protein, 453 aa, Flaveria ramosissima
MPTDQADLNSDQVLRRDIPWETYMTTKLITGTALQLLRRYDKKTENERAPLLENDGSSYIRVFISILRDIQKEDTVEYVLALIDEMLTANPNRAKLFHEKSLADEDIYEPFLRLLWKGSWFVQEKSSKILTLVVSARSNKNGLTAKGEATNLKKKITTSDDVLKGLVEWLCVQLKKPSHPNRSIPASINCLAALLKEPVVRSSFVQADGVKLLVPLISPASTQQSMQLLYETCLCVWLLSYYEPAIEYLATSRALPRLLEVVKGSTKEKVVRLIVLTFKNLLSKGTFGAQMVDLGLPQIVQSLKAQAWSDEDLLDALNHLEDGLKDNIKKLSSFDKYKQEVLLGHLDWSPMHKDPSFWRDNITYFEDNDFQTLRVLLTILETSSDPRALAVACFDLSQFIQYHPAGRVIVTDLKAKERVMKLMNHENAEVTKNALLCIQRLFLGAKYASFLQA

SEQ ID NO: 9328 - protein, 451 aa, Flaveria ramosissima
MPTDQAELNSDQVLRRDIPWETYMTTKLITGTALQLLRRYDKKSENERAPLLENDGPSYIRVFINILRDIQKEDTVEYVLALIDEMLTVNPNRAKLFHDKSLADEDIYEPFLRLLWKGSWFIQEKSSKILTLVVSARPNKNGSTANGEGTKKKTASSDDVLKGLVEWLCIQLKKPSHPNRSIPTAINCLATLLKEPIVRSSFVQADGVKLLVPLISPASTQQSIQLLYETCLCVWLLSYYEPAVEYLATSRALPRLLEVVKGSTKEKVVRMIVLTFKNLLSKGTFGAQMVDLGLPQIVQSLKAQAWSDEDLLEALNHLEEGLKDNIKKLSSFDKYKQEVLLGHLDWSPMHKDPNFWRDNITKFEENDFQTLRVLLTILETSSDPRALAVACFDLSQFIQYHPAGRVIVTDLKAKERVMKLMNHENAEVTKNALLCIQRLFLGAKYASFLQV

SEQ ID NO: 9329 - protein, 452 aa, Tragopogon dubius
MPTDQAELNSEQVLRRDIPWETYMTTKLITGTSLQLLRRYDKKSEHDRAQLLDNDGPSYIHVFISILRDIQKEDTVEYVLALIDEMLTSNPKRAKLFHDKSLADEDIYEPFLRLLWKGSWFIQEKSSKILTLTVSARPKQNGLTANGQTDSKKKITASDDVLKGLVEWLCIQLKKPSHPTRSIPASINCLATLLKEPVVRSSFVQADGVKLLVPLISPASTQQSIQLLYETCLCVWLLSYYEPAIEYFSTSRALPRLLEVVKGSTKEKVVRLIVLTFKNLLSKGSFGAQMVDLGLPQIVQSLKAQAWSDEDLLDALNHLEEGLKDNIKKLSSFDKYKQEVLLGHLDWSPMHKDPIFWRDNITNFEENDFQTLRVLLTILETSGDPRALAVACYDLSQFIQYHPAGRIIVTDLKAKERVMKLMNHENAEVTKNALLCIQRLFLGAKYASFLQA

SEQ ID NO: 9330 - protein, 307 aa, Flaveria ramosissima
MPTDQAELNSDQVLRRDIPWETYMTTKLITGTALQLLRRYDKKSENERAPLLENDGPSYIRVFINILRDIQKEDTVEYVLALIDEMLTVNPNRAKLFHDKSLADEDIYEPFLRLLWKGSWFIQEKSSKILTLVVSARPNKNGSTANGEGTKKKTASSDDVLKGLVEWLCIQLKKPSHPNRSIPTAINCLATLLKEPIVRSSFVQADGVKLLVPLISPASTQQSIQLLYETCLCVWLLSYYEPAVEYLATSRALPSVVGGCQRFNKREGCEDDSVDLQKLAFQRNLWSSDGGSWTSTNCSKFESAGLE

SEQ ID NO: 9331 - protein, 144 aa, Flaveria ramosissima
MPTDQAELNSDQVLRRDIPWETYMTTKLITGTALQLLRRYDKKSENERAPLLENDGPSYIRVFINILRDIQKEDTVEYVLALIDEMLTVNPNRAKLFHDKSLADEDIYEPFLRLLWKGSWFIQEKSSKILTLVVSARPNKIGSN

SEQ ID NO: 9332 - protein, 451 aa, Flaveria ramosissima
MPTDQAELNSDQVLRRDIPWETYMTTKLITGTALQLLRRYDKKTENERAPLLENDGPSYIRVFINILRDIQKEDTVEYVLALIDEMLTANPTRAKLFHDKSLADEDIYEPFLRLLWKGSWFIQEKSSKILTLVVSARPNKNDSTANGEGTKKKTTSSDDVLKGLVEWLCIQLKKPSHPNRSIPTAINCLATLLKEPVVRSSFVQADGVKLLVPLISPASTQQSIQLLYETCLCVWLLSYYEPAVEYLATSRALPRLLEVVKGSTKEKVVRMIVLTFKNLLSKGTFGAQMVDLGLPQIVQSLKAQAWSDEDLLEALNHLEEGLKDNIKKLSSFDKYKQEVLLGHLDWSPMHKDPNFWRDNITKFEENDFQTLRVLLTILETSSDPRALAVACFDLSQFIQYHPAGRVIVTDLKAKERVMKLMNHENAEVTKNALLCIQRLFLGAKYASFLQV

SEQ ID NO: 9333 - protein, 451 aa, Flaveria ramosissima
MPTDQAELNSDQVLRRDIPWETYMTTKLITGTALQLLRRYDKKTENERAPLLENDGPSYIRVFINILRDIQKEDTVEYVLALIDEMLTANPTRAKLFHDKSLADEDIYEPFLRLLWKGSWFIQEKSSKILTLVVSARPNKNDPTANGEGTKKKTASSDDVLKGLVEWLCIQLKKPSHPNRSIPTAINCLATLLKEPVVRSSFVQADGVKLLVPLISPASTQQSIQLLYETCLCVWLLSYYEPAVEYLATSRALPRLLEVVKGSTKEKVVRMIVLTFKNLLSKGTFGAQMVDLGLPQIVQSLKAQAWSDEDLLEALNHLEEGLKDNIKKLSSFDKYKQEVLLGHLDWSPMHKDPNFWRDNITKFEENDFQTLRVLLTILETSSDPRALAVACFDLSQFIQYHPAGRVIVTDLKAKERVMKLMNHENAEVTKNALLCIQRLFLGAKYASFLQA

SEQ ID NO: 9334 - protein, 452 aa, Centaurea maculosa
MPTDQAELNSEQVLRRDIPWETYMTTKLITGTSLQLLRRYDKKSENDRAPLLDNDGPSYIKVFISILRDIQKEETVEYVLALIDEMLTANPKRALLFHDKSLADEDIYEPFLRLLWKGSWFIQEKSSKILTLIVSARPKQNGRTANGATDSKKKITSSDDVLKGLVEWLCIQLKKPSHPSRSIPASVNCLATLLKESVVRSSFVQADGVKLLVPLISPASTQQSIQILYETCLCVWLLSYYEPAIEYLATSRALPRLLDVVKGSTKEKVVRLIVLTFKNLLSKGSFGAQMVDLGLPQIVQSLKAQAWSDEDLLDTLNHLEEGLKDNIKKLSSFDKYKQEVLLGHLDWSPMHKDPIFWRDNITNFEENDFQTLRVLLTILETSSDPRALAVACFDLSQFIQYHPAGRVIVTDLKAKERVMKLMNHENAEVTKNALLCIQRLFLGAKYASFLQA

SEQ ID NO: 9335 - protein, 452 aa, Cirsium arvense
MPTDQAELNSEQVLRRDIPWETYMTTKLITGTSLQLLRRYDKKSENDRAPLLDNDGPSYIKVFISILRDIQKEETVEYVLALIDEMLTANPKRAQLFHDKSLADEDIYEPFLRLLWKGSWFIQEKSSKILTLIVSARPKQNGRTANGATDSKKKITSSDDVLKGLVEWLCIQLKKPSHPSRSIPASVNCLATLLKESVVRSSFVQADGVKLLVPLISPASTQQSIQILYETCLCVWLLSYYEPAIEYLATSRALPRLLDVVKGSTKEKVVRLIVLTFKNLLSKGSFGAQMVDLGLPQIVQSLKAQAWSDEDLLDTLNHLEEGLKDNIKKLSSFDKYKQEVLLGHLDWSPMHKDPIFWRDNITNFEENDFQTLRVLLTILETSSDPRALAVACFDLSQFIQYHPAGRVIVTDLKAKERVMKLMNHENAEVTKNALLCIQRLFLGAKYASFLQA

SEQ ID NO: 9336 - protein, 451 aa, Flaveria ramosissima
MPTDQAELNSDQVLRRDIPWETYMTTKLITGTALQLLRRYDKRSENERAPLLENDGPSYIRVFINILRDIQKEDTVEYVLALIDEMLTVNSNRAKLFHDKSLADEDIYEPFLRLLWKGSWFIQEKSSKILTLVVSARPNKNGSTRNGEGTKKKTTSTDDVLKGLVEWLCIQLKKPSHPNRSIPTAINCLATLLKEPVVRSSFVQADGVKLLVPLISPASTQQSIQLLYETCLCVWLLSYYEPAVEYLATSRALPRLLEVVKGSTKEKVVRMIVLTFKNLLSKGTFGAQMVDLGLPQIVQSLKAQAWSDEDLLEALNHLEEGLKDNIKKLSSFDKYKQEVLLGHLDWSPMHKDPNFWRDNITKFEENDFQTLRVLLTILETSSDPRALAVACFDLSQFIQYHPAGRVIVTDLKAKERVMKLMNHENAEVTKNALLCIQRLFLGAKYASFLQV

SEQ ID NO: 9337 - protein, 450 aa, Ambrosia trifida
MPIDQADLTSDKVLRRDIPWETYLTSKLITGKALQQIRRYDKKSENDRAPLLENDGPSYVRMFISMLRDIQKEDTVEYVLALIDDMLTAKPIRAKLFHDKSLADEDVYEPFLRLLWKGSWFIQEKSSKILTLVVSARPNKTANGEATDSKKKITTSDDVLKGLVEWICIQLKKPSHPNLSIPASINCLAALLKEPVIRSSFVQADGVKLLVPLISPATTQQSIQLLYETCLCVWLLSFYEPAIEYLATSRALQRLSEVVKGSTKEKVVRLIVLTFKNLLSRGTFGAQMVELGLPQIVQSLKAQAWSDEDLLDALNHLEQGLKDNIKKLSSFDKYKQEVLLGHLDWSPMHKDTIFWRDNITNFEENDFQTLRVLLTILETSSDPRALAVACFDLSQFIQYHPAGRVIVTDLKAKERVMKLMNHENAEVTKSALLCIQRLFLGAKYASFLQA

SEQ ID NO: 9338 - protein, 452 aa, Centaurea maculosa
MPTDQAELNSEQVLRRDIPWETYMTTKLITGTSLQLLRRYDKKSENDRAPLLDNDGPSYIKVFISILRDIQKEETVEYVLALIDEMLTANPTRALLFHDKSLADEDIYEPFLRLLWKGSWFIQEKSAKILTLIVSARPKQNGRTANGATDSKKKITSSDDVLKGLVEWLCIQLKKPSHPSRSIPASVNCLATLLKESVVRSSFVQADGVKLLVPLISPASTQQSIQILYETCLCVWLLSYYEPAIEYLATSRALPRLLDVVKGSTKEKVVRLIVLTFKNLLSKGSFGAQMVDLGLPQIVQSLKAQAWSDEDLLDTLNHLEEGLKDNIKKLSSFDKYKQEVLLGHLDWSPMHKDPIFWRDNITNFEENDFQTLRVLLTILETSSDPRALAVACFDLSQFIQYHPAGRVIVTDLKAKERVMKLMNHENAEVTKNALLCIQRLFLGAKYASFLQA

SEQ ID NO: 9339 - protein, 453 aa, Cichorium intybus
MPTDQAELNSEQVLRRDIPWETYMTTKLITGTSLQLLRRYDKKTENDRAQLLDNDGPSYIHVFISILRDIQKEDTVEYVLALIDEMLTASPKRAKLFHDKTLADEDIYEPFLRLLWKGSWFIQEKSSKILTFVVSARPKQNGRTANGQSADSKKKITASDDVLKGLVEWLCIQLKKPSHPTRSIPASVNCLATLLKEPVVRSSFVQADGVKLLVPLISPASTQQSIQLLYETCLCVWLLSYYEPAIEYLATSRALPRLLEVVKGSTKEKVVRLIVLTFKNLLSKGTFGAQMVDLGLPQIVQSLKAQAWSDEDLLDALNHLEEGLKDNIKKLSSFDKYKQEVLLGHLDWSPMHKDPIFWRDNITNFEENDFQTLRVLLTILETSGDPRALAVACYDLSQFIQYHPAGRVIVTDLKAKERVMKLMNHENAEVTKNALLCIQRLFLGAKYASFLQA

SEQ ID NO: 9340 - protein, 453 aa, Cichorium intybus
MPTDQAELNSEQVLRRDIPWETYMTTKLITGTSLQLLRRYDKKTENDRAQLLDNDGPSYIHVFISILRDIQKEDTVEYVLALIDEMLTASPKRAKLFHDKTLADEDIYEPFLRLLWKGSWFIQEKSSKILTFVVSARPKQNGRTANGQSGDSKKKITASDDVLKGLVEWLCIQLKKPSHPTRSIPASVNCLATLLKEPIVRSSFVQADGVKLLVPLISPASTQQSIQLLYETCLCVWLLSYYEPAIEYLATSRALPRLLEVVKGSTKEKVVRLIVLTFKNLLSKGTFGAQMVDLGLPQIVQSLKAQAWSDEDLLDALNHLEEGLKDNIKKLSSFDKYKQEVLLGHLDWSPMHKDPIFWRDNITNFEENDFQTLRVLLTILETSGDPRALAVACYDLSQFIQYHPAGRVIVTDLKAKERVMKLMNHENAEVTKNALLCIQRLFLGAKYASFLQA

SEQ ID NO: 9341 - protein, 453 aa, Cichorium intybus
MPTDQAELNSEQVLRRDIPWETYMTTKLITGTSLQLLRRYDKKTENDRAQLLDNDGPSYIHVFISILRDIQKEDTVEYVLALIDEMLTASPKRAKLFHDKTLADEDIYEPFLRLLWKGSWFIQEKSSKILTFVVSARPKQNGRTANGQSGDSKKKITASDDVLKGLVEWLCIQLKKPSHPTRSIPASVNCLATLLKEPVVRSSFVQADGVKLLVPLISPASTQQSIQLLYETCLCVWLLSYYEPAIEYLATSRALPRLLEVVKGSTKEKVVRLIVLTFKNLLSKGTFGAQMVDLGLPQIVQSLKAQAWSDEDLLDTLNHLEEGLKDNIKKLSSFDKYKQEVLLGHLDWSPMHKDPIFWRDNITNFEENDFQTLRVLLTILETSGDPRALAVACYDLSQFIQYHPAGRVIVTDLKAKERVMKLMNHENAEVTKNALLCIQRLFLGAKYASFLQA

SEQ ID NO: 9342 - protein, 160 aa, Flaveria ramosissima
MPTDQAELNSDQVLRRDIPWETYMTTKLITGTALQLLRRYDKKTENERAPLLENDGPSYIRVFINILRDIQKEDTVEYVLALIDEMLTANPTRAKLFHDKSLADEDIYEPFLRLLWKGSWFIQEKSSKILTLVVSARPTKTIQLQMEKAQRRKPHQVMMF

SEQ ID NO: 9343 - protein, 453 aa, Cichorium intybus
MPTDQAELNSEQVLRRDIPWETYMTTKLITGTSLQLLRRYDKKTENDRAQLLDNDGPSYIHVFISILRDIQKEDTVEYVLALIDEMLTASPKRAKLFHDKTLADEDIYEPFLRLLWKGSWFIQEKSSKILTFVVSARPKQNGRTANGQSADSKKKITASDDVLKGLVEWLCIQLKKPSHPTRSIPASVNCLATLLKEPIVRSSFVQADGVKLLVPLISPASTQQSIQLLYETCLCVWLLSYYEPAIEYLATSRALPRLLEVVKGSTKEKVVRLIVLTFKNLLSKGTFGAQMVDLGLPQIVQSLKAQAWSDEDLLDTLNHLEEGLKDNIKKLSSFDKYKQEVLLGHLDWSPMHKDPIFWRDNITNFEENDFQTLRVLLTILETSGDPRALAVACYDLSQFIQYHPAGRVIVTDLKAKERVMKLMNHENAEVTKNALLCIQRLFLGAKYASFLQA

SEQ ID NO: 9344 - protein, 465 aa, Flaveria ramosissima
MPTDQADLSSDQVLRRDIPWETYMTTKLITGTALQLLRRYDKKTENERAPLLENDGPSYIRVFISILRDIQKEDTVEYVLALIDEMLTVKPNRAKLFHDKSLADEDIYEPFLRLLWKGSWFIQEKSSKILTLVVSARSNKNGSTANGEATNSKKKITTSDDVLKGLVEWLCIQLKKPSHPNRSIPASINCLAALLKEPVVRSSFVQADGVKLLVPLISPASTQQSIQLLYETCLCVWLLSYYEPAIEYLATSRALPRLLEVVKGSTKEKVVRLIVLTFKNLLSKGTFGAQMVDLGLPQIVQSLKAQAWSDEDLLDALNHLEDGLKDNIKKLSSFDKYKQEVLLGHLDWSPMHKDPSFWRENITYFEDNDFQTLRVLLTILETSSDPRALAVACFDLSQFIQYHPAGRVIVTDLKAKERVMKLMNHENAEVTKNALLCIQRLFLGAKYASFCKHNMHLLETWTLLC

SEQ ID NO: 9345 - protein, 450 aa, Cirsium arvense
MDQAELNSEQVLRRDIPWETYMTTKLITGTSLQLLRRYDKKSENDRAPLLDNDGPSYIHVFISILRDIQKEETVEYVLALIDEMLTANPKRALLFHDKSLADDDIYEPFLRLLWKGSWFIQEKSSKILTLVVSARPKQNGRTNGGATDSKKKTTTSDDVLKGLVEWLCIQLKKPSHPSRSIPASVNCLATLLKESVVRSSFVQADGVKLLVPLISPASTQQSIQILYETCLCVWLLSYYEPAIEYLATSRALPRLLEVVKGSTKEKVVRLIVLTFKNLLAKGSFGAQMVDLGLPQIVQSLKAQAWSDEDLLDTLNHLEEGLKDNIKKLSSFDKYKQEVLLGHLDWSPMHKDPIFWRDNITNFEENDFQTLRVLLTILETSSDPRALAVACFDLSQFIQYHPAGRIIVTDLKAKERVMKLMNHENAEVTKNALLCIQRLFLGAKYASFLQV

SEQ ID NO: 9346 - protein, 451 aa, Helianthus annuus
MPTDQAELNSDQVLRRDIPWETYMTTKLITGTALQLLRRYDKKSENERAPLLENDGASYIRVFINILRDIQKEDTVEYVLALIDEMLTANPKRAKLFHDKSLEDEDIYEPFMRLLGKGSWFIQEKSSKILTLVVSARSNKNGSIANGEGSKKKGTSSDDVLKGLVDWLCIQLKKPSHPNRSIPSAVNCLATLLKEPVVRSAFVQADGVKLLVPLISPASTQQSIQLLYETCLCVWLLSYYEPAIEYLATSRALPRLLEVVKGSTKEKVVRLIVLTFKNLLAKGTFGAQMVDIGLPQVVQSLKAQAWSDEDLLDALNHLDEGLKDNIKKLSSFDKYKQEVLLGHLDWSPMHKDPNFWRENITRFEENDFQTLRVLLTILETSSDPRALAVACFDLSQFIQYHPAGRVIVTDLKAKERVMKLMNHENAEVTKNALLCIQRLFLGAKYASFLQV

SEQ ID NO: 9347 - protein, 163 aa, Flaveria ramosissima
MVDLGLPQVVQSLKAQAWSDEDLLEALNHLEEGLKDNIKKLSSFDKYKQEVLLGHLDWSPMHKDPNFWRDNITKFEENDFQTLRVLLTILETSSDPRALAVACFDLSQFIQYHPAGRVIVTDLKAKERVMKLMNHENAEVTKTPYSASKGFSLVPSMQAFCRS

SEQ ID NO: 9348 - protein, 81 aa, Flaveria ramosissima
MPTDQAELNSDQVLRRDIPWETYMTTKLITGTALQLLRRYDKRSENERAPLLENDGPSYIRVLSASCVTYRKRTLLNMCWL

SEQ ID NO: 9349 - protein, 62 aa, Ambrosia trifida
RSRPHTHKLTRDLPLFSSMPMDQAELNSDQVLRRDIPWETYMTTKLITGTALQLLRRYRQKN

SEQ ID NO: 9350 - protein, 451 aa, Chrysanthemum coronarium
MDQAELNSDQVLRRDIQWETYMTTKLITGTSLQLLRRYDKKTETERASLLENDGPSYIRVFISILRDIQKEDTVEYVLALIDEMLTADPKRAKLFHDKSLADEDIYEPFLRLLWKGSWFIQEKSSKILTLVVSARPKQNGSSANGEPADSKKKITASSDVLKGLVEWLCIQLKKPSHPSRSIPASVTCLSTLLKEPIVRSSFVQADGVKLLVPLISPASTQQSIQLLYETCLCVWLLSYYEPAIEYLATSRALPRLLEVVKGSTKEKVVRLIVLTFKNLLVKGTFGAQMVDLGLPQIVQSLKAQAWSDEDLLDALNHLEEALKDNIKRLSSFEKYKQEVLLGHLDWSPMHKDPNFWRDNITNFEENDFQTLRVLLTILDTSSDPRALAVACYDLSQFIQYHPAGRVIVTDLKAKERVMKLMNHENAEVTKNALLCIQRLFLGAKYASFLQV

SEQ ID NO: 9351 - protein, 451 aa, Chrysanthemum coronarium
MDQAELNSDQVLRRDIQWETYMTTKLITGTSLQLLRRYDKKTETERASLLENDGPSYIRVFISILRDIQKEDTVEYVLALIDEMLTADPKRAKLFHDKSLADEDIYEPFLRLLWKGSWFIQEKSSKILTLVVSARPKQYGSSANGESADSKKKITASSDVLKGLVEWLCIQLKKPSHPSRSIPASVTCLSTLLKEPIVRSSFVQADGVKLLVPLISPASTQQSIQLLYETCLCVWLLSYYEPAIEYLATSRALPRLLEVVKGSTKEKVVRLIVLTFKNLLVKGTFGAQMVDLGLPQIVQSLKAQAWSDEDLLDALNHLEEALKDNIKRLSSFEKYKQEVLLGHLDWSPMHKDPNFWRDNITNFEENDFQTLRVLLTILDTSSDPRALAVACYDLSQFIQYHPAGRVIVTDLKAKERVMKLMNHENAEVTKNALLCIQRLFLGAKYASFLQV

SEQ ID NO: 9352 - protein, 451 aa, Chrysanthemum coronarium
MDQAELNSDQVLRRDIQWETYMTTKLITGTSLQLLRRYDKKTETERASLLENDGPSYIRVFISILRDIQKEDTVEYVLALIDEMLTADPKRAKLFHDKSLADEDIYEPFLRLLWKGSWFIQEKSSKILTLVVSARPKQNGSSANGEPADSKKKITASSDVLKGLVEWLCIQLKKPSHPSRSIPASVTCLSTLLKEPIVRSSFVQADGVKLLVPLISPASTQQSIQLLYETCLCVWLLSYYEPAIEYLATSRALPRLLEVVKGSTKEKVVRLIVLTFKNLLVKGTFGAQMVDLGLPQIVQSLKAQAWSDEDLLDALNHLEEALKDNIKRLSSFEKYKQEVLLGHLDWSPMHKDPNFWRDNITNFEENDFQTLRVLLTILDTSSDPRALAVACYDLSQFIQYHPAGRVIVTDLKAKERVMKLMNHENAEVTKNALLCIQRLFLGAKHASFLQV

SEQ ID NO: 9353 - protein, 451 aa, Chrysanthemum coronarium
MDQAELNSDQVLRRDIQWETYMTTKLITGTSLQLLRRYDKKTESERASLLENDGPSYIRVFISILRDIQKEDTVEYVLALIDEMLTADPKRAKLFHDKSLADEDIYEPFLRLLWKGSWFIQEKSSKILTLVVSARPKQYGSSANGESADSKKKITASSDVLKGLVEWLCIQLKKPSHPSRSIPASVTCLSTLLKEPIVRSSFVQADGVKLLVPLISPASTQQSIQLLYETCLCVWLLSYYEPAIEYLATSRALPRLLEVVKGSTKEKVVRLIVLTFKNLLVKGTFGAQMVDLGLPQIVQSLKAQAWSDEDLLDALNHLEEALKDNIKRLSSFEKYKQEVLLGHLDWSPMHKDPNFWRDNITNFEENDFQTLRVLLTILDTSSDPRALAVACYDLSQFIQYHPAGRVIVTDLKAKERVMKLMNHENAEVTKNALLCIQRLFLGAKYASFLQV

SEQ ID NO: 9354 - protein, 451 aa, Artemisia annua
MDQAELNSDQVLRRDIQWETYMTTKLITGTSLQLLRRYDKKTETERASLLENDGPSYIRVFISILRDIQKEDTVEYVLALIDEMLTADPKRAKLFHDKSLADEDIYEPFLRLLWKGSWFIQEKSSKILTLVVSARPKQYGSGANGESADSKKKITASSDVLKGLVEWLCIQLKKPSHPSRSIPASVNCLSTLLKEPIVRSSFVQADGVKLLVPLIVPASTQQSIQLLYETCLCVWLLSYYEPAIEYLATSRALPRLLEVVKASTKEKVVRLIVLTFKNLLVKGTFGAQMVDLGLPQIVQSLKAQAWSDEDLLDALNHLEEALKDNIKRLSSFDKYKQEVLLGHLDWSPMHKDPNFWRENITAFEENDFQTLRVLLTILDTSSDPRALAVACYDLSQFIQYHPAGRVIVTDLKAKERVMKLMNHENAEVTKNALLCIQRLFLGAKYASFLQV

SEQ ID NO: 9355 - protein, 438 aa, Conyza canadensis
VLRRDIPWETYMNTKLITTTAFQRLRRYDKKSEIDRTPLLENDGPSYIRVFISILRDIQKEDTVEYVLALIDDMLTANPKRAKLFHDKSLADEDIYEPFLRLLWKGSWFIQEKSSKILTLVVSARSKQNGLTLNGDSKKKITSSDDVLKGLVEWFCLQLKKPSHPSRSIPASVNSLATLLKEPVVRSSFVQADGVKLLVPLIAPASTQQSIQLLYETCLCVWLLSYYEPAIEYLATSRALPRLLEVVKGSTKEKVVRLIVLTFKNLLSKGSFGAQMVDLGLPHIVQSLKAQAWSDEDLLDALNHLEEGLKDNIKKLSSFDKYKQEVLLGHLDWSPMHKDAIFWRDNITNFEENDFQTLRVLLTILETSSDPRALAVACFDLSQFIQYHPAGRVIVTDLKAKERVMKLMNHENAEVTKNALLCIQRLFLGAKYASFLQV

SEQ ID NO: 9356 - protein, 268 aa, Chrysanthemum coronarium
MDQAELNSDQVLRRDIQWETYMTTKLITGTSLQLLRRYDKKTETERASLLENDGPSYIRVFISILRDIQKEDTVEYVLALIDEMLTADPKRAKLFHDKSLADEDIYEPFLRLLWKGSWFIQEKSSKILTLVVSARPKQYGSSANGESADSKKKITASSDVLKGLVEWLCIQLKKPSHPSRSIPASVTCLSTLLKEPIVRSSFVKQMGLSYLCHLFLQHPLSSRFSFSMRHASVFGSYPTMNLQLSIWLHLEPCHGCWRLLKVQQKRRL

SEQ ID NO: 9357 - protein, 454 aa, Chrysanthemum coronarium
MDQAELNSDQVLRRDIQWETYMTTKLITGTSLQLLRRYDKKTETERASLLENDGPSYIRVFISILRDIQKEDTVEYVLALIDEMLTADPKRAKLFHDKSLADEDIYEPFLRLLWKGSWFIQEKSSKILTLVVSARPKQYGSSANGESADSKKKITASSDVLKGLVEWLCIQLKKPSHPSRSIPASVNCLATLLKEPIVRSSFVQADGVKLLVPLISPASTQQSIQLLYETCLCVWLLSYYEPAIEYLATSRALPRLLEVVKGSTKEKVVRLIVLTFKNLLVKGTFGAQMVDLGLPQIVQSLKAQAWSDEDLLDALNHLEEALKDNIKRLSSFEKYKQEVLLGHLDWSPMHKDPNFWRDNITNFEENDFQTLRVLLTILDTSSDPRALAVACYDLSQFIQYHPAGRVIVTDLKAKERVMKLMNHENAEVNQNALLCIQRLFLGRQVRKSFAKLMY

SEQ ID NO: 9358 - protein, 462 aa, Arnica chamissonis
MPIDQAELNSDQVLRRDIPWETYMTTKLITGTALQLLRRYDKKTENERAPLLENDGPSYIRVFISILRDIQKEDTVEYVLALVDEMLTAKPSRAKLFHDKSFADEDIYEPFLRLLWKGSWFIQEKSSKILTLVVSARLNKNGLAANREAADSKKKITTSDDVLKGLVEWLCIQLKKPSQPNRSIPASITCLAALLKEPVVRSSFVQADGVKLLVPLISPASTQQSIQLLYETCLCVWLLSYYEPAIEYLATSRALPRLSEVVKSSTKEKVVRLIVLTFKNLLSKGTFGAQMVDLGLPQIVQSLKAQAWSDEDLLDALNHLEEGMKDNIKKLSSFDKYKQEVLLGHLDWSPMHKDPIFWRDNITSFEENDFQTLRVLLTILETSSDPRALAVACFDLSQFIQYHPAGRVIVTDLKAKERVMKLMNHENAEVRKTLYSASKGFSLVPSMQAFCKFNMHLMGVLW

SEQ ID NO: 9359 - protein, 462 aa, Ambrosia trifida
MDQAELNSDQVLKRDIPWETYMTTKLITGTALQLLRRYDKKTENERAQLLENDGPSYIRVFINILRDIQKEDTVEYVLALIDEMLAANPKRAKLFHDKSLEDEDIYEPFMRLLWKGSWFNQEKSSKILSLVVSARSNKNGLTANGEGSKKKITSSDDVLKGLVDWICIQLKKPSHPNRSIPSSINCLATLLKEPVVRSSFVQADGVKLLVPLISPASTQQSIQLLYETCLCVWLLSYYEPAIEYLATSRALPRLIEVVKGSTKEKVVRLIVLTFKNLLSKGTFGAQMVDLGLPQIVQSLKAQAWSDEDLLDALNHLDEGLKDNIKKLSSFDKYKQEVLLGHLDWSPMHKDPNFWRENVTRFEENDFQTLRVLLTILETSSDPRALAVACFDLSQFIQYHPAGRVIVTDLKAKERVMKLMNHENAEVTKNALLCIQRLSLVPSMQAFCRCNHGFSYVYWFPFE

SEQ ID NO: 9360 - protein, 463 aa, Flaveria ramosissima
MPTDQAELNSDQVLRRDIPWETYMTTKLITGTALQLLRRYDKKSENERAPLLENDGPSYIRVFINILRDIQKEDTVEYVLALIDEMLTANPTRAKLFHDKSLADEDIYEPCLRLLWKGSWFIQEKSSKILTLVVSARPNKNDPTANGEGTKKKTSSSDDVLKGLVEWLCIQLKKPSHPNRSIPTAINCLATLLKEPVVRSSFVQADGVKLLVPLISPASTQQSIQLLYETCLCVWLLSYYEPAVEYLATSRALPRLLEVVKGSTKEKVVRMIVLTFKNLLSKGTFGAQMVDLGLPQVVQSLKAQAWSDEDLLEALNHLEEGLKDNIKKLSSFDKYKQEVLLGHLDWSPMHKDPNFWRDNITKFEENDFQTLRVLLTILETSSDPRALAVACFDLSQFIQYHPAGRVIVTDLKAKERVMKLMNHENAEVTKTPYSASKGFSSVPSMQAFCRLNHGPFYVSLVSI

SEQ ID NO: 9361 - protein, 228 aa, Flaveria ramosissima
MQLLYETCLCVWLLSYYEPAIEYLATSRALPRLLEVVKGSTKEKVVRLIVLTFKNLLSKGTFGAQMVDLGLPQIVQSLKAQAWSDEDLLDALNHLEDGLKDNIKKLSSFDKYKQEVLLGHLDWSPMHKDPSFWRDNITYFEDNDFQTLRVLLTILETSSDPRALAVACFDLSQFIQYHPAGRVIVTDLKAKERVMKLMNHENAEVTKNALLCIQRLFLGAKYASFLQA

SEQ ID NO: 9362 - protein, 414 aa, Helianthus annuus
MDQAELNSDQVLRRDIPWETYMTTKLITGTALQLLRRYDKKSENERAPLLENDGASYIRVFINILRDIQKEDTVEYVLALIDEMLTANPKRAKLFHDKSLEDEDIYEPFMRLLGKGSWFIQEKSSKILTLVVSARSNKNGSIANGEGSKKKGTSSDDVLKGLVDWLCIQLKKPSHPNRSIPSAVNCLATLLKEPVVRSAFVQADGVKLLVPLISPASTQQSIQLLYETCLCVWLLSYYEPAIEYLATSRALPRLLEVVKGSTKEKVVRLIVLTFKNLLAKGTFGAQMVDIGLPQVVQSLKAQAWSDEDLLDALNHLDEGLKDNIKKLSSFDKYKQEVLLGHLDWSPMHKDPNFWRENITRFEENDFQTLRVLLTILETSSDPRALAVACFDLSQFIQYHPAGRVIVTDLKAKSA

SEQ ID NO: 9363 - protein, 450 aa, Gossypium hirsutum
MDRAELSTEQVLKRDIPWETYMTTKLISGTGLQLLRRYDNRAESVRAQLLDDDGPAYVQVFVNILRDIFKEETVEYVLALIDEMLTANPKRARLFHDKSLANEDTYEPFLRLLWKGNWFIQEKSCKILALIVSARPKTQDGVVANGENSKKKGTTINDVLKELVEWLCTQLKKPSHPTCGIPTAINCLASLLKEPVVRSSFVQADGVKLLIPLITPASTQQSIQLLYETCLCVWLLSYYEPAIEYLATSRALPRLVDVVRSSTKEKVVRVVVLTFRNLLSKGTFGAQMVDLGLPQIVQSLKAQAWSDEDLLEALNHLEDGLKDNIKKLSSFDKYKQEVLLGHLDWSPMHKDPLFWRDNVSCFEENDFQVLRVLITIMETSSDPRALAVACFDLSQFIQHHPAGRVIVNDLKAKERVMKLMNHDSAEVTKNALLCIQRLFLGAKYASFLQA

SEQ ID NO: 9364 - protein, 450 aa, Gossypium raimondii
MDRAELSTEQVLKRDIPWETYMTTKLISGTGLQLLRRYDNRAESVRAQLLDDDGPAYVQVFVNILRDIFKEETVEYVLALIDEMLTANLKRARLFHDKSLANEDTYEPFLRLLWKGNWFIQEKSCKILALIVSARPKTQDGVVANGENSKKKGTTINDVLKELVEWLCTQLKKPSHPTCGIPTAINCLASLLKEPVVRSSFVQADGVKLLIPLITPASTQQSIQLLYETCLCVWLLSYYEPAIEYLATSRALPRLVDVVRSSTKEKVVRVVVLTFRNLLSKGTFGAQMVDLGLPQIVQSLKAQAWSDEDLLEALNHLEDGLKDNIKKLSSFDKYKQEVLLGHLDWSPMHKDPLFWRDNVSCFEENDFQVLRVLITIMETSSDPRALAVACFDLSQFIQHHPAGRVIVNDLKAKERVMKLMNHDSAEVTKNALLCIQRLFLGAKYASFLQA

SEQ ID NO: 9365 - protein, 450 aa, Gossypium hirsutum
MDRAELSTEQVLKRDIPWETYMTTKLISGTGLQLLRRYDNRAESVRAQLLDDDGPAYVQVFVNILRDIFKEETVEYVLALIDEMLTANLKRARLFHDRSLANEDTYEPFLRLLWKGNWFIQEKSCKILALIVSARPKTQDGVVANGENSKKKGTTINDVLKELVEWLCTQLKKPSHPTCGIPTAINCLASLLKGPVVRSSFVQADGVKLLIPLITPASTQQSIQLLYETCLCVWLLSYYEPAIEYLATSRALPRLVDVVRSSTKEKVVRVVVLTFRNLLSKGTFGAQMVDLGLPQIVQSLKAQAWSDEDLLEALNHLEDGLKDNIKKLSSFDKYKQEVLLGHLDWSPMHKDPLFWRDNVSCFEENDFQVLRVLITIMETSSDPRALAVACFDLSQFIQHHPAGRVIVNDLKAKERVMKLMNHDSAEVTKNALLCIQRLFLGAKYASFLQA

SEQ ID NO: 9366 - protein, 410 aa, Cichorium intybus
MPTDQAELNSEQVLRRDIPWETYMTTKLITGTSLQLLRRYDKKTENDRAQLLDNDGPSYIHVFISILRDIQKEDTVEYVLALIDEMLTASPKRAKLFHDKTLADEDIYEPFLRLLWKGSWFIQEKSSKILTFVVSARPKQNGRTANGQSADSKKKITASDDVLKGLVEWLCIQLKKPSHPTRSIPASVNCLATLLKEPVVRSSFVQADGVKLLVPLISPASTQQSIQLLYETCLCVWLLSYYEPAIEYLATSRALPRLLEVVKGSTKEKVVRLIVLTFKNLLSKGTFGAQMVDLGLPQIVQSLKAQARSDEDLLDTLNHLEEGLKDNIEKLSSFDKYKQEVLLSHLDWSPMHKDPIFWRDNITNFEEHDFQTLRVLLTILETSGDPHAHAVACYDLSQFIQYHPARRVIV

SEQ ID NO: 9367 - protein, 208 aa, Ambrosia trifida
MMSPGINLVMTVIGFTVSTMFILFVCTRLICARIHYVSSRRSFRMSSRSDLNALERGKRGAEPFVGASFPTKKYSDPFFSCSKDAQCIVCLSEYHADDTLRILPSCGHFFHSSCIDIWLQQHCTCPVCRVSLREVFDKKCLMQPMFSSAIRFPSRADDIRRMDPTTDGQPRSTGNVLEARLNNSNIIENGPDGSKSPRNKQFESPSDV

SEQ ID NO: 9368 - protein, 208 aa, Ambrosia trifida
MMSPGINLVMTVIGFTVSTMFIVFVCTRLICARIHYVSSRRSFRMSSGSDLNALERGKRGAEPFVGASFPTKKYSDPFFSCSKDAQCIVCLSEYHADDTLRILPSCGHFFHSSCIDIWLQQHCTCPVCRVSLREVFDKKCLMQPMFSSAIRFPSRADDIRRMDPTTDGQPRSTGNVHEAGPNNSNIIENGPAGSKSLRNKQVESPSDV

SEQ ID NO: 9369 - protein, 208 aa, Flaveria ramosissima
MMSPGINLVMTVIGFTVSTMFIVFVCTRLICARIHYISARRSFRMSSRSDLNALERGVRGAEAFVAANFPTKKYSDPFFSCAKDAQCIVCLSEYHADDTLRILPSCGHFFHSSCIDIWLQQHCTCPVCRVSLREVFDKRCSMQPMFSSAIRFPSRANDSRRMDPTADGQPRSTGNIQEVGLNNSNVNENDPAGSKSPRNKQLESPSGV

SEQ ID NO: 9370 - protein, 208 aa, Flaveria ramosissima
MMSPGINLVMTVIGFTVSTMFIVFVCTRLICARIHYISARRSFRMSSRSDLNALERGVRGAEAFVAANFPTKKYSDPFFSCAKDAQCIVCLSEYHADDTLRILPSCGHFFHSSCIDIWLQQHCTCPVCRVSLREVFDKRCSMQPMFSSAIRFPSRANDSRRMDPTADGQPRSTDNVQEVGLNNSNVNENDPAGSKSPRNKQLESPSGV

SEQ ID NO: 9371 - protein, 208 aa, Flaveria ramosissima
MMSPGINLVMTVIGFTVSTMFIVFVCTRLICARIHYISARRSFRMSSTSDLNALERGVRGAEAFVAANFPTKKYSDPFFSCAKDAQCTVCLSEYHADDTLRILPSCGHFFHSSCIDIWLQQHCTCPVCRVSLREVFDKRCSMQPMFSSAIRFPSRANDSRRMDPTADGQPRSTGNVQEVGLNNSNVNENDPAGSKSPRNKQLESPSGV

SEQ ID NO: 9372 - protein, 208 aa, Flaveria ramosissima
MMSPGINLVMTVIGFTVSTMFIVFVCTRLICARIHYISARRSFRMSSRSDLNALERGARGAEAFVAANFPTKKYSDPFFSCAKDAQCIVCLSEYHADDTLRILPSCGHFFHSSCIDIWLQQHCTCPVCRVSLREVFDKRCSMQPMFSSAIRFPSRANDSRRMDLTTDGQPRSTDNVQEVRLNNSNVNENDPARSKSPRNKQLESPSGV

SEQ ID NO: 9373 - protein, 208 aa, Chrysanthemum coronarium
MMSPGINLVMTVIGFTVSTMFIVFVCTRLICARIHYISSRRSFRMSSRSDLNSLERGARGAEPFVAANFPTKKYSDPFFSCAKDAQCIVCLSEYHADDTLRILPFCGHFFHSSCIDIWLQQHCTCPVCRVSLREMFDRRLSMQPMFSSAVRFSSRSDDSPRMEPTTNSQPRSTDNEQEAGQHNSNVNENSPAGSKNSGNKQFESPSDV

SEQ ID NO: 9374 - protein, 208 aa, Flaveria ramosissima
MISPGINLVMTVIGFTVSTMFIVFVCTRLICARIHYISARRSFRMSSRSDLNALERGVRGAEAFVAANFPTKKYSDPFFSCAKDAQCIVCLSEYHADDTLRILPSCGHFFHSSCIDIWLQQHCTCPVCRVSLREVYDKRCSMQPMFSSAIRFPSRADNNRRMDPTADGQPRSTDNVQEVGLNNSNMNENGPAGSKSPRNKQLESPSCV

SEQ ID NO: 9375 - protein, 202 aa, Flaveria ramosissima
MMSPGINLVMTVIGFTVSTMFIVFVCTRLICARIHYISARRSFRMSSRSDLNALERGVRGAEAFVAANFPTKKYSDPFFSCAKDAQCIVCLSEYHADDTLRILPSCGHFFHSSCIDIWLQQHCTCPVCRVSLREVFDKRCSMQPMFSSAIRFPSRANDSRRIDLTTDGQPRSTDNVQEVGLNNSNVNENDPAGSKSPRNKQL

SEQ ID NO: 9376 - protein, 208 aa, Artemisia annua
MMSPGINLVMTVIGFTVSTMFIVFVCTRLICARIHYISSRRSFRMSSRSDLNSLERGARGAEPFVAANFPTKKYSDPFFSCAKDAQCIVCLSEYHADDTLRILPFCGHFFHSSCIDIWLQQHCTCPVCRVSLREMFDRRYSMQPMPSSAVRFSSRSDESPRMNPTSNTQPRSTDNEQEAGQHNSNVNENSPAGSKKSGNKQFESPSDV

SEQ ID NO: 9377 - protein, 207 aa, Chrysanthemum coronarium
MSPGINLVMTVIGFTVSTMFIVFVCTRLICARIHYISSRRSFRMSSRSDLNSLERGTRGAEPFVAANFPTKKYSDPFFSCAKDAQCIVCLSEYHADDTLRILPFCGHFFHSSCIDIWLQQHCTCPVCRVSLREMFDRRYSMQPMFSSAVRFSSRSNGSPRMDPTTNSQTPSTDNEHEAGQHNSNVNQNSPAGSKNLGNKQFESPSDV

SEQ ID NO: 9378 - protein, 208 aa, Helianthus annuus
MMSPGINLVMTVIGFTVSTMFIVFVCTRLICARIHYISARRSFRMSSRSDLNARERGMRGAESFVAASFPTKKYSDPFFSYAKDAQCIVCLSNYHADDTLRILPSCGHFFHSSCIDIWLQQHCTCPVCRVSLREIFNNPCPLQPMYSSAVRFSSRADDSNRMDPSTESQPRSTDNIQEAGPNSSNINDNGPAGSKKSVSKQFESPSDV

SEQ ID NO: 9379 - protein, 208 aa, Cichorium intybus
MMSPGINLVMTVIGFTVSTMFIVFVCTRLICARIHYISSRRSFRMSSRSDLNVLERGIRGAEPLVAASFPTKKYSDPFFSCAKDAQCIVCLSEYHADDTLRILPFCGHFFHSSCIDIWLQQHCTCPVCRVSLREIFDKRYTMQPMSSSAIRFSSRTDDSRRIDRTTDGQNRSTDTARETEQNNSNVNENNPAGSKNSGSKQSESPSDV

SEQ ID NO: 9380 - protein, 208 aa, Cirsium arvense
MMTPGVNLVMTVIGFTVSTMFIVFVCTRLICARIHYISSRRSFRLSSRSDLNSLERGVRGAEPLVAASFPTKKYSDPFFSCAKDAQCVVCLSDYHADDTLRILPFCGHFFHSSCIDIWLQQHCTCPVCRVSLREMFEKRCLMQPMFSSAVRFSSRADDGRRTDPTTNGQLQSTNNEREVRPDNSNTNENSSGGSKNSVNKSFESPSDV

SEQ ID NO: 9381 - protein, 207 aa, Helianthus annuus
MSPGINLVMTVIGSTVSTMFIVFVCTRLICARIHYISARRSFRMSSRSDLNARERGIRGAESFIAASFPTKKYSDPFFSYAKDAQCIVCLSNYHADDTLRILPSCGHFFHSSCIDIWLQQHCTCPVCRVSLREIFNNPCPLQPMYSSAVRFSSRAADSNRMDPTTESQPRSTDNIQEAGPNSSNTNDNGPAGSKNSVSKQFESPSDV

SEQ ID NO: 9382 - protein, 208 aa, Cirsium arvense
MMTPGVNLVMTVIGFTVSTMFIVFVCTRLICARIHYISSRRSFRLSSRSDLNSLERGLRGAEPLVAASFPTKKYSDPFFSCAKDAQCVVCLSDYQAEDTLRILPFCGHFFHSSCIDIWLQQHCTCPVCRVSLREIFERRCLMQPMFSSAVRFSSRADDSRRTDPTTNGQLQSTDDEQEVRQVNSNTNENSSGGSKNSVNKRFESPSDV

SEQ ID NO: 9383 - protein, 210 aa, Centaurea maculosa
MMTPGVNLVMTVIGFTVSTMFIVFVCTRLICARIHYISSRRSFRLSSRSDLNSLERGVRGAEPLVAASFPTKKYSDPFFSCAKDAQCVVCLSDYHADDTLRILPFCGHFFHSSCIDIWLQQHCTCPVCRVSLREMFEKRCLMQPMFSSAVRFSSRADDGRRTDLTTNGQLQSTINEREVRPDNSNTNTNENSSGGSKNSVNKSFESPSDV

SEQ ID NO: 9384 - protein, 208 aa, Ambrosia trifida
MMSPGVNLVMTVIGFTVSTMFIVFVCTRLICARIHYISARRSFRISSRSDLNARERGMRGAESFVAANFPTKKYSDPFFSYAKDAQCIVCLSNYNADDTLRILPSCGHFFHSSCIDIWLQQHCTCPVCRVSLREIFDNPCSMQPMYSSAVRFSSREDNNHRMDRTTDSQPRSTDNIHEAGSNSSNMNDNGLAGSKNPVNRSFESQSNV

SEQ ID NO: 9385 - protein, 415 aa, Helianthus annuus
MVIASARISTCGSMELAPASFSTRHVGRDCVYLKSTSSQWLKKPPRWFGFSHDKISKFNHSACSVSMVSNNYVGRSTYRIKKDNDDKIYRRLDSCLVIPPPKGKKPKAIIKFLGGAFIGAVPEVTYSYLLGLLANEGYLIISVPYNVTFDHSQAAREVYERFHSCLNSILTSGLPDDGLLAAELVDLPLYSVGHSNGALLQVLTGSYFSDKLPKANAIISYNNRPATEAVPYFEQLGPLVSQLMPVVEASPVSSMAKGAADAWKALLDTAEAMTPDYDPEARVSLDKFVDQLPSVFNQVAQGISEFKPTPTENRECCKNSYNVKKTLLVKFNTDAIDETDLLEETLRPRVEAIGGTLEKVSLSGNHITPCIQEPKLQVGDVYTPADAIAQGLKNLSLHETKVAGRTIADWLSSIG

SEQ ID NO: 9386 - protein, 415 aa, Ambrosia trifida
MVIASTRIGTCGSMELAPASFSTRHVGRDCVYLKSISSPLLQKQPRWFGFSRDRNSTFSHSACSLRMVSNDYVGRSTYRIKKDNDNKLYRRLDSCLVIPPPKGKKPKAIIKFLGGAFIGAVPEVTYSYLLGLLANEGYLIISVPYNVTFDHSQAAREVYERFHSCLNSILTSGLPDDGLLASELVDLPLYSVGHSNGALLQVLSGSYFSDKLPKANAIISYNNRPATEAVPYFEQLGPLVSQLMPVVEASPVSSMAKGAADAWKALLDTAQAMTPDYDPEARVSLDKFVDQLPSVFNQVAQGISEFKPTPTENRECCKNMYNVKKTLLVKFNVDAIDETDLLEETLRPRVEAIGGTLEKVSLNGNHITPCIQEPKLQVGDVYTPADAIAQGLKNLSLNETKIVARTIADWFSSIS

SEQ ID NO: 9387 - protein, 415 aa, Ambrosia trifida
MVITSTRIGACGSMELAPASFSTRHVGRDCVYLKSISSPLLQKQPRWFGFSRDRNSTFSHSACSLRMVSNDYVGRSTYRIKKDNDNKLYRRLDSCLVIPPPKGKKPKAIIKFLGGAFIGAVPEVTYSYLLGLLANEGYLIISVPYNVTFDHSQAAREVYERFHSCLNSILTSGLPDDGLLASELVDLPLYSVGHSNGALLQVLSGSYFSDKLPKANAIISYNNRPATEAVPYFEQLGPLVSQLMPVVEASPVSSMAKGAADAWKALLDTAQAMTPDYDPEARVSLDKFVDQLPSVFNQVAQGISEFKPTPTENRECCKNMYNVKKTLLVKFNVDAIDETDLLEETLRPRVEAIGGTLEKVSLSGNHITPCIQEPKLQVGEVYTPADAIAQGLKNLSLNETKIMARTIVDWFSSIS

SEQ ID NO: 9388 - protein, 404 aa, Echinacea purpurea
MELAPSSFSTRHLRRDCVYLKGLSSQWLQQQRQPRWFGFSRDRISTFNQSACSARMVSNNYVGRNTYRTRKDNDDKIYRRLDSCLVIPPPKGKKPKAIIKFLGGAFIGAVPEVTYSYLLGLLANEGYLIISVPYNVTFDHSQAAREVYERFHSCLNSILTSGLPDDGLLAAELVDLPLYSVGHSNGALLQVLTGSYYSEKLPKANAIISYNNRPATEAVPYFEQLGPLVSQLMPVVEASPVSSMAKGAADAWKALLDTAEAMTPDYDPEARVSLDKFVDQLPSVFNQVAQGISEFKPTPTENRDYCKNSYNVKKTLLVKFNVDAIDETDLLEETLRPRVEAIGGTLEKVTLSGNHITPCIQEPKLQVGDVYTPADAIAQGLKNLSLNETKIMARTIADWFSSIN

SEQ ID NO: 9389 - protein, 402 aa, Flaveria ramosissima
MELAPSSFSRRHVHRDCVYPKSLSSRGLQKQPRWFGFSRDKISNCSYSACSVRMVSNNYVGRNTYRIKKDDNDKIFRRFDSCLVIPPPKGKKPKAIIKFLGGAFIGAVPEVTYSYLLGLLANEGYLIISVPYNVTFDHSQAAREVYEKFHSCLNAILTSGLPNDGLLAAELVDLPLYSVGHSNGALLQVLAGSYFSDKLPKANAIISYNNRPATEAVPYFEQLGPLVSQLMPVVEASPVSSMAKGAADAWKALLDTAQAMTPDYDPEARVSLDKFVDQLPSVFNQVAQGISEFKPTPTENRECCKNSYNVKKTLLVKFNVDAIDETDLLEETLRPRVEAIGGTLEKVSLSGNHITPCIQEPKLQVGDIYTPADAIAQGLKNLSLNETKVVARTIADWFNSIS

SEQ ID NO: 9390 - protein, 404 aa, Echinacea purpurea
MELAPSSFSTRHLRRDCLYHNGLSSQWLQQQKQPRWFSFYRDRIRTFNQSACSARMVSNNYVGRNTYRTKKDNDDKIYRRLDSCLVIPPPKGKKPKAIIKFLGGAFIGAVPEVTYSYLLGLLANEGYLIISVPYNVTFDHSQAAREVYERFHSCLNSILTSGLPDDGLLAAELVDLPLYSVGHSNGALLQVLTGSYYSDKLPKANAIISYNNRPATEAVPYFEQLGPLVSQLMPVVEASPVSSMAKGAADAWKALLDTAEAMTPDYDPEARVSLDKFVDQLPSVFNQVAQGISEFKPTPTENRDYCKNSYNVKKTLLVKFNVDAIDETDLLEETLRPRVEAIGGTLEKVSLSGNHITPCIQEPKLQVGDVYTPADAIAQGLKNLSLNETKIMARTIADWFSSIN

SEQ ID NO: 9391 - protein, 402 aa, Flaveria ramosissima
MELAPSSFSRRHVHRDCVYPKSLSSRGLQKQPRWFGFSRDRISNCGYSPCSVRMVSNNYVGRNTYRIKKDDNDKIFRRFDSCLVIPPPKGKKPKAIIKFLGGAFIGAVPEVTYSYLLGLLANEGYLIISVPYNVTFDHSQAAREVYEKFHSSLNSILTSGLPNDGLLAAELVDLPLYSVGHSNGALLQVLAGSYFSDKLPKANAIISYNNRPATEAVPYFEQLGPLVSQLMPVVEASPVSSMAKGAVDAWKALLDTAQAMTPDYDPEARVSLDKFVDQLPSVFNQVAQGISEFKPTPTENRECCKNSYNVKKTLLVKFNVDAIDETDLLEETLRPRVEAIGGTLEKVSLSGNHITPCIQEPKLQVGDIYTPADAIAQGLKNLSLNETKVVARTIADWFNSIS

SEQ ID NO: 9392 - protein, 401 aa, Flaveria ramosissima
MELAPSSFSCRHVYRDCVYPKVLSSRWLQKQPRWFGFSRDKRTNFSYSACSLRMVSNNYVGRNTYRIKKDNDKIFRRFDSCLVIPPPKGKKPKAIIKFLGGAFIGAVPEVSYSYLLGLLANEGYLIISVPYNVTFDHSQAAREVFEKFHSCLNSILTSGLPNDGLLASELVDLPLYSVGHSNGALLQVLAGSYFSEKLPKANAIISYNNRPATEAVPYFEQLGPLVSQLMPVVEASPVSSMAKGAADAWKALLDTAQAMTPDYDPEARVSLDKFVDQLPSVFNQVAQGISEFKPTPTENRECCKNSYNVKKTLLVKFNVDAIDETDLLEETLRPRVEAIGGTLEKVSLSGNHITPCIQEPKLQVGDIYTPADAIAQGLKNLSLNETKVVARTIADWFSSIS

SEQ ID NO: 9393 - protein, 415 aa, Chrysanthemum coronarium
MAILSTGTSTCGSMELVATSFSPRYTQRDCVDFKSLSTQRQHQRPWWFGFSYDKVRKLGAPGRSLRMISNGYVGRDTYRIKKDNDDKIYRRLDSCLVIPPPKGKKPKAIIKFLGGAFIGAVPEVTYSYLLGLLANEGYLIISVPYNVTFDHSQAAREVFERFHSCLNSVLTYGLPSDGLLAAELADLPLYSVGHSNGALLQVLAGSYFSDKLPKANAIISYNNRPATEAVPYFEQLGPLVSQMMPMVEASPVSSMAKSAADAWKAVLDTAEAMAPDYDPETRVSLDKFVDQLPSVFNQVAQGISEFKPTPTENREFCKNSYNVPKTLLVKFNTDAIDETDLLEETLRPRVEAIGGTLDIVSLSGNHITPCIQDPKLQVGDIYTPADAIAQGLKTLSLNETKILARTIVDWFSSIN

SEQ ID NO: 9394 - protein, 415 aa, Artemisia annua
MAILSTGTSTCGSMELVASSFSPRYTQCDCVQFKSLSTQRQHQQPRWFGFSYDKVRKLGAPGRSLRMISNGYVGRDTYRIKKDNDDKIYRRLDSCLVIPPPKGKKAKAIIKFLGGAFIGAVPEVTYSYLLGLLANEGYLIIVVPYNVTFDHSQAAREVFERFHSCLNSVLTYGLPSDGLLAAELADLPLYSVGHSNGALLQVLAGSYFSDKLPKANAIISYNNRPATEAVPYFEQLGPLVSQMMPMVEASPVSSMAKSAADAWKALLDTAETMAPDYDPETRVSLNKFVDQLPSVFNQVAQGISEFKPTPTENRECCKNSYNVPKTLLVKFNTDAIDETDLLEETLRPRVKAIGGTLDIVSLSGNHITPCIQDPKLQVGDIYTPADAIAQGLKTLSLNETKILARTIADWFSSIN

SEQ ID NO: 9395 - protein, 359 aa, Helianthus annuus
MSTCGSMELAPASFSTRHVGRDCVYLKRKSSQWLKKPPRWFGFSHDKISKFNHSACSVSMVSNNYVGRSTYRIKKDNDDKIYRRLDSCLVIPPPKGKKPKAIIKFLGGAFIGAVPEVTYSYLLGLLANEGYLIISVPYNVTFDHSQAAREVYERFHSCLNSILTSGLPDDGLLAAELVDLPLYSVGHSNGALLQVLTGSYFSDKLPKANAIISYNNRPATEAVPYFEQLGPLVSQLMPVMEASPVSSMAKGAADAWKSLLDTAEAMTPDYDPEARVSLDKFVDQVPSVFNQVAQGISEFKPTPTENRECCKNSYNVKKTLLVKFNTDAIDETDLLEETLRPRVEAIGGTLEKVSLSGNH

SEQ ID NO: 9396 - protein, 416 aa, Centaurea maculosa
MSIVSMGTSTCGSMELAAYSFSPRHAQHDVGYLKSLSSQWQQQRPWRFGFSCHKIRNVDASGHSFRMISNGYVGRDTYKVKKDNDDKIYRRLDSCLVIPPPKGKKPKAIIKFLGGAFIGAVPEVTYSYLLGLLANEGYLIISVPYNVTFDHSRAASEVHERFNSCLNLILTAGLPNDDLLAAELVDLPLYSVGHSNGALLQVLTGSYFSDKIPKANAIISYNNRPATEAVPYFEQLGPLVSQLMPVVEASPVSSMAKGAADAWRVLLDTAEAMTPDYDPEARVSLNKFVDQLPSVFNQVAQGISEFRPTPIENREFCKNSYNVRKTLLVKFNVDAIDETDLLEETLRPRVDAIGGRLDKVSLNGNHITPCIQEPKLQVGDVYTPADAIAQGLKTLSLNETKILARTIADWFSSITE

SEQ ID NO: 9397 - protein, 416 aa, Cirsium arvense
MSIISMGTSTCGSMELAAYSFSPRHTQYDVFCPKSLSSQWQQQRPWRFGFSCHKIRKVDASGRSLRMISNGYVGRETYRVKKDNDDKIYRRLDSCLVIPPPKGKKPKAIIKFLGGAFIGAVPEVTYSYLLGLLANEGYLIISVPYNVTFDHSRAASEVHERFNSCLNLILTAGLPNDDLLAAELVDLPLYSVGHSNGALLQVLTGSYFSDKIPKANAIISYNNRPATEAVPYFEQLGPLVSQLMPVVEASPVSSMAKGAADAWRVLLDTAEAMTPDYDPEARVSLNKFVDQLPSVFNQVAQGISEFRPTPIENREFCKNSYNVRKTLLVKFNVDAIDETDLLEETLRPRVDAIGGRLDKVSLNGNHITPCIQEPKLQVGDVYTPADAIAQGLKTLSLNETKILARTIADWFSSITE

SEQ ID NO: 9398 - protein, 411 aa, Chrysanthemum coronarium
MAILSTGTSTCGSMELVATSFSPRYTQHDCVYFKSLSTQRQHRFGFSYDKVRKLGAPGRSLRMIWNGYVGRDTYRIKKDNDDKIYRRLDSCLVIPPPKGKKPKAIIKFLGGAFIGAVPEVTYSYLLGLLANEGYLIISVPYNVTFDHSQAAREVFERFHSCLNSVLTYGLPSDGLLAAELADLPLYSVGHSNGALLQVLVGSYFSDKLPKANAIISYNNRPATEAVPYFEQLGPLVSQMMPMVEASPVSSMAKSAADAWKAVLDTAEAMAPNYDPETRVSLDKFVDQLPSVFNQVAQGISEFKPTPTENREFCKNSYNVPKTLLVKFNTDAIDETDLLEETLRPRVEAIGGTLDIVSLSGNHITPCIQDPKLQVGDIYTPADAIAQGLKTLSLNETKILARTIVDWFSSIN

SEQ ID NO: 9399 - protein, 416 aa, Cirsium arvense
MAIVSMGTSTCGSMELAAYSFSPRHAQRDVVYPKSLSSQWQQQRPWWFGFSCHKIRNADASGHSLRMISNSYVGRDTYRMKRDTDDKIYRRLDSCLVIPPPKGKKPKAIIQFLGGAFIGAVPEVTYSYLLGLLANEGYLIISVPYNVTFDHSQAASEVYDRFNSCLKLMLTSGLPTDDLLAAELVDLPLYSVGHSNGALLQVLTGSYFSEKIPKANAIISYNNRPATEAVPYFEQLGPLVSQLMPVVEASPVSSMAKGAADAWRVLLDTAEAITPDYDPEARVSLNKFVDQLPSVFNQVAQGISEFRPTPVENREFCKNSYNVEKTLLVKFNVDAIDETDLLEETLKPRVEAIGGTLDKVSLSGNHITPCIQEPKLQVGDVYTPADAIAQGLKTLSLNETKILARTIADWFNSINE

SEQ ID NO: 9400 - protein, 399 aa, Arnica chamissonis
MELAPSLFSPRHRQRDCFYLKSLSSRWMQHRPQGFGYSCDRLQSYDSGRMMISNGYVGIDTYRMKKVNDDKIHRRLDSCLVIPPPNGKKPKAIIKFLGGAFIGAVPEVTYSYLLGLLANEGYLIISVPYNVTFDHSQAAREVYERFHSCLNSILTSGLPSDDLLAADLVNLPLYSVGHSNGALLQVLTGSYFSEKLPKANAIISYNNRPATEAVPYFEQLGPLVSQLMPVVEASPVSSMAKGAADAWKALLDTAEAMTPDYDPEARISLNKFVDQLPSVFNQVAQGISEFKPTPTENRECCRNSYNVQKTLLVKFNVDAIDETDLLEETLRPRVEAIGGTLENISLSGNHITPCIQEPKLQVGDVYTPADAIAQGLKSLSLNETKILARTIADWFSSIN

SEQ ID NO: 9401 - protein, 398 aa, Chrysanthemum coronarium
MELVATSFSPRYTQRDCVYFKSLSTQRQHRFGFSYDKVRKLGAPGRSLRMISNGYVGRDTYRIKKDNDDKIYRRLDSCLVIPPPKGKKPKAIIKFLGGAFIGAVPEVTYSYLLGLLANEGYLIISVPYNVTFDHSQAAREVFERFHSCLNSVLTYGLPSDGLLAAELADLPLYSVGHSNGALLQVLAGSYFSDKLPKANAIISYNNRPATEAVPYFEQLGPLVSQMMPMVEASPVSSMAKSAADAWKTLLDTAEAMAPDYDPETRVSLDKFVDQLPGVFNQVAQGISEFKPTPTENRECCKNSYNVPKTLLVKFNTDAIDETDLLEETLRPRVEAIGGTLDIVSLSGNHITPCIQDPKLQVGDIYTPADAIAQGLKTLSLNETKILARTIVDWFSSIN

SEQ ID NO: 9402 - protein, 415 aa, Chrysanthemum coronarium
MAILSTGTSRCGSMELVASSFSPLHILRDSVYLNSLSSQRKQQRPLWFRYSYDRLSKSGASGRSPRMILNGYVGRDTYRMKKDNDEKMYRRLDSCLVIPPPKGKKPKAIIKFLGGAFIGAVPEVTYGYLLGLLANEGYLIISVPYNVTFDHSQAAREVFERFHSCLNSVLMYGLPSDGLLAAELVDLPLYSVGHSNGALLQVLSGSYFSDKLPKANAIISYNNRPATEAVPYFEQLGPLVSQMMPMVEASPVSSMAKSAADAWKAVLDTAEAMTPNYDPETRVSLNKFVDQLPGVFNQVAQGISEFKPTPSENRECCKNLYNVHKTLLVKFNTDAIDETDLLEETLRPRVEAIGGTLDIVSLSGNHITPCIQDPKLQVGDIYTPADAIAQGLKTLSLNETKILARTIVDWFSSIN

SEQ ID NO: 9403 - protein, 398 aa, Chrysanthemum coronarium
MELVATSFSPRYTQHDCVYFKSLSTQRQHRFGFSYDKVRKLGAPGRSLRMIWNGYVGRDTYRIKKDNDDKIYRRLDSCLVIPPPKGKKPKAIIKFLGGAFIGAVPEVTYSYLLGLLANEGYLIISVPYNVTFDHSQAAREVFERFHSCLNSVLTYGLPSDGLLAAELADLPLYSVGHSNGALLQVLAGSYFSDKLPKANAIISYNNRPATEAVPYFEQLGPLVSQMMPMVEASPVSSMAKSAADAWKAVLDTAEAMAPDYDPETRVSLDKFVDQLPSVFNQVAQGISEFKPTPTENRECCKNSYNVPKTLLVKFNTDAIDETDLLEETLRPRVEAIGGTLDIVSLSGNHITPCIQDPKLQVGDIYTPADAIAQGLKTLSLNETKILARTIVDWFSSIN

SEQ ID NO: 9404 - protein, 415 aa, Chrysanthemum coronarium
MAILSTGTSRCGSMELVASSFSPLHILRDSVYLNSLSSQRKQQRPLWFRYSYDRLSKSGASGRSPRMILNGYVGRDTYRMKKDNDEKMYRRLDSCLVIPPPKGKKPKAIIKFLGGAFIGAVPEVTYGYLLGLLANEGYLIISVPYNVTFDHSQAAREVFERFHSCLNSVLMYGLPSDGLLAAELVDLPLYSVGHSNGALLQVLSGSYFSDKLPKANAIISYNNRPATEAVPYFEQLGPLVSQMMPMVEASPVSSMAKSAADAWKAVLDTAEAMTPNYDPETRVSLNKFVDQLPGVFNQVAQGISEFKPTPSENRECCKNLYNVHKTLLVKFNTDAIDETDLLEETLRPRVEAIGGTLDIVSLSGNHITPCIQDPKLQVGDIYTPADAIAQRLKTLSLNETKILARTIVDWFSSIN

SEQ ID NO: 9405 - protein, 245 aa, Chrysanthemum coronarium
MYGLPSDGLLAAELVDLPLYSVGHSNGALLQVLSGSYFSDKLPKANAIISYNNRPATEAVPYFEQLGPLVSQMMPMVEASPVSSMAKSAADAWKAVLDTAEAMTPNYDPETRVSLNKFVDQLPGVFNQVAQGISEFKPTPSENRECCKNLYNVPKTLLVKFNTDAIDETDLLEETLRPRVEAIGGTLDIVSLSGNHITPCIQDPKLQVGDIYTPADAIAQRLKTLSLNETKILARTIVDWFSSIN

SEQ ID NO: 9406 - protein, 402 aa, Chrysanthemum coronarium
MELVATSFSPRYTQYDRMYFKSLSTQRQHQRPRWFGVSYDKVRKLGAPGRSLRMIWNGYVGRDTYRIKKDNDDKIYRRLDSCLVIPPPKGKKPKAIIKFLGGAFIGAVPEVTYSYLLGLLANEGYLIISVPYNVTFDHSQAAREVFERFHSCLNSVLTYGLPSDGLLAAELADLPLYSVGHSNGALLQVLVGSYFSDKLPKANAIISYNNRPATEAVPYFEQLGPLVSQMMPMVEASPVSSMAKSAADAWKAVLDTAEAMAPDYDPETRVSLDKFVDQLPSVFNQVAQGISEFKPTPTENREFCKNSYNVPKTLLVKFNTDAIDETDLLEETLRPRVEAIGGTLDIVSLSGNHITPCIQDPKLQVGDIYTPADAIAQGLKTLSLNETKILARTIVDWFSSIN

SEQ ID NO: 9407 - protein, 402 aa, Chrysanthemum coronarium
MELVATSFSPRYTQRDCVYFKSLSTQRQHQRPRWFGVSYDKVRKLGAPGRSLRMIWNGYVGRDTYRTKKDNDDKIYRRLDSCLVIPPPKGKKPKAIIKFLGGAFIGAVPEVTYSYLLGLLANEGYLIISVPYNVTFDHSQAAREVFERFHSCLNSVLTYGLPSDGLLAAELADLPLYSVGHSNGALLQVLVGSYFSDKLPKANAIISYNNRPATEAVPYFEQLGPLVSQMMPMVEASPVSSMAKSAADAWKAVLDTAEAMTPNYDPETRVSLDKFVDQLPSVFNQVAQGISEFKPTPTENREFCKNSYNVPKTLLVKFNTDAIDETDLLEETLRPRVEAIGGTLDIVSLSGNHITPCIQDPTLQVGDIYTPADAITQGLKTFSLNETKILARTIVDWFSSFN

SEQ ID NO: 9408 - protein, 409 aa, Centaurea maculosa
MALMELAVFISFSPRHAQRDVIYLKSLSSQWQQQRPWRFGFSCHKIRNVDASGRSLRMISNGYVGRETYRVKKDNDDKIYRRLDSCLVIPPPKGKKPKAIIKFLGGAFIGAVPEVTYSYLLGLLANEGYLIISVPYNVTFDHSQAASEVYERFNSCLNLMLTAGLPNDDLLASELVDLPLYSVGHSNGALLQVLSGSYFSERIPKANAIISYNNRPATEAVPYFEQLGPLVSQLMPVVEASPVSSMAKGAVDAWKVLLDTAEAMTPDYDPEARVSLNKFVDQLPSVFNQVAQGISEFRPTPIENREFCKNSYNVRKTLLVKFNVDAIDETDLLEETLRPRVEAIGGRLDKVSLNGNHITPCIQEPKLQVGDVYTPADAIAQGLKTLSLNETKILARTIADWSAASRVRR

SEQ ID NO: 9409 - protein, 407 aa, Cichorium intybus
MSITSMGTSTCGSMELAASSFTPKNFLSARWQKKQTHWFGFSWDKMCNLKSSSRSLRMISNGYSGRDIYKMKKDNDDKIYRRLDSCLVIPPPKGKKPKAIIKFLGGAFIGAVPEVTYSYLLGLLANEGYLIISVPYNVTFDHSQAAKEVYERFHSCLNSILTSGLPNDDVSPFDLVDLPLYSVGHSNGALLQVLSGSYFTDKIPKANAIISYNNRPATEAVPYFEQLGPLMSQLMPVVEASPVSSMAKGAADAWRVLLDTAEAMTPDYDPETRVSLNKFVDQLPSVFNQVAQGISEFKPTPSENRECCKNSYNVRKTLLVKFNFDAIDETDLLEETLRPRVEAIGGTLDKISLNGNHITPCIQEPKLQVGDVYTPADAIAQGLKTLSLNDTKILATTISDWFTSINN

SEQ ID NO: 9410 - protein, 407 aa, Cichorium intybus
MSITSMGTSTCGSMELAASSFTPKNFLSARWQKKQTHLFRFSWDKMSNFKPSSRSLRMISNGYSGRDIYKMKKDNDDKIYRRLDSCLVIPPPKGKKPKAIIKFLGGAFIGAVPEVTYSYLLGLLANEGYLIISVPYNVTFDHSQAAKEVYERFHSCLNSILTSGLPNDDVSPSELVDLPLYSVGHSNGALLQVLSGSYFTDKIPKANAIISYNNRPATEAVPYFEQLGPLMSQLMPVVEASPVSSMAKGAADAWRVLLDTAEAMTPDYDPETRVSLNKFVDQLPSVFNQVAQGISEFKPTPSENRECCKNSYNVRKTLLVKFNFDAIDETDLLEETLRPRVESIGGTLDKISLNGNHITPCIQEPKLQVGDVYTPADAIAQGLKTLSLNDTKILATTISDWFTSINN

SEQ ID NO: 9411 - protein, 407 aa, Cichorium intybus
MSITSMGTSTCGSMELAASSFTPKNFLSAKWQKKQTHWFKFSWDKMCNLKPSSCSLRTISNGYSGRDIYKMKKDNDDKIYRRLDSCLVIPPPKGKKPKAIIKFLGGAFIGAVPEVTYSYLLGLLANEGYLIISVPYNVTFDHSQAAKEVYERFHSCLNSILTSGLPNDDVSPFDLVDLPLYSVGHSNGALLQVLSGSYFTDKIPKANAIISYNNRPATEAVPYFEQLGPLMSQLMPVVEASPVSSMAKGAADAWRVLLDTAEAMTPDYDPETRVSLNKFVDQLPSVFNQVAQGISEFKPTPSENRECCKNSYNVRKTLLVKFNFDAIDETDLLEDTLRPRVEAIGGTLDKISLNGNHITPCIQEPKLQVGDVYTPADAIAQGLKTLSLNDTKILATTISDWFTSINN

SEQ ID NO: 9412 - protein, 349 aa, Ambrosia trifida
MVSNDYVGRSTYRIKKDNDNKLYRRLDSCLVIPPPKGKKPKAIIKFLGGAFIGAVPEVTYSYLLGLLANEGYLIISVPYNVTFDHSQAAREVYERFHSCLNSIITSGLPDDGLLASELVDLPLYSVGHSNGALLQVLSGSYFSDKLPKANAIISYNNRPATEAVPYFEQLGPLVSQLMPVVEASPVSSMAKGAADAWKALLDTAQAMTPDYDPEARVSLDKFVDQLPSVFNQVAQGISEFKPTPTENRECCKNMYNVKKTLLVKFNVDAIDETDLLEETLRPRVEAIGGTLEKVSLSGNHITPCIQEPKLQVGEVYTPADAIAQGLKNLSLNETKIMARTIVDWFSSIS

SEQ ID NO: 9413 - protein, 600 aa, Arnica chamissonis
MSSYITSSENGRDSAPLLYLSEPLSQSYSSESPILPGNEMMYMNFSSASAGEFSGSLAGNSQQLNTCIDIPSIGVHDSSVVSHQQFLSSIGEPWRDGRNHEMMLMGQMGRQNLQGQGQGQGLSLSLGSHILPAGFQFHSGDYRNPDMGFSSFLSADSDSIKTDVSPYGIRSVSREITDSKYLKAGQQLLDEIVNVGKALKQHNSGKESMDYSKGIDGESKNVTSSNQQESNELSDAEKQDLQNKMTKLISMLEEVDRRYKQYYHQMQTVVSAFDVIVGFGAAKPYTALALQTISRHFRCLRDAISGQIKATQRILGETDSTTNEKGVGISRLRFVDRQLRQQQALQQLGMMQQHTWRPQRGLPETSVSILRAWLFEHFLHPYPKDSDKIMLARQTGLTRSQVSNWFINARVRLWKPMVEEMYKEEAGDDEIESNSSTDIAPKNTIGDRTTSVDQEDMNQSTAASGFDSKSSNQAPGVEIIGTNNDPDFQHMMVRSNIRDEHQRLTAAVYQMPPRFGNGNGGGVSLTLGLQHSEDGNLPPMASHGSHQHSFTDIRSGSNGGADDTGAGSSLGPETVDFNSADSDNQQQGIGSSHLLHDFVA

SEQ ID NO: 9414 - protein, 528 aa, Echinacea purpurea
MSSYIRSSENGTDSAPMHYLREPLPQSYSSEPPILARNEMMYMNYSSPASTEEFSGTLAENSQQLNSCIDIPNTGIHDSSVVSHQQLLSSIGEPWRDGRDHGMMLMDQMGSQNLQGQLSLSLGSRIQPAGIQLHSGDYGNPSMGFSSFLSADSDSIKTDVSPYGMGNVSRAITDSKYLKAAQQLLDEIVNVGKALKQHNSKKESMDYKKEIDGELKNVTSSNQQELNELSAAEKQDLQNKMMKLISMLEEVDRRYKQYYHQMQIVVSAFDVVAGCGAAKPYTSLALQTISSHFRSLRDAINGQIKATHGSLGETDSTTNGKGVGISRLRFVDQQLRQQRALQQLGMMQQHTWRPQRGLPETSVSILRAWLFEHFLHPYPKDSDKIMLARQTGLTRSQVSNWFINARVRLWKPMVEEMYKEEAGDAEMESNSSSEITPKITKAYNKTSVDQEDQNQCTTASGFDSNQAPNVELIGTSNDSDFQHVMVQSNRGGVSLTLGLQHTEDNQQQQQQQQEQRFESSHLLHDFVA

SEQ ID NO: 9415 - protein, 464 aa, Echinacea purpurea
MSSLNYDALNLNLNLKFIFITILLTSINTSALTHQNPKSNSTQINSNSVLVALLDSHYTELSELVEKALLLQTLEQAVSRHNITIFAPNNEALERQMDPEFKRFLLEPGNLKSLQNLLLFHIIPSRVGSNEWSGHHKTLCVDEAENSLPLTRGNSGEKIVGGLAKLTRPDDVTRPDGLIHGIERLLVPRSVQEDFNRRRSLTSISAVLPEGAPVVDPRTHRLKKPAAPVPAGAPPVLPIYDAMAPGPSLAPAPAPGPGGPRHHFDGESQVKDFIQTLLHYGGYNELADILVNLTSLATEMGRLVSEGYVLTVLAPNDEAMAKLTTDQLSDPGAPEQIMYYHLIPEYQTEESMYNSVRRFGKVQYDTLRLPHKVIAEEADGSVKFGSGEESGYLFDPDIYTDGRISVQGIDGVLFPVEEEKEKEKPASKVSPVTAVKVVAKQRRGKLLEVACSMGGVFGRFTSCY

SEQ ID NO: 9416 - protein, 466 aa, Cichorium intybus
MGSPNYGALKLIFFTFLLISVNATALPHQNPKSNSTQINSNSVLVALLDSHYTELSELVEKALLLQTLEEAVSRHNITIFAPNNEALERQMDPEFKRFLLEPGNLKSLQNLLLFHIIPSRVGSKEWPREDFESVAHHKTLCVDEADNHLPLTRGNSGEKIVGGLARVTRPDDVIRPDGLIHGIERLLVPRSVQEDFNRRRSLTSISAVLPEGAPVVDPRTHRLKKPATPVPAGAPPVLPVYDAMAPGPSLAPAPAPGPGGARHHFDGESQVKDFIQTLLHYGGYNELADILVNLTSLATEMGKLVSEGYVLTVLAPNDEAMAKLTTDQLSDPGAPEQIMYYHLIPEYQTEESMYNSVRRFGKVQYDTLRLPHKVVAEEADGSVKFGQGEGSAYLFDPDIYTDGRISVQGIDGVLFPVEETTEKPASKVAPSTVPKVVAKQRRGKLLEVACSIIGAFRQDSYFTSCY

SEQ ID NO: 9417 - protein, 451 aa, Ambrosia trifida
MSSMNYDALHLNPILLLLFTILLTSINATALTNQNAKPNSTQINSNSVLVALLDSHYTELSELVEKALLLQTLEQAVSHHNITIFAPNNEALERNMDPEFKRFLLEPGNLKSLQKLLLFHIIPSRVGSREWPGQDAGSVTHHKTLCVEEPDNRLPLTIGNSGEKIVGGLAKITRPDDVTRPDGLIHGIERLLVPRSVQEEFNRRRSLTSISAVLPEGAPVVDPRTHRLKKPAPVPAGAPPVLPIYDAMAPGPSLAPAPAPGPGGPRHHFDGESQVKDFIQTLLHYGGYNELADILVNLTSLATEMGRLVSEGYVLTVLAPNDEAMAKLTTDQLSDPGAPEQIMYYHLIPEYQTEESMYNSVRRFGKVQYDTLRLPHKVVAEEADGSVKFGSGEGSAYLFDPDIYTDGRISVQGIDGVLFPMEETTEKPVGKVSPATTAKVVAKQKRKSNRL

SEQ ID NO: 9418 - protein, 448 aa, Lactuca sativa
MGSLNYGALNLIFLTFLLITIDSTALPHQNPKSNSTQINSNSVLVALLDSHYTELSELVEKALLLQTLEEAVSRHNITIFAPNNEALERQMDPEFKRFLLEPGNLKSLQNLLLFHIIPSRVGSKEWPRKDFESIAHHKTLCVDEADNHLPLTRGNSGEKIVGGLARVTRPDDVIRPDGLIHGIERLLVPRSVQEDFNRRRSLTSISAVLPEGAPVVDPRTHRLKKPATPVPAGAPPVLPVYDALAPGPSLAPAPAPGPGGPRHHFDGESQVKDFIQTLLHYGGYNELADILVNLTSLATEMGKLVSEGYVLTVLAPNDEAMSKLTTDQLSDPGAPEQIMYYHLVPEYQTEESMYNSVRRFGKVQYDTLRLPHKVVAEEADGSVKFGQGEGSAYLFDPDIYTDGRISVQGIDGVLFPMEEPTEKPASKVAPTTAPKVVAKQRRGSLSYF

SEQ ID NO: 9419 - protein, 454 aa, Lactuca sativa
MDSQIYGALNLIVFFLAINVNALTAQNPKSSSTQINSNSVLVALLDSHYTELSELVEKALLLQTLEQAVSHHNITIFAPNNEALERQMDPEFKRFLLEPRNLKSLQNLLLYHIIPSRVGAKEWPEQEVVHHQTLCVDESDNRLPLTRGNSGEKMVGGLARVVRPDDVIRADGLIHGIERLLVPRSVQEDFNRRRSLSSISAVLPEGAPVVDPRTHRLKKSATPAPAGAPPALPVYDALAPGPSLAPAPAPGPGGPRHHFDGESQVKDFIQTLLHYGGYNELADILVNLTSLATEMGKLVSEGYVLTVLAPNDEAMAKLTTDQLSDPGAPEQIMYYHIIPEYQTEESMYNSVRRFGKVRYDTLRLPHKVVAEEADGSVKFGQGEESAYLFDPDIYTDGRISVQGIDGVLFPVEETTETPSSKVAPTTAPKVVSKQRRGKLMEVACTLAGALGQSC

SEQ ID NO: 9420 - protein, 447 aa, Echinacea purpurea
MGSLNYDAFIPLLFTTFILVQTSIITTALPVQPAQPLQTHINSNSVLVALLDSHYTELSELVEKALLLQTLEQTVSTQNITIFAPDNEALERQMDPEFKRFLLEPRNLKSLQNLLMFHIVPGRVGSGEWSGHHKTLCVDESDNRLPLTRGKTGEKIVNGVAKLTRPDDVIRPDGLIHGIERLLVPRSVQEDFNRRRSLTSISAVLPTGAPEVDPRTHRLKKPAAPVPAGSPPVLPVYDAMAPGPSLAPAPAPGPGGARHHFDGESQVKDFIQTLLHYGGYNELADILVNLTSLATEMGKLVSEGYVLTVLAPNDEAMAKLTTDQLSDPGAPEQIMYYHLIPEYQTEESMYNSVRRFGKVQYDTLRLPHKVMAEEADGSVKFGSGEGSAYLFDPDIYTDGRISVQGIDGVLFPVEETTEKPASKVAPATATKVVAKQRRGKLLEVACS

SEQ ID NO: 9421 - protein, 446 aa, Chrysanthemum coronarium
MSSNKNYDAFVLVTFFITTMLFFNSSTTALTQINSNSVLVALLDSHYTELSELVEKALLLQTLEKTVSFHNITIFAPSNEALERQMDPEFKRFLLEPGNLKSLQSLLLYHIIPGRVGSSEWKGVHKTLLVDGMDSHLPLTMESNEKVVGSARVTRPDDLIRPDGLIHGIERLLVPRSVQEDFNKRRSLTSISAVLPEGAPVVDPRTHRLKKPAPVPAGAPPVLPVYDALAPGPSLAPAPAPGPGGAHRHFDGEAQVKDFIQTLLHYGGYNELADILVNLTSLATEMGKLVSEGYVLTVLAPNDEAMAKLTTDQLSDVGAPEQIMYYHIIPEYQTEESMYNSVRRFGKVSYDSLRLPYKVVAEEADGSVKFGSGDGSAYLFDPDIYTDGRISVQGIDGVLWPEESKEKDVGKAPVAAPKVVAKQRRGKLLEVACSIAGTFGHFTRCY

SEQ ID NO: 9422 - protein, 461 aa, Lactuca sativa
MDFQIYGALGILFFIFYLIPPASINATEIPQQHTKSSSTQINSNSVLVALLDSHYTELSELVEKALLLQTLEEAVSRHNITIFAPSNEALERHLDPEFKRFLLEPGNLKSLQNLLLFHIIPSRVGSKEWPEEDLASVAYETLCVEEAENHLPLTRENSGEKIVVGLAKVIRPDDVIRPDGVIHGIERLLVPRLVQEEFNRRRSLSSISAVLPEGAPVVDPRTNRLKKPATPAPAGAPPALPVYDAMAPGPSLAPAPAPGPGGPRHHFDGENQVKDFIQTLLHYGGYNELADILVNLTSLATEMGKLVSEGYVLTVLAPNDEAMAKLTTDQLSDPGAPEQIIYYHLIPEYQTEESMYNSVRRLGKVQYDTLRLPHKVVAEEGDGSVKFGQGEETAYLFDPDIYTDGRISVQGIDGVLFPFEQTVEKPASKVAPAPPTKKIAAEQKRGVFTVYCLFLLNSNPH

SEQ ID NO: 9423 - protein, 293 aa, Solanum phureja
MEFWGVEVKAGQTLKVKPELFKLIHVSQAAIGEVKDVKEAKYVPLRLTVGDNSYVIGTLSAEDRPQLMFDLVFEKEFELSHGWKNGSVHFIGYTADDPSGDEIDSGDDVFSDEENVLEALNGKLEADVKDVKPDAKKSAPVKDEKNAKVAESKKEAESDEDDSDDEDDSEDDSDVPLGMDGPEGMDFSGDSEDDDDSEEETPKKVEQKKRPAPSPQVAPGSGKKAKQATPDNKSGGKKGPATPFAKQNGKPAFNGNNKPKTQSPKSGGQFSGNKSNNKNFSGQKNFKGKQGRK

SEQ ID NO: 9424 - protein, 289 aa, Solanum tuberosum
MEFWGVEVKAGQTLKVKPELFKLIHVSQAAIGEVKDVKEAKYVPLRLTVGENSYVIGTLSAEDRPQLMFDLVFEKEFELSHGWKNGSVHFIGYTADDPSGDEIDSGDDVFSDEENVLEALNGKLEADVKDVKPDAKKSAPVKDEKNAKVAESKKEAESDEDDSDSEDDSDVPLGMDGPEGMDFSGDSEDDDDSEEETPKKVEQKKRPAPSPKVAPGSGKKAKQATPDNKSGGKKGPATPFAKQNGKPAFNGNNKPKTQSPKSGGQFSGNKSNNKNFSGQKNFKGKQGRK

SEQ ID NO: 9425 - protein, 290 aa, Solanum phureja
MEFWGVEVKAGQTLKVKPELFKLIHVSQAAIGEVKDVKEAKYVPLRLTVGDNSYVIGTLSAEDRPQLMFDLVFEKEFELSHGWKNGSVHFIGYTADDPCGDEIDSGDDVFSAEENVLEALNGKLEADVKDVKPDAKKSAPVKDEKNAKVAESKKEAESDEDDSDDSDDVPLGMEGMDFSGDSEDDDDSEEDDDSEEETPKKVEQKKRPAPSPKVAPGSGKKAKQATLDNKSGGKKGPATPFAKQNGKPAFNGNNKPKPQSPKSGGQFSGNKSNSKNFSGQKNFKGKQGRK

SEQ ID NO: 9426 - protein, 296 aa, Capsicum annuum
MEFWGVEVKAGESLKVKPELFKLIHISQAAIGEVKDVKEAKHVPLRLTVGENSYVIGTLSAEDRPQLMFDLVFEKEFELSHGWKNGSVYFIGYTADDPSTDEIDSGDDAFSDEENVLDALSGKVEADVKDVKTDAKKSELVKDEKNAKVAEPKKEAESDDSDDDDDFEDDSDDEDDSDDDGPLGMDSDGPEGMDLSDDSEEDDDSEDETPKKVEEKKRPAPSPKVAPGSGKKAKQATPDNKSAGKKKGPVTPFGKQNGKPAAANGNNKFQSPKSGNKSNNKNFSGQKNSKGKQGRK

SEQ ID NO: 9427 - protein, 287 aa, Secale cereale
MSAGDGAAVSAVEGKLAELSTSCDLRTLPKRGKSVSARTLNTAQIQLVASHPEVYEPCDDSFALVDALLSDKAQLLTLQPSLCMEVGCGSGYVITSLAIMLRQLGSGTQYMATDINQHAVETTQATLEAHGVHADVIATDIVSGLEKRLAGMVDVIVVNPPYVPTPEEEIGMNGIASSWAGGLNGRQVIDRILPAVRELLSEKGCLYMIALEDNDPLGICHLMNEKGFASRVLLKRCTDEESLYVLKFWQDAAAGANASQSGRSPRAESWLSQLPFKSFWHKNTGSS

SEQ ID NO: 9428 - protein, 286 aa, Avena sativa
MSAGDSAAVSAVEGKLSELSTSCDLRTLPRRGKPASARTLNTAQIPLVASHPEVYEPCDDSFALVDALLSDKAQLLTLQPSLCMEVGCGSGYVITSLAIMLRQLGSGTQYLATDINPHAVDTTQATLEAHGIHADVIATDIMSGLEKRLAGMVDVVVVNPPYVPTPEEEIGIKGIASSWAGGLNGRQVIDRILPAVRELLSEKGCLYMIALEDNDPLGICHLMNEKGFASRVLLKRCTEEESLYVLKFWHDATVSTNASQSGKSPGSESSWLSPFKSFWHKSGNSS

SEQ ID NO: 9429 - protein, 288 aa, Brachypodium distachyon
MSAGDSAAVSAVEGKLAEVSTNSDLKSLPKRGKAASGRTLNTAQIQLVARHPEVYEPCDDSFALVDALLSDKAQLLALQPSLCLEVGCGSGYVVTSLAIMLRQLGSGTHYLATDINQHAVETTQATLEAHGIHADVIATDIVSGLEKRLAGMVDVVVVNPPYVPTPEEEIGIKGIASSWAGGLNGRQVIDRILPAVRELLSERGCMYMIALEDNDPLGICHLMNEKGYASRVLLKRCTEEESLYVLKFWQDPTAGSSASPSAKSPGSESSWISQLPFRSFWQKNNSSS

SEQ ID NO: 9430 - protein, 285 aa, Oryza sativa
MAGGDSAAVSAVEGRLSELSTNSDEKGLPRRGKSLSGRTLNTAQIQLVASHPEVYEPCDDSFALVDALLSDKAQLLTLKPRLCMEIGCGSGYVITSLAIMLRQLGSGTQYLATDINQHAVETTQATLEAHGVHADVIATDIVSGLEKRLHGLVDVVVVNPPYVPTPEEEIESNGIASSWAGGINGRQVIDRILPAVRELLSERGWLYMIALEDNDPLDICHLMNEKGYASRVLLKRCTEEESLYVLKFWQDASTGTNASHAARSPRSESSWLSQLPFRSLWHKNA

SEQ ID NO: 9431 - protein, 253 aa, Festuca arundinacea
KPASARTLNTAQIPLVASHPEVYEPCDDSFALVDALLSDKAQLLALQPSLCLEVGCGSGYVITSLAIMLRQLGSGTQYLATDINQHAVETTQATLEAHGIHADVIATDIVSGLEKRLAGMVDVVVVNPPYVPTPEEEIGIKGIAASWAGGLNGRQVIDRILPAVRELLSEKGCLYMIALEDNDPLGICHLMNEKGFASRVLLKRCTEEESLYVLKFWQDAAVSTNASQSGKSPGSESSWLSPFRSFWHKNSSS

SEQ ID NO: 9432 - protein, 279 aa, Setaria italica
MADGDGAAASGKLTEHSASGAEKGLPRRGKSLSGRTLNTAQIPLVASHPEVYEPCDDSFALVDALLSDKAQLLTLQPRLCMEVGCGSGYVITSLAIMLRQLASGTQYLATDINKHAAETTQATLEAHGVHADVIVTDIVSGLEKHLAGMVDVVVINPPYVPTPEEEIRCKGIASSWAGGLNGRQVIDRILPAVREILSERGWLYMVALEDNDPLDICHLMSEMGYASRVVLKRCTEEESLFVLKFWRDPHTGTSASPKSPKSESWFSQLPFKSLWHKGS

SEQ ID NO: 9433 - protein, 198 aa, Secale cereale
EGLICFPSIYYTCSNISFTFPCVVDGLIQLLLAYLGIPRYEGPEVDPAAAARDARELYRAGEKRLGTDERAFIRVFTERSWAHLAAVADAYHHLYARSLDKAVKSETSGTFELGLLTILRCAECPARYFAKALHKAMKGLGTSDTTLIRVVVTRAEVDMQYIKAEYHKKYKRSLADAIHSETSGNYRTFLLSLVGRDR

SEQ ID NO: 9434 - protein, 222 aa, Secale cereale
MAESDAADGKMANGEVYDDGRAVEVAGGEDTLPAVLRGFVDGVWPPGDGGDPLLRRLRAATCEAAPRLRDASRNSARDLLAWTKQGSGLRAILVISVGTITMISLTGLLIFMSFLLVATANAIIVSVLMSLAAAGGFLALFFACLVAVYVGAVSIAIFVISATVISAIVGVLIATGWIGFFWTIWFAARKSLDLTKHSIGMTTSAVQSYSASRQVKQKPTTD

SEQ ID NO: 9435 - protein, 229 aa, Pseudoroegneria spicata
MAESDAAAGKMAHGEVSDDGRAVEVSDDGRAVEVSAADTLPAVLRSFVDGVWSPGDGADPLLQRLRAASCETAPRLREASRNSARDLLAWTKQGSGLRAILVISVGTITLISLTGLLIFMSFLLVATVNAIIVSVLMSLAAAGGFLALFFACLVAVYVGAVSIAIFVISATVISAIVGVIIATGWIGFFWTIWFAARKSLDLTKHSIGVTTSAVQSYSTSRSAGQKPTD

SEQ ID NO: 9436 - protein, 221 aa, Leymus cinereus x Leymus triticoides
MAESDAAAGKMANGEVSDDGRAVEVSGGEDTLPGVLRSFVDGVWSPGDGGDPLLQRLRAASCETAPRLRDASRNSARDLLAWTKRGSGLRAILVISVGTITLISLTGLLIFMSFLLVATTNAIIVSVLMSLAAAGGFLALFFACLVAVYVGAVSIAIFVISATVISAIVGVMIATGWIGFFWTIWFAARKSLDVTKHSIGMTTSAMQSFSTSRRAGQKATE

SEQ ID NO: 9437 - protein, 219 aa, Lolium multiflorum
MAESGASATKMANGEVSDGRAVDVSGEDTLPGVLRSFVDGVWSPGADGDPLLRRLRTASCDSAPRLREASKNSARDLLAWTKQGSGLRAILVISVGTIMLIALTGLLIFMSFLLVATTNAIVVSVLMSLAAAGGFLALFFACLVAVYVGAVSVAIFVISATVISAIVAVMIATGWIGFFWTIWFAARKSMDLTKHSIGMTTSAMQSYSASRHVREKPAE

SEQ ID NO: 9438 - protein, 771 aa, Brachypodium distachyon
MDTPDRPRAAATNAAAAGFEDSPVFNFINNLSPIPPPKPQASAHNVQLFKSSDLAPVSSIFASPHVNPAKESKLVVRDDPVQLPQDSNSPNSVRTRLGTAIRLIKSKNIVSENCSFTCHLSQAPIDSSINTSISTSNLPQPIQFVGGSAECDKNQNAGGDKDLSTDQECPVEGVFFDHTGIDKMDSSQPGRIVHENQLCEQSRDGFVAYDEDYLATEELNSDMLRLAPPFDAETQLMNGTLNADNAHSGTLLTDGSSGSYINNAAHDPHLYWDGAVDGSAMDYTPQLLPGVCQNQLVSNDQLCNALTEPSNHMPMDQSALSQHMRGTRRRCLFNEKAGAVNKAAKKTSDRHSANTTTPRCKTSSSDHNSKPMKTPPCALPGIGLHLNALATIPKDKIVPYAAQSSTIQASNFPSAVSSSPATSEPNTANEDSSQAIVVANADESGQGSPKKKRHKFDNGDGTSCKRCSCKKSKCLKLYCECFHAGVFCSEPCSCQGCLNKPSNMETVLSTREQIESRNPLAFAPKVIRTSEPGQELGEQSNKTPASARHKRGCNCKKSSCLKKYCECFQGGVGCSISCRCEGCKNAFGRREGVVLLSIEQAKQGSVENIACVKEETSENDNQLVIYQAANPASAENVLTTPSVEDIRPLSALPPSSSKRPRSSTKLIGHSSRLCNSQAPLKTDILLSPFESYAEMVLGDGASDVLKGGSSPQTSVKVVSPNKKRISPPRIGTGLSPICKNGRKLILKSIPSFPSLCGDVNKVDPKTSSPAS

SEQ ID NO: 9439 - protein, 411 aa, Pseudoroegneria spicata
MAAVRARWRLLALPLALFLAIGSPRGLDAAPKPPVPKAISDLREAIVKGLGLQSEELKVSGFDVRDALVGHAVAYEFDMEVGRKVVPVRLLEDVNRWDFVDLPIFRSQADADDTALAEIGRGSFDPTLPPFQLAGPMELWIQDGDDVRLALPHDVEAGTLKKVVLADGAVVTVKGASAVSLRLPLELPLPLNRTTYKGRLSSLLSIARALRGAARSNQKPLMSLRIEGPTSLSSTPSMSPNDKLKLKRLAPGQVELSSRAIPAVTDDEDESPSPGLWPFLSLNASDGSLQGLEELLAKVLGKKAGEKGTFKLVNARASAQTYVKMGFTVEKRIADGEVNWSNLPEWKTKPKKLRAHYEVLARVERGQAIPERIAQVQPFQVDEAMSESMLTGNVSRSKMEVVNPPPVYFTL

SEQ ID NO: 9440 - protein, 411 aa, Secale cereale
MAAARARWRFLALPLALFLAIGSSRGLGAAPKPPVPKAISDLREAIVKGLGFQSEELKVSGFDVRDALVGHAVAYEFDMEVGRKVVPVRLLEDVNRWDFVDLPIFRSQADADDTALAEIGRGSFDPTLPPFQLAGPMELWIQDGDDVRLALPHDVEAGTLKKVVLADGAVVTVKGARAVSLRLPLELPLPLNRTTYKGRLSSLLSIARALRGAARSNQKPLMSLRIEGPTSLSSTPSMSPNDKLKLKRLAPGQVELSSRAIPAVTDDEDESPSPGLWPFLSLNASDGSLQGLEELLAKFLGKKAGEKGTFKLVNARASAQTYVKMGFTVEKRIADGEVNWSNLPEWKTKPKKLRAHYEVLARVERGQAIPERIAQVQPFQVDEAMSESMLTGNVSRSKMEVVNPPPVFFTL

SEQ ID NO: 9441 - protein, 411 aa, Leymus cinereus x Leymus triticoides
MAAARARWRSLALPLALFLAIGSSPGLDAAPKPPVPKAISDLRDAIVNGLGFQSDELKVSGFDVRDALVGHAVAYEFDMEVGRKVVPVRLLEDVNRWDFVDLPIFRSQADADDTALAEIGRGSFDPTLPPFQLAGPMELWIQDGDDVRLALPHDVEAGTLKKVVLADGAVVTVKGARAVSLRLPLELPLPLNRTTYKGRLSSLLSIARALRGAARSNQKPLLSLRIEGPTSLSSTPSMSPNDKLKLKRLAPGQVELSSRAIPAVTDDEDESPSPGLWPLLSLNASDGSLQGLEELLAKVLGKKAGEKGTFKLLNARASAQTYVKMGFTVEKRIADGEVNWSNLPEWKTKPKKLRAHYEVLARVERGQAIPERIAQVQPFQVDEAMSESMLTGNVSRSKMEVVNPPPVYFTL

SEQ ID NO: 9442 - protein, 414 aa, Avena sativa
MAAGRARWRFLALPLALLLAIGSSRGLDPAPKPPVPKAISDLRDAIVKGLGFQSEELKVSGFDVRDALVGQAVAYEFDMEVGKKVVPVRLLEDVSRWDFVDLPIFRTQADADDTALAEIGRGARGSFEPTLPPFQLAGPMELWIQDGDDVRLALPHDVEAGTLKKVVLADGAVVTVKGARAVSLRLPLELPLPLNRTTYKGRLSSLLSIARALRGAARSNQKPLLSLRIEGPTSLSSTPSMSPNDKLKLKRLAPGQVELSSRGIPAVTDDEDEPHNAGLWPLLSLNASEGSLQGLEDLLASVLGKKAGEKGTFKLLNARAAAQTYVKMGFTVEKSVADGEVNWSNLPEWKTKPKKLRAHYEVLARVERGQAIPERIAQVQPFQVEEAMSESMLTGNVSRSKMEVVNPPPVYFTL

SEQ ID NO: 9443 - protein, 414 aa, Avena sativa
MAAGRARWRFLALPLALLLAIGSSRGLDPAPKPPVPKAISDLRDAIVKGLGFQSEELKVSGFDVRDALVGQAVAYEFDMEVGKKVVPVRLLEDVSRWDFVDLPIFRTQADADDTALAEIGRGGRGSFEPTLPPFQLAGPMELWIQDGDDVRLALPHDVEAGTLKKVVLADGAVVTVKGARAVSLRLPLELPLPLNRTTYKGRLSSLLSIARALRGAARSNQKPLLSLRIEGPTSLSSTPSMSPNDKLKLKRLAPGQVELSSRAIPAVTDDEDEPQNAGFWPLLSLNASDGSLQGLEDLLASVLGKKAGEKGTFKLLNARAAAQTYVKMGFTVEKSVADGEVNWSNLPEWKTKPKKLRAHYEVLARVERGQAIPERIAQVQPFQVEEAMSESMLTGNVSRSKMEAVNPPPIYFTL

SEQ ID NO: 9444 - protein, 414 aa, Avena sativa
MAAARARWRFLALPLALLLAIGSSRGLDPAPKPPVPKAISDLRDAIVKGLGFQSEELKVSGFDVRDALVGQAVAYEFDMEVGKKVVPVRLLEDVSRWDFVDLPIFRTQADADDTALAEIGRGGRGSFEPTLPPFQLAGPMELWIQDGDDVRLALPHDVEAGTLKKVVLADGAVVTVKGARAVSLRLPLELPLPLNRTTYKGRLSSLLSIARALRGAARSNQKPLLSLRIEGPTSLSSTPSMSPNDKLKLKRLAPGQVELSSRAIPAVTDDEDEPQNAGFWPLLSLNASDGSLQGLEDLLASVLGKKAGEKGTFKLLNARAAAQTYVKMGFTVEKSVADGEVNWSNLPEWKTKPKKLRAHYEVLARVERGQAIPERIAQVQPFYAEEATSESMLTGNVSRSKMEVVNPPPVYFTL

SEQ ID NO: 9445 - protein, 414 aa, Avena sativa
MAAARARWRFLALPLALLLAIGSSRGLDPAPKPPVPKAISDLRDAIVKGLGFQSEELKVSGFDVRDALVGQAVAYEFDMEVGKKVVPVRLLEDVSRWDFVDLPIFRTQADADDTALAEIGRGGRGSFEPTLPPFQLAGPMELWIQDGDDVRLALPHDVEAGTLKKVVLADGAVVTVKGARAVSLRLPLELPLPLNRTTYKGRLSSLLSIARALRGAARSNQKPLLSLRIEGPTSLSSTPSMSPNDKLKLKRLAPGQVELSSRAIPAVTDDEDEPHNAGFWPLLSLNASDGSLQGLEDLLASVLGKKAGEKGTFKLLNARAAAQTYVKMGFTVEKSVADGEVNWSNLPEWKTKPKKLRAHYEVLARVERGQAIPERIAQVQPFYAEEATSESMLTGNVSRSKMEVINPPPVYFTL

SEQ ID NO: 9446 - protein, 414 aa, Avena sativa
MAAARARWRFLALPLALLLAIGSSRGLDPAPKPPVPKAISDLRDAIVKGLGFQSEELKVSGFDVRDALVGQAVAYEFDMEVGKKVVPVRLLEDVSRWDFVDLPIFRTQADADDTALAEIGRGGRGSFEPTLPPFQLAGPMELWMQDGDDVRLALPHDVEAGTLKKVVLADGAVVTVKGARAVSLRLPLELPLPLNRTTYKGRLSSLLSIARALRGAARSNQKPLLSLRIEGPTSLSSTPSMSPNDKLKLKRLAPGQVELSSRAIPAVTDDEDEPHNAGFWPLLSLNASDGSLQGLEDLLASVLGKKAGEKGTFKLLNARAAAQTYVKMGFTVEKSVADGEVNWSNLPEWKTKPKKLRAHYEVLARVERGQAIPERIAQVQPFYAEEATSESMLTGNVSRSKMEVVNPPPVYFTL

SEQ ID NO: 9447 - protein, 411 aa, Brachypodium distachyon
MAAAQARWRFLAMPLALFLAIGSSNAAPKPPVPKAISDLREAIVKGLGIQSEELRVSGFDVRDALVGQAVAYEFDMEVGRKAMPVRLLEDVNRWDFVDLPIFRSQADADDTALAEFGRGARGSFEPTLPPFQLAGPMELWIQDGDDVRLALPHDVDAGTLKKVVLADGAVVTVKGARAVSLRLPLELPLPLNRTTYKGRLSSLLSIARALRGAARSNQKPLLSLRIEGPTSLSSTPSMSPNNKLKLKRLAPGQVELSSRAIPAVTEDEDESHSTGLWPLLSLNGSDSSLQGLEELLASVLGKKAGEKGTFKLLNARASAQTYVKMGFTVEKSIADGEVNWSDFPEWKTKPKKLRAHYEVLARVERGQAIPERIAQVQPFQVDEAMSESMLNGNVSRSKVEVVNPPPVYFTL

SEQ ID NO: 9448 - protein, 422 aa, Oryza sativa
MAARARWRILALPLALLLAVGSSPGLVRQASSSAAAKPPVPKAISDLREAIVKGLGFQSEELKVSGFDVRDALVGQAVAYEFDIEVGRKVVPVRLLEDVNRWDFVDLPIFRSQADADDTALAEIRRGKSGKRAFDPTLPPFQLAGPMELWIQDGDDVRLALPHDVEAGTLKKVVLSDGAVVTVKGAKAVSLRLPLELPLPLNRTTYKGRLSSLISIAQTLRGAARSNQKPLLSLRIEGPTSLSSTPSMSPNDRLKLKRLAPGQVELSSRAIPAVTDDDGDGSHAAGLWPLLSLNGSDGSLQGFEELLASVLGKKAGEKGTFKLLKARASAQTYVKMGFAVEKRIADGEVNWSNFPEWKTKPKKLRAHYEVLARVEGGQAIPERIAQVQPFEADEAMSESVLTGNVSMSKTEVVHPPPVYFTL

SEQ ID NO: 9449 - protein, 421 aa, Panicum virgatum
MAARARWRLLALPLALFLVAGSARGLAKPEDTAAPKPPVPKAISDLRDAIVKGLGFQAEGLKVSGFDVRDALVGHAVSYEFGIEVGRKVLPVRLLEDVNRWDFVDLPIFRSQADADDTALAEIWRAGKGSIVEPTLPPFQLAGPMELWIQDGDDVRLALPHDVDAGTLKKVVLSDGAVVTVKGARAVSLRLPLELPLPLNRTTYKGRLSSLLSIAQALRGAARSNQKPLLSLRIEGPTSLSSTPSMSPKDKLKLKRLAPGQVELSSRAGAIPAATEDGDESPNTELWPLLSLNGSDGSLQGFEELLASVLGKKAGEKGTFKLLKARASAQTYVKMAFAVEKKLAEGEVNWSNFPEWKTKPKKLRAHYEVLARVEGGQAIPERIAQVQPFQADEATAESVLTGNVTRSKMEIIHPPPVYFTL

SEQ ID NO: 9450 - protein, 421 aa, Sorghum bicolor
MPARARWRLLALPLALFLVAGSAHGLVKPEAAATPKPPVPKAISDLRDAIVKGLGFQAEGLKVSGFDVRDALVGHAVAYEFDIEVGRKVLPVRLLEDVSRWDFVDLPIFRSQADADDTALAEIRRGGRGSVVEPTLPPFQLAGPMELWIQNGDDVRLALPHDVDAGTLKKVVLSDGAVVTVKGARAVSLRLPLELPLPLNRTTYKGRLSSLLSIAQALRGAARSNQKPLLSLRIEGPTSLSSTPSMSPKDKLKLKRLAPGQVELSSRAGPIPAIAEDDDEPHSSGLWPLLSLNGSDGSLQGFEELLASVLGKKAGEKGTFKLLKARASAQTYVKMAFMVEKKLVEGEVNWSNIPEWKTKPKRLRAHYEVLARVEEGQAIPERIAQVQPFQADEAMSESVLTGNVTRSKMEIVHPPPVYFTL

SEQ ID NO: 9451 - protein, 421 aa, Setaria italica
MAARARWRLLALPLALFLVAGSARGLVKPEAAAAPKPPVPKAISDLRDAIVKGLGFQAEGLKVSGFDVRDALVGHAVSYEFDIEVGRKVLPVRLLEDVKRWDFVDLPIFRSQADADDTALAEIWRAGKGSVVEPTLPPFQLAGPMELWIQDGDDVRLALPHDVDAGTLKKVVLSDGAVVTVKGARAVSLRLPLELPLPLNRTTYKGRPSSLLSIAQALRGAARSNQKPLLSLRIEGPTSLSSTPSKSPNDKLKLKRLAPGQVELSSRAGTIPAVTEDEDEPHNTALWPLLSLNGSDGSLQGFEELLASVLGKKAGENGTFKLVKARASAQTYVKMAFAVEKKLVKGETDWSNFPEWKTKPKNLRAHYEVLARVEGSQAIPERIAQVQPFQADEAMSESVLTGNVTRSKMEIVHPPPVYFTL

SEQ ID NO: 9452 - protein, 421 aa, Zea mays
MPARARWRLLALPLALLLVAGSAHGLVKPEAAAAPKPPVPKAISDLRDAIVKGLGFQAEGLKVSGFDVRDALVGHAVAYEFDIEVGRKVLPVRLLEDVSRWDFVDLPIFRSQADADDTALAEIRRTGTGSIVEPTLPPFQLAGPMELWIQNGDDVRLALPHDVDAGTLKKVVLSDGAVVTVKGARAVSLRLPLELPLPLNRTTYKGRLSSLISIAQALRGAARSNQKPLLSLRVEGPVSLSSTPSMSPKDKLKLKRLAPGQVELSSQAGAIPAITEDEDEPHNPGLWPLLSLNGSDGSLQGFEELLASVLGKKAGEKGTFKLLKARASAQTYVKMAFTVEKKLAEGDVNWSNIPEWKTKPKRMRAHYEVLARVEEGQAIPERIAQVQPFQANEAMSESVLTGNVTRSKMEIVHPPPVYFTL

SEQ ID NO: 9453 - protein, 417 aa, Panicum virgatum
MAARARGRLLALFLVAGSARGLAKPEAAAAPKPPVPKAISDLRDAIVKGLGFQAEGLKVSGFDVRDALVGHAVSYEFDIEVGRKVLPVRLLEDVNRWDFVDLPIFRSQADADDTALAEIWRAGKGSIVEPTLPPFQLAGPMELWIQDGDDVRLALPHDVDAGTLKKVVLSDGAVVTVKGARAVSLRLPLELPLPLNRTTYKGRLSSLLSIAQALRGAARSNQKPLLSLRIEGPTSLSSTPSMSPKDKLKLKRLAPGQVELSSRAGAIPAATEDGDESPNTELWPLLSLNGSDGSLQGFEELLASVLGKKAGEKGTFKLLKARASAQTYVKMAFAVEKKLAEGEVNWSNFPEWKTKPKKLRAHYEVLARVEGGQAIPERIAQVQPFQADEATAESVLTGNVTRSKMEIIHPPPVYFTL

SEQ ID NO: 9454 - protein, 370 aa, Avena sativa
AIVKGLGFQSEELMVSGFDVRDALVGQAVAYEFDMEVGKKVVPVRLLEDVSRWDFVDLPIFRTQADADDTALAEIGRGARGSFEPTLPPFQLAGPMELWIQDGDDVRLALPHDVEAGTLKKVVLADGAVVTVKGARAVSLRLPLELPLPLNRTTYKGRLSSLLSIARALRGAARSNQKPLLSLRIEGPTSLSSTPSMSPNDKLKLKRLAPGQVELSSRAIPAVTDDEDEPQNAGFWPLLSLNASDGSLQGLEDLLASVLGKKAGEKGTFKLLNARAAAQTYVKMGFTVEKSVADGEVNWSNLPEWKTKPKKLRAHYEVLARVERGQAIPERIAQVQPFYAEEATSESMLTGNVSRSKMEVVNPPPVYFTL

SEQ ID NO: 9455 - protein, 391 aa, Echinochloa colona
AAAAPKAPVPKAISDLRDAIVKGLGFQAEGLKVSGIDVRDALVGHAVSYEFDIEVGRKVLPVRLLEDVKRWDFVDLPIFRSQADADDTALAEIWRAGKGSVVEPNLPPFQLAGPMELWIQDGDDVRLALPHDVDAGTLKKVVLSDGAVVTVKGARAVSLRLPLELPLPLNRTTYKGRLSSLLSIAQALRGAARSNQKPLLSLRIEGPASLSSTPSKSPNDKLKLKRLAPGQVELSSRAGTIPAVAEDDDEPHNTGLWPLLSLNGSDGSLQGFEELLASVLGKKAGEKGTFKLLKARASAQTYVKMAFAVEKKLAEGEANWSNFPEWKTKPKKLRAHYEVLARVEGGQAIPERIAQVQPFQADEAMSESALTGNVTRSKMEIVHPPPVYFAL

SEQ ID NO: 9456 - protein, 333 aa, Secale cereale
MEVGRKVVPVRLLEDVNRWDFVDLPIFRSQADADDTALAEIGRGSFDPTLPPFQLAGPMELWIQDGDDVRLALPHDVEAGTLKKVVLADGAVVTVKGARAVSLRLPLELPLPLNRTTYKGRLSSLLSIARALRGAARSNQKPLMSLRIEGPTSLSSTPSMSPNDKLKLKRLAPGQVELSSRAIPAVTDDEDESPSPGLWPFLSLNASDGSLQGLEELLAKFLGKKAGEKGTFKLVNARASAQTYVKMGFTVEKRIADGEVNWSNLPEWKTKPKKLRAHYEVLARVERGQAIPERIAQVQPFQVDEAMSESMLTGNVSRSKMEVVNPPPVFFTL

SEQ ID NO: 9457 - protein, 418 aa, Secale cereale
MEAVAAAGGAGLTGWQAAALSGAAGWVWAASYYDLTRRARALAQPWVTRRVHAETPSILTFQRLQHRLLDNFFSVLSCVVSVPFYTGFLPLLFWSGHGKLARQMTLLLAFCDYLGNAVKDLVSAPRPCSPPVRRVTATEDEKENAMEYGLPSSHALNTVCLMGYMLHYVLTYGPCDGFTIATGLSLALMLVTLIGIARVYLGMHSLTDVIAGISFGIVILAFWLVVHDHVDAFVVSGQNVTFFWASLSLVLCFAYPRPEFPTPSFEFHTAFNGVAFGIVYGVQQTYTRFHGPDAPLILSHELPLLGYAGRVLVGIPTILAVKSCSKALSKWLLPVMCSTLGIPIVSSCYVPALKPSDIGGGSGNKDEAKQAGGYLQRVFSLFPQKAYDVDTGIRFVQYAGLAWSVVDLVPVIFTHLNL

SEQ ID NO: 9458 - protein, 419 aa, Hordeum vulgare
MDVEAVAAAGGAGLTGWQAAALSGAAGWVWAASHYDLTRRARALAQPWVTRRVHAETPDIITFQRLQHRLLDNFFSVLSCVVSVPFYTGFLPLLFWSGHGKLARQMTLLLAFCDYLGNAVKDLVSAPRPCSPPVRRVTATEDEKENAMEYGLPSSHALNTVCLMGYMLHYVLTYGPCNGFMIATGLSLAFLLVTLIGIARVYLGMHSLTDVIAGISFGIVILAFWLVVHDHVDAFVVSGQNVTFFWASLALVLCFAYPKPEFPTPSFEFHTAFNGVAFGIVYGVQQTYTRFHGPDAPLILSHQLPLLAYAGRVLVGIPTILAVKSCSKALSKWLLPVMCSTLGIPIVSSCYVPTLKPSNSSSGNKPDDAKLAGGYLQRVFSLFPQKAYDVDTGIRFVQYAGLAWSVVDLVPVIFTHLNL

SEQ ID NO: 9459 - protein, 414 aa, Brachypodium distachyon
MEAAAAAGAAGLTRWQAAALSAVAGWVWAASYFDLTRRARALTQPWVTRRVHAETPSILRFQRTQHRLLDNFFSVLSCVVSVPFYTGFLPLLFWSGHGKLARQMTLLMAFCDYLGNAVKDLVSAPRPCSPPVRRVTATEDEKENAMEYGLPSSHALNTVCLMGYILHYVLTYGPCSAFMVATCLSLALLLVMLIGIARIYLGMHSLTDVIAGICFGTVILAFWLVVDDHVDAFVVSGQNVTFFWASLSLLMCFAYPKPEFPTPSFEYHTAFNGVAFGIVYGIQQTYFHFHNPNVPLIFSQQLPLLAYIGRVLVGIPTILAVKSCSKALSKWLLPVMCNTLGIPIVSSCYVPALKVTNSNSSKSDAKQAGYLQRVFSLFPQKAYDVDTGIRFVQYAGLAWSVVDLVPAIFTHLNL

SEQ ID NO: 9460 - protein, 416 aa, Setaria italica
MEAAVAGAGGAGLTRWQAAALSAVAGWVWAASFYDLTRRARALVQPWVTRRVHAETPAILRFQRLQHKLLDNFFSVLSCVVSVPFYTGFLPLLFWSGHNKLARQMTLLMALCDYLGNSVKDMISAPRPCSPPVRRVTATEDEKENAMEYGLPSSHALNTVCLMGYLLHYVLTYGDAGNVMIAAGLSLAFLFVMLIGIARIYLGMHSLIDVIAGICFGIVILAFWLVVHDHVDAFVVSGQNVASFWAGLSLLMCFAYPKPEFPTPSFEYHTAFNGVAFGIVYGIQQTYFHFHTPDAPLIFSSRLPLLAFAGRVLVGIPTILVVKFCSKALSKWLLPVMCSTLGIPIVSSCYVPALKVDNSSKNKPDAKQGAGYLQRVFSLFPQKAYDVDTGIRFVQYASLAWSVVDLVPAIFTHLNL

SEQ ID NO: 9461 - protein, 416 aa, Echinochloa colona
MEAAAAVGAGGAGLTRWQAAALAAVAGWVWAASFYDLTRRARALVQPWVTRRVHAETPAILRFQRLQHKLLDNFFSVLSCVVSVPFYTGFLPLLFWSGHGKLARQMTLLMAFCDYLGNSVKDMVSAPRPCSPPVRRVTATEDEKENAMEYGLPSSHALNTVCLMGYLLHYVLTYGEHGGVMIAAGLSLAFLLVMLVGIARIYLGMHSLTDVIAGISFGIVILAFWLAVHDHVDAFVVSGQNVASFWAGLSLLMCFAYPKPEFPTPSFEYHTAFNGVAFGIVFGIQQTYFHFHTPDAPLIFSPQLPLLTFAGRVLVGIPTILVVKFCSKALSKWLLPVMCSTLGIPIVSSCYVPTLKVDNSKSKPDAKHGAGYLQRVFSLFPQKAYDVDTGIRFVQYASLSWSVVDLVPAIFTHLNL

SEQ ID NO: 9462 - protein, 400 aa, Secale cereale
MEAVAAAGGAGLTGWQAAALSGAAGWVWAASYYDLTRRARALAQPWVTRRVHAETPSILTFQRLQHRLLDNFFSVLSCVVSVPFYTGFLPLLFWSGHGKLARQMTLLLAFCDYLGNAVKDLVSAPRPCSPPVRRVTATEDEKENAMEYGLPSSHALNTVCLMGYMLHYVLTYAPCDGFTIATGLSLAFMLVTLIGIARVYLGMHSLTDVIAGISFGIVILAFWLVVHDHVDAFVVSGQNVTFFWASLSLVLCFAYPRPEFPTPSFEFHTAFNGVAFGIVYGVQQTYTRFHGPDAPLIMSHELPLLGYAGRVLVGIPTILAVKSCSKAVSKWLLPVMCSTLGIPIVSSCYVPALKPSDIGGDPGNRTRPSRPAGTSSGSSPSSRKRRTTWTRASGSCSTPG

SEQ ID NO: 9463 - protein, 417 aa, Panicum virgatum
MEAAAVGVGAGGAGLTRWQAAALSAVAGWVWAASFYDLTRRARALVQPWVTRRVHAETTAILRFQRLQHKLLDNFFSVLSCVVSVPFYTGFLPLLFWSGHGKLARQMTLLMAFCDYLGNSVKDIVSAPRPCSPPVRRVTATEDEKENAMEYGLPSSHALNTVCLMGYLLHYVLAYGEHGSVMIAAGLSLAVLLVMLVGIARIYLGMHSLTDVIAGIGFGFVILAFWLAVHDHVDAFVVSGQNVASFWAGLSLLMCFAYPKPEFPTPSFEYHAAFNGVAFGIVYGIQQTYFHFHTPDAPLIFSPQLPLLAFAGRVLVGIPTILVVKFCSKALSKWLLPVMCSTLGIPNVSSCYVPALKADYSKSKPDVKQGVGYLQRVFSLFPQKSYDVDTGIRFVQYASLAWSVVDLVPAIFTHLNL

SEQ ID NO: 9464 - protein, 417 aa, Pennisetum glaucum
MEAAAVVGAGGAGLTRWQAAALSAVAGWVWAASFYDLTRRARALVQPWVTRRVHAETPAILTLQRFQHNFLDNFFSVLSCVVSVPFYTGFLPLLFWSGHNKLARQMTLLMALCDYLGNSVKDMISAPRPCSPPVRRVTATEDEKENAMEYGLPSSHALNTVCLMGYLLHYVLTYGDAGNVMIVAGLSLGVLFVMLIGTARIYLGMHSLIDVIAGIGFGVVILAFWLVVHDHVDAFVVSGQNVASFWAGLSLLVCFAYPKPEFPTPSFEYHTAFNGVAFGIVYGIQQTYFHFHTPDAPLIFSPQLPLLAFAGRVLVGIPTILAVKFCSKALSKWLLPVMCSTLGIPIVSSCYVPALKVDNSSKSKANAKQGAGYLQRVFSLFPQKAYDVDTGIRFVQYASLAWSVVDLVPAIFTHLNL

SEQ ID NO: 9465 - protein, 415 aa, Panicum virgatum
MEAAAVGAGGAGLTRWQAAALSAVGGWVWAASFYDLTRRARALVQPWVTRRVHAETTAILRFQRLQHKLLDNFFSVLSCVVSVPFYTGFLPLLFWSGHGKLARQMTLLMAFCDYLGNSVKDIVSAPRPCSPPVRRVTATEDEKENAMEYGLPSSHALNTVCLMGYLLHYVLAYGEHGSVMVAAGLSLAVLLVMLVGIARIYLGMHSLTDVIAGIGFGFVILSFWLAVHDHVDAFVVSGQNVASFWAGLSLLMCFAYPKPEFPTPSFEYHTAFNGVAFGIVYGIQQTYFHFHTPDAPLVFSPQLPLLAFAGRVLVGIPTILVMKFCSKALSKWLLPVMCSTLGIPIVSSCYVPALKVDNSKSKPDVKQGVGYLQRVFSLFPQKAYDVDTGIRFVQYASLAWSVVDLVPAIFTHLNL

SEQ ID NO: 9466 - protein, 387 aa, Festuca arundinacea
HEASYFDLTRRTRALAQPWVTRRVHAETPSILRFQRMQHKLLDNLFSVLSCVVSVPFYTGFLPLLFWSGHGKLARQMTLLMAFSDYLGNVVKDVVSAPRPCSPPVRRVTTTQDEKEHAMEYGLPSSHALMTVCLMGYMLHYVLTYGGCDGFMIAIGLSVALMQVILIGIARVYLGMHSLTDVIAGICLGIVILAFWLVVDDHVDAFVVSGQNVTFFWASLSLLLCFAYPVPEFPTPSFEFHTAFTGVAFGIVYGVQQTYLRFHGPDAPLILSEQLPLLTYVGRVLVGITTILIVKSCSKALSKWLLPVMCSTLGIPIVSSCYVPTLKAPNSNSGKSDPKQAGYLQKVFLLFPRKAYDVDTGIRFVQYAGLAWSVVDLVPVIFTYLNL

SEQ ID NO: 9467 - protein, 419 aa, Zea mays
MEAAAASAAAVGGSGAGLTRWQAAALAALAGWVWAASFYDLTRRARALVQPWVTRRVHAETPAILRFQKLEHKLLDNFFSVLSCVVSVPFYTGFLPLLFWSGHGRLARQMTLLMAFCDYLGNSVKDMVSAPRPCSPPIRRVTATEDEKENAMEYGLPSSHALNTVCLTGYLLHYVLTYGEHGSLTVAAGLSLALLLVMLVGIARIYLGMHSLTDVVAGIGFGIVILAFWLAVHDHVDAFVVSGQNVATFWAGLALLMCFAYPKPEFPTPSFEFHTAFNGVAFGIVYGIQQTYFHFHAPDAPIVFSAELPFLAFAGRVLVGIPTILAVKSCSKALSRWLLPVMCSTLGIPIVSSCYVPALKIDGGSSKSRQAAGGHLQRLLSHFPQKAYDVDTGIRFVQYASLAWSVVDLVPAIFAHLDL

SEQ ID NO: 9468 - protein, 419 aa, Zea mays
MEAAAAVVGFGAGAGLTRWQAAALSAVAGWVWAASFYDLTRRARALVQPWVTRRVHAETAAILRFQRLEHKLLDNIFSVLSCVVSVPFYTGFLPLLFWSGHGRLARQMTLLMAFCDYLGNSVKDIVSAPRPCSPPVRRVTATEDEKENAMEYGLPSSHALNTVCLTGYLLHYILTFGEHGSVTVAAGLSLAFLLVMLVGIARIYLGMHSLTDVVAGIGFGIVILAFWLAVHDRVDAFVVSGENVATFWAGLSLLLCFAYPKPEFPTPSFEYHTAFNGVAFGIVYGIQQTYFHFHTPDAPVVFSAELPLLTFAGRVLVGIPTILAVKFCSKALSKWLLPVVCSTLGIPTVSSCYVPALRADSGSGSGKNRQGPGHLQRLLFSHFPRKAYDVDTGIRFVQYASLAWSVVDLVPAMFAHLNL

SEQ ID NO: 9469 - protein, 205 aa, Pseudoroegneria spicata
MAMAGGAPPAPLPVVGHQFCAPYVVPLTVTKKALSLSDGDFAITDANGAVVLKVKGAIFSIRSRRTILDGAGLPLLTMQEKVFSMHHRWEVFRGDSTNAGDLLFTVKTTSLIQLKTEMDVFLAGNTAQQVCDFKIKGTYFDRSCVFYLGDSNTMVAQMSRKLTVSNVLLGRDTFSVTVFPHVDYVFIASLVVILDEVHRDKRDDN

SEQ ID NO: 9470 - protein, 201 aa, Secale cereale
MAMAPPAPLPVVGQQFCAPYVVPLTVTKKALSLSDGDFAITDANGAVVLKVKGAIFSIRSRRTILDGAGMPLLTMQEKVFSMHHRWEVFRGDSTNARDLLFSVKTTSLIQLKTEMDVFLAGNTAQQVCDFKIKGSYFDRSCVFYLGDSNNMVAQMSRKLTVSNVLLGRDTFSVTVFPHVDYVFIASLVVILDEVHRDKRDD

SEQ ID NO: 9471 - protein, 157 aa, Secale cereale
MAMAPPAPLPVVGQQFCAPYVVPLTVTKKALSLSDGDFAITDANGAVVLKVKGAIFSIRSRRTILDGAGMPLLTMQEKVFSMHHRWEVFRGDSTNARDLLFSVKTTSLIQLKTEMDVFLAGNTAQAGLRLQDQGQLLRPVLRLLPRRLQQHGSSNEP

SEQ ID NO: 9472 - protein, 206 aa, Brachypodium distachyon
MAAAAAASGAPPAPLPVVGQQFCAPYVVPLTVTKKAISLSDGDFAITDANGAVVLKVKGAIFSIRNRRVLLDAAGQPLLSMQEKVFSMHNRWEVFRGDSTNASDLLFTVKKSSMIQLKTEMDVFLAGNTAQQVCDFKIKGSYFDRSCAFYLGNSSTMVAQMNRKFTVSNVLLGKDTFGVTVFPHVDYVFIATLVVILDEVHRDKND

SEQ ID NO: 9473 - protein, 206 aa, Avena sativa
MAFPAASGAPPAPLPVVGHQFCAPYVVPLTVTKKALSISDGDFTITDANGAVVLKVKGSIFSLRHRRVLLDAAGQPLLSMQEKVFSMHNRWEVFRGDSSNASDLLFSVKKSSMIQFKTEMDVFLAGNTAQQVCDFKIKGNYFDRSCAFYLGNSTTMVAQMNRKFTISNVLLDRDTFVVTVFPHVDYVFIATLVVILDEVHREKYDQ

SEQ ID NO: 9474 - protein, 207 aa, Festuca arundinacea
MAFPAASGAAPPAPLPVVGHQFCVPYVVPLTVTKKALSISDGDFAITDANGALVLKVKGSIFSMRHRRVLLDAAGQPLLSMQEKVFSMHHRWEVFRGDSSSASDLLFSVKKSSLIQFKTEMDVFLAGNTAQQVCDFKIKGNYFDRSCAFYLGDSTTMVAQMNRKFTVSNVLLDRDTFVVTVFPHVDYVFIATLVVILDEVHREKYDG

SEQ ID NO: 9475 - protein, 210 aa, Lolium multiflorum
MLPAPAIPLPDSEAPPAPLPVAGHQFCAPYVVPLTVTKKALSLSDGDFAITDANGAVVLKVKGTIFSMQNRRVLLDAAGLPLLCMQEKVFSMHHRWEVFRGDSTNTGDLLFSVKKSSMIQFKTEMDVFLAGNTAQQVCDFKIKGSYLDRSCAFYLGNSAAMVAQMNRKMTVSSVLLDKDTFAVTVFPHVDYVFIAALVVILDDVHRDKND

SEQ ID NO: 9476 - protein, 203 aa, Secale cereale
MAMAPPAPLPVVGQQFCAPYVVPLTVTKKALSLSDGDFAITDANGAVVLKVKGAIFSIRSRRTILDGAGMPLLTMQEKVFSMHHRWEVFRGDSTNARDLLFSVKTTSLIQLKTEMDVFLAGNTAQQVCDFKIKGSYFDRSCVFYLGDSNNMVAQMSRKLTVSNVLLGRTRSASPCSRTSTTCSSPALCDPRRGSQGTSATIDE

SEQ ID NO: 9477 - protein, 109 aa, Avena sativa
MAFPAASGAPAPPAPLPVVGHQFCAPYVVPLTVTKKALSISDGDFAITDANGGLVLKVKGSIFSLRHRASSSTPPASPSSPCKRRYSVCTIDGKCSEGTAQTQAICSLP

SEQ ID NO: 9478 - protein, 207 aa, Festuca arundinacea
  Sequence also found in Organisms: Lolium multiflorum
MAFPAASGAAPPAPLPVVGHQFCAPYVVPLTVTKKALSISDGDFAITDANGALVLKVKGSIFSMRHRRVLLDAAGQPILSMQEKVFSMHNRWEVFRGDSSSASDLLFSVKKSSLIQFKTEMDVFLAGNTAQQVCDFKIKGNYFDRSCAFYLGDSTTMVAQMNRKFTISNVLLDRDTFVVTVFPHVDYVFIATLVVILDEVHREKYDG

SEQ ID NO: 9479 - protein, 208 aa, Avena sativa
MAFPAASGAPAPPAPLPVVGHQFCAPYVVPLTVTKKALSISDGDFAITDANGGLVLKVKGSIFSLRHRRVLLDAAGQPLLSMQEKVFSMHNRWEVFRGDSANASDLLFTVKKSSMIQFKTEMDVFLAGNTAQQVCDFKIKGNYFDRSCAFYLGNSTTMVAQMNRKFTISNVLLDRDTFIVTVFPHVDYVFIATLVVILDEVHREKFDQ

SEQ ID NO: 9480 - protein, 131 aa, Secale cereale
ATRALDPIRSFYASRAPRSSISINGAVHLHCRRAAGLGLEERQEGRGGAGARGGRGGGGAAASPERRAGAGGGAAAGELEAARLRAEAAEEAEERLCAQLGEAECEALELARAYQGHVQELARELAAARSS

SEQ ID NO: 9481 - protein, 132 aa, Secale cereale
AATRALDPIRSFYASRAPRSSISINGAVHLHYRRAAGLGLEERQEDRSGAGACGGRGGGGAAAAPERRAGAGVALLRAELEAARLRAEAAEEAEERLCAQLGEAECEALELARAYQGHVQELARELAAARSR

SEQ ID NO: 9482 - protein, 102 aa, Hordeum vulgare
MAPSISIAVPTPASGWKSGRKAAEGEAEAALLRRRNAELEREVALLRAELEAARLRAEAAEEAEERLCVQLGEAECEALELARAYQGEVQELARELAAARSR

SEQ ID NO: 9483 - protein, 251 aa, Triticum aestivum
MASVHLCGPKVASAAMAKPALADGLRIPTSSSARPVPTGRRLRGLVVRAATVVSPKYTSVKPLGDRVLVKTKTTEDKTAGGILLPTTAQSRPQAGEVVAVGEGRSLGSNIVEISVPVGAKVIYSKYAGTELEFNDTTHLIMKEDDIIGILDTDDVKDLKPLSDRILIKVAESEEETAGGLLLTQASKEKPSVGTVVAVGPGPLGDDGSRTPLSITPGSSVLYSKYAGSEFKGSEGEYIVLRSSDVIAVLSS

SEQ ID NO: 9484 - protein, 251 aa, Secale cereale
MASVHLCGPKVASAAMAKPALADGLRVPASSSARPVPTGRRLRGLVARAATVVSPKYTSVKPLGDRVLVKTKTTEDKTAGGILLPTTAQSRPQAGEVVAVGEGRSLGSNIVEISVPVGAKVIYSKYAGTELEFNDTTHLIMKEDDIIGILDTDDVKDLKPLSDRILIKVAESEEETAGGLLLTQASKEKPSVGTVVAVGPGGLGDDGSSTPLSITPGSSVLYSKYAGSEFKGSEGEYIVLRSSDVIAVLSS

SEQ ID NO: 9485 - protein, 251 aa, Secale cereale
MASVHLCGPKVASAAMAKPALADGLRVPASSSARPVPTGRRLRGLVARAATVVSPKYTSVKPLGDRVLVKTKTTEDKTAGGILLPTTAQSRPQAGEVVAVGEGRSLGSNIVEISVPVGAKVIYSKYAGTELEFNDTTHLIMKEDDIIGILDTDDVKDLKPLSDRILIKVAASEEETAGGLLLTQASKEKPSVGTVVAVGPGGLGDDGSRTPLSITPGSSVLYSKYAGSEFKGSEGEYIVLRSSDVIAVLSS

SEQ ID NO: 9486 - protein, 251 aa, Secale cereale
MASVHLCGPKVASAAMAKPALADGLRVPASSSARPVPTGRRLRGLVARAATVVSPKYTSVKPLGDRVLVKTKTTEDKTAGGILLPTTAQSRPQAGEVVAVGEGRSLGTSIVEISVPVGAKVIYSKYAGTELEFNDTTHLIMKEDDIIGILDTDDVKDLKPLSDRILIKVAESEEETAGGLLLTQASKEKPSVGTVVAVGPGGLGDDGSRTPLSITPGSSVLYSKYAGSEFKGSEGEYIVLRSSDVIAVLSS

SEQ ID NO: 9487 - protein, 247 aa, Echinochloa colona
MASVHLTGPRVAVAAKPAALGGLRLPTPSIAVPTGRRARGLVVRAATVVSPKYTSIKPLGDRVLVKVKTSEAKTDGGILLPVSVQTRPQGGEVVAVGEGRSFGSNSIEISVPIGAQVVYSKYAGTELEFNDEAHLILKEDDIIGILDGDDVKDLKPLNDRILIKVAEAEEQTPGGLLLTQASKEKPSVGTVVAVGPGPLGEDGSRTSLSITPGSNVMYTKYAGSEFKGVEGEYIVLRASDVMAVLCS

SEQ ID NO: 9488 - protein, 246 aa, Setaria italica
MASLHLTGPRVAVAAKPAALGGLRLPTPSIAVPTGRRARGLVVRAATVVSPKYTSIKPLGDRVLVKVKTTEAKTDGGILLPVSVQSRPTGGEVVAVGEGRSFGSNSIEISVPVGAQVVYSKYAGTELEFNDADHLILKEDDIIGILDSDDVKDLKPLNDRILIKVAEAEEQTAGGLLLTQANKEKPSVGTVVAVGPGPLGEDGTRKALSITPGSNVMYSKYAGSEFKGQDGEYIVLRASDVMAVLS

SEQ ID NO: 9489 - protein, 246 aa, Pennisetum glaucum
MASVHLTGPRVAVAAKPAALGGLRLPTPSIAVPTGRRARGLVVRAATVVSPKYTSVKPLGDRVLVKVKTTEAKTDGGILLPVSVQSRPTGGEVVAVGEGRSFGSNSVEISIPVGAQVVYSKYAGTELEFNDADHLILKEDDIIGILDSDDVKDLKPLNDRVLIKVAEAEEQTPGGLLLTQANKEKPSVGTVVAVGPGPLGEDGTRKPLSITPGSNVMYSRYAGSEFKGQDGEYIVLKASDVMAVLS

SEQ ID NO: 9490 - protein, 878 aa, Secale cereale
MLLHGLVERLTGKNKQAWKEGKIRGTAVLVKSDVLDLNDFNASLLDGVHKILGRDDGVLFHLLSATAPDPQNPRRGKVGKAAHLEEMVVTMKSTAAGESVFKVTFDWDDSQGIPGAVIVRNTYRSEYLLKTLTLHGVPGKGTVVFVANSWIYPNVDRVFFANDTYLPSKMPALLVQYRQDELNNLRGDGTTGKYEEWDRVYRYDYYNDLGEPDSGHPRPVLGGTQELPYPRRCRTGRPPTKTDPRSESRIPRYKIKEALEIYVPRDERFGHLKLSDFLGYSLKAITEAILPIIRTYVDTTPKEFDSFQDIYNLYDGLLKVPDNPHLKELKNKIPLQFIKSLLPVAGDDLLNLPLPHVIKSDPYAWRSDEEFAREMLAGVNPVCIKRLTEFPVKSTLDPSVYGDQSSTITEDQIQQNLEEGLTVKQAMERNRLFILDHHDNFMPFLERINKLKGNFIYASRTLLFLKADGTLKPLAIELSVPHPNGIQHGAESTVYLPADIDSGVQGQIWQLAKAYASVDDSAWHQLISHWLNTHAVIEPFVIATNRQLSVVHPVHKLLSPHYRDTLNINALARTTLINAGGVFEMTVFPGEYALMMSSVVYKDWKLTEQGLPDDLVKRGMAVPDASSPYGVRLLIKDYPYAVDGLVIWWAIERWVNEYLAIYYPNDGVLRADKELAEWWREVREVGHGDLKDAEWWPRMVTVQELAKTCTTIIWVASALHAAVNFGQYPYAGYLPNRPTVSRRKMPEEGDEEYKQLEKGGKEADKVFIHTITSQFQTILGITLIEILSKHSSDEVYLGQRDTPEWTSDGKALEAFRRFGTRLREIEKRIMDMNKDPALKNRNGPVKMPYMLLYPNTSDAGGEKGLGLTAMGIPNSVSI

SEQ ID NO: 9491 - protein, 504 aa, Secale cereale
MLAGVNPVCIKRLTEFPVKSTLDPSVYGDQSSTITEDQIQQNLEEGLTVKQAMERNRLFILDHHDNFMPFLERINKLKGNFIYASRTLLFLKADGTLKPLAIELSLPHPHGIQHGAESTVYLPADIESGVQGQIWQLAKAYASVDDSAWHQLISHWLNTHAVIEPFVIATNRQLSVVHPVHKLLSPHYRDTLNINALARTTLINAGGVFEMTVFPGEYALEMSAVVYKNWKLTEQGLPDDLVKRGMAVPDASSPYGVRLLIKDYPYAVDGLVIWWAIERWVNEYLAIYYPNDGVLRADKELEEWWREVREVGHGDLKDAEWWPRMVTVQELAKTCTTIIWVASALHAAVNFGQYPYAGYLPNRPTVSRRKMPVPGDEEYKQLEKGGEEADKVFIHTITSQFQTILGITLIEILSKHSSDEVYLGQRDTPEWTSDGRALEAFRRFGARLMEIEKRIMDMNKDPALKNRNGPVKMPYMLLYPNTSDPGGERGLGLTAMGIPNSVSI

SEQ ID NO: 9492 - protein, 878 aa, Hordeum vulgare
MLLHGLVDRLTGKNKEAWKEGKIRGTAVLVKSDVLDLGDFHASLLDGVHKILGKDDGVSFRLVSATAPDPQNGSRGKVGKPAHLEEMVVTMKSTAAGESVFKVTFEWDESQGVPGAVIVRNTYRSEYLLKTLTLHGVPGKGTVVFVANSWIYPNVDRLFFANDTYLPSKMPALLVQYRQDELNNLRGDDTTGEYKEADRVYRYDYYNDLGEPDNDNPRPVLGGTQELPYPRRCRTGRPPTETDPRSESRIPKYKIKEALNIYVPRDERFGHLKLSDFLGYSLKAITEAILPIIRTYVDSTPKEFDSFQDIYNLYDGLLKVPDNQHLKELKNKIPLQFIKSLLPVAGDDLLNLPLPHVIKSDKYAWRSDEEFAREMLAGVNPVCIRRLTEFPVKSTLDPSVYGDQSSTITEDQIQLNLEDGLTVRQAMDKKRLFILDHHDNFMPFLDRINKLEGNYIYASRTLLFLKADGTLKPLAIELSQPHPDGIQHGAKSTVYLPADINSGVDGQIWQLAKAYASVDDSAWHQLISHWLNTHAVIEPFVIATNRQLSVVHPVHKLLSPHYRDTLNINALARTTLINAGGVFELTVFPGQYALEMSAVVYKNWKLTEQGLPDDLVKRGMAVPDESSPYGIRLLIKDYPYAVDGLVIWWAIERWVNEYLAIYYPNDGVLRADKELEEWWKEVREVGHGDLKDADWWPKMVTVQELAKTCTTIIWVASALHAAVNFGQYPYAGYLPNRPTVSRRPMPKEGDEEYEQLKEGGEAADMVFIHTITSQFQTILGITLIEILSKHSSDEVYLGQRDTPEWTSDAKALEAFKRFGSRLVEIEKRILDMNKDPALKNRNGPVKMPYMLLYPNTSDANGEKALGLTAMGIPNSVSI

SEQ ID NO: 9493 - protein, 349 aa, Secale cereale
MLLQGLVERLTGKNKQAWKEGKIQGTAVLVKSDVLDLNDFNASLLDGVHKILGRDDGVLFHLLSATAPDPQNPRRGKVGKAAHLEEMVVTMKSTAAGESVFKVTFDWDDSQGIPGAVIVRNTYRSEYLLKTLTLHGVPGKGTVVFVANSWIYPNVDRVFFANDTYLPSKMPALLVQYRQDELNNLRGDGTTGKYEEWDRVYRYDYYNDLGEPDSGHPRPVLGGTQELPYPRRCRTGRPPTKTDPRSESRIPRYKIKEALEIYVPRDERFGHLKLSDFLGYSLKAITEAILPIIRTYVDTTPKEFDSFQDIYNLYDGLLKVPDNPHLKELKNKIPLQFIKSLLPVLAMTS

SEQ ID NO: 9494 - protein, 198 aa, Secale cereale
MTVFPGEYALQMSAVVYKNWKLTEQGLPDDLVKRGMAVPDASSPYGVRLLIKDYPYAVDGLVIWWAIERWVNEYLAIYYPNDGVLRADKELEEWWREVREVGHGDLKDAEWWPRMVTVQELAKTCTTIIWVASALHAAVNFGQYPYAGYLPNRPTVSRRKMPVPGDEEYAQLEKGGRRRTRCSSTPSRASSRPSWASR

SEQ ID NO: 9495 - protein, 879 aa, Brachypodium distachyon
MLLHGLWDKVTGKNKEAWKEGRIRGTAVLVKKDVLDLGDFHASLLDGVHKILGCEDGVAFHLVSATAADPNNGERGKVGKAAHLEELVVTMKSTAAGESVFRVAFEWDDSQGIPGAVIVRNTNRSEFLLKTLTLEGVPGRGTVVFVANSWIYPAAGDRVFFANDTYLPSKMPVLLVQYRQDELRNLRGDSKAGPYEEHDRVYRYDYYNDLGEPDKGEDHVRPMLGGSQEHPYPRRGRTGRRPTKTDPKSESRLPLLNLKKALNIYVPRDERFGHLKLSDFLGYSLKAITEAVVPIIRTYVDTTPKEFDSFQDIMNLYDGLLEVPHSPALAEIKKKIPFDFIKSILPVAGDDFLNLPFPHVVKSDRSAWRTDEEFAREMLAGVNPVCIRRLTEFPARSTLDHSVYGDHTSKITEDHIQHNLEDGLSIKKALESNRLFILDHHDNFMPFLDRINKLEGNFIYASRTLLFLKADGTLKPLAIELSLPHPDGQQHGAESKVYTPAVEGVESQIWQLAKAYACVNDSAWHQLISHWLNTHAVIEPFVIATNRQLSVVHPVHKLLSPHYRDTMNINALARQTLINAGGIFELTVFPGKYALEMSSVVYKDWKLTEQGLPADLVKRGVAVPDPSSPYNVRLLIKDYPYAVDGLVIWWAIETWVKEYLTIYYPNDGVLRSDEELQKWWKEVREVGHGDLKDADWWPKMDTVQELAKMCTTIIWVASALHAAVNFGQYPYAGYLPNRPTVSRRPMPEPGMKEYAQLERGGKEADKVFIHTITSQFQTILGITLIEILSKHSSDEVYLGQRDTPEWTSDAKALEAFKRFGSRLIEIEKRITEMNGNPSLKNRNGPVKMPYMLLYPNTSDVTGEKGVGLTAMGIPNSISI

SEQ ID NO: 9496 - protein, 853 aa, Avena sativa
VMVKPEVLDIRDFHASFLDGVHNILGKKDGVSFRLVSATAPDPINRERGKVGSAAHLEEMVVTLKSRAEGESIFKVTFDWDASQGIPGAVVVTNTYKSEFLLKTLTLHGVPGKGTVVFVANSWIYRGADRVFFANDTYLPSKMPALLVQYRQEELNNLRGDSTVGEYQEHDRVYRYDYYNDLGEPDRGEKYARPILGGSQELPYPRRGRTGRPPTKNDPKSESRIPVYLVTKALGIYVPRDERFGHLKLSDFLGYSLKAITEAILPMIRTYIDTTPTEFDSFQDIYNLYDGLLQVPHSPQLAEMKKKIPFEFIKSILPVAGDDFLNLPLPQVIKSDKFAWRTDEEFTREMLAGVNPVCIRRVTEFPIKSTLDHSVYGDQNSTITEDQIQPYLEEGLTVEQARESNRLFILDHHDNFMPFLERINKLEGNYIYASRTLLFLKSDGTLKPLAIELSLPHPDGIQHGAKSTVYPPASMADGVDGQIWQLAKAYACVNDSAWHQLISHWLNTHAVIEPFVIATNRQLSVVHPVHKLLSPHYRDTMNINALARTTLINAGGVFELTVFPGKYALEMSSVVYKDWKLTEQGLPDDLVKRGMAVRDPSSPYGVRLLIKDYPYAVDGLVIWWAIQRWVKEYLEIYYPNDGVLRADEELREWWKEVREVGHGDLKDKDWWPKMDTVEELAKTCTTIIWVASALHAAVNFGQYPYAGYLPNRPTVSRKPMPVEGSDEYKALVEGGEAADKVFIHTITSQFQTILGITLIEILSKHASDEVYLGQRDTPEWTSDAKALDAFKRFGDRLMDIEKRILTMNKDPALKNRNGPVNMPYMLLYPNTSDVNGEKGLGLTGMGIPNSVSI

SEQ ID NO: 9497 - protein, 842 aa, Avena sativa
DFHASFLDGVHNILGKKDGVSFHLVSATAPDPNNRERGKVGSAAHLEEMVVTLKSRAEGESIFKVTFDWDASQGIPGAVIVRNTYKSEFLLKTLTLHGVPGKGTVVFVANSWIYRGADRVFFANDTYLPSKMPALLVQYRQEELNNLRGDSTVGEYQEHDRVYRYDYYNDLGEPDRGEKYARPILGGSQELPYPRRGRTGRPPTKNDPKSESRIPVYLVTKALGIYVPRDERFGHLKLSDFLGYSLKAITEAILPMIRTYIDTTPTEFDSFQDIYNLYDGLLQVPHSPQLAEMKKKIPFEFIKSILPVAGDDFLNLPLPQVIKSDKFAWRTDEEFTREMLAGVNPVCIRRVTEFPIKSTLDHSIYGDQNSKITEDQIQPYLEEGLTVEQARESNRLFILDHHDNFMPFLERINKLEGDYIYASRTLLFLKSDGTLKPLAIELSVPHPDGVQHGAKSTVYPPASMTDGVDGQIWQLAKAYACVNDSAWHQLISHWLNTHAVIEPFVIATNRQLSVVHPVHKLLSPHYRDTMNINALARTTLINAGGVFELTVFPGKYALEMSSVVYKDWKLTEQGLPDDLVKRGMAVRDPSSPYGVRLLIKDYPYAVDGLVIWWAIERWVKEYLEIYYPNNGVLRADKELEEWWKEVREVGHGDLKDKDWWPKMETVEELAKTCTTIIWVASALHAAVNFGQYPYAGYLPNRPTVSRKPMPVEGSDEYKALVEGGEAADKVFIHTITSQFQTILGITLIEILSKHASDEVYLGQRDTPEWTSDTRALDAFKRFGDRLMDIEKRILTMNKDPALKNRNGPVNMPYMLLYPNTSDVNGEKGLGLTGMGIPNSVSI

SEQ ID NO: 9498 - protein, 205 aa, Triticum aestivum
MRRGYSYSPSPPPRGYRGRARSPSPRDRYDGRGRDLPTSLLVRNLRRDCRPDDLRRPFAQFGRLKDVYIPRDYYTQEPRGFGFVQYFDPNDAADAKYYMDGQVILGREVAVVFAQENRKKPAEMRTRESSRGRSYDRRHSPSPRRRPSYRGRSYSRSPSPRPARRRFRDESPSRSRSPSGSRSASPLDGKYGRSSRRERSISVSG

SEQ ID NO: 9499 - protein, 207 aa, Secale cereale
MRRGYSYSPSPPPRGYRGRARSPSPRDRYDGRGRDLPTSLLVRNLRRDCRPDDLRRPFTQFGRLKDVYIPRDYYTQEPRGFGFVQYFDPDDAADAKYYMDGQVILGREVAVVFAQENRKKPAEMRTRESSRGRSYDRRHSPSPRGRPSYRGRSYSRSPSPRPARRRFRDESPSRSRSPVDSGSRSASPLDGKYGRSSRRERSISVSG

SEQ ID NO: 9500 - protein, 207 aa, Secale cereale
MRRGYSYSPSPPPRGYRGRARSPSPRDRYDGRGRDLPTSLLVRNLRRDCRPDDLRRPFTQFGRLKDVYIPRDYYTQEPRGFGFVQYFDPDDAADAKYYMDGQVILGREVAVVFAQENRKKPAEMRTRESSRGRSYDRRHSPSPRGRPSYRGRSYSRSPSPRPARRRFRDESPSRSRSPVHSGSRSASPLDGKYGRSSRRERSISVSG

SEQ ID NO: 9501 - protein, 207 aa, Triticum aestivum
MRRGYSYSPSPPPRGYRGRARSPSPRDRYDGRGRDLPTSLLVRNLRRDCRPDDLRRPFAQFGRLKDVYIPRDYYTQEPRGFGFVQYFDPDDAADAKYYMDGQVILGREVAVVFAQENRKKPAEMRTRESSRGRSYDRRHSPSPRGRPSYRGRSYSRSPSPRPARRRFRDESPTRSRSPVDSGSRSASPLDGKYGRSSRRERSISVSG

SEQ ID NO: 9502 - protein, 207 aa, Secale cereale
MRRGYSYSPSPPPRGYRGRARSPSPRDRYDGRGRDLPTSLLVRNLRRDCRPDDLRRPFTQFGRLKDVYIPRDYYTQEPRGFGFVQYFDPDDAADAKYYMDGQVILGREVAVVFAQENRKKPAEMRTRESSRGRSYDRRHSPSPRGRPSYRGRSYSRSPSPRPARRRFRDESPSRSGSPVHSGSRSASPLDGKYGRSSRRERSISVSG

SEQ ID NO: 9503 - protein, 207 aa, Secale cereale
MRRGYSYSPSPPPRGYRGRARSPSPRDRYDGRGRDLPTSLLVRNLRRDCRPDDLRRPFTQFGRLKDVYIPRDYYTQEPRGFGFVQYFDPDDAADAKYYMDGQVILGREVAVVFAQENRKKPAEMRTRESSRGRSYDRRHSPSPRGRPSYRGRSYSRSPSPRPARRRFRDESPSRSRSPVHSGSRSVSPLDGKYGRSSRRERSISVSG

SEQ ID NO: 9504 - protein, 207 aa, Leymus cinereus x Leymus triticoides
MRRGYSNSPPPPPRGYRGRARSPSPRDRYDGRGRDLPTSLLVRNLRRDCRPDDLRRPFAQFGRLKDVYIPRDYYTQEPRGFGFVQYFDPDDAADAKYYMDGQVILGREVAVVFAQENRKKPAEMRTRESSRGRSYDRRHSPSPRGRPSYRGRSYSRSPSPRPARRRFRDESPSRSRSPVDSGSRSASPLDGKYGRSSRRERSISVSR

SEQ ID NO: 9505 - protein, 109 aa, Secale cereale
MDGQVILGREVAVVFAQENRKKPAEMRTRESSRGRSYDRRHSPSPRGRPSYRGRSYSRSPSPRPARRRFRDESPSRSRSPVHSGSRSASPLDGKYGRSSRRERSISVSG

SEQ ID NO: 9506 - protein, 207 aa, Pseudoroegneria spicata
MTRGYSYSPSLPPRGYRGRARSPSPRDRYDGRRRDLPTSLLVRNLRRDCRPDDLRRPFAQFGRLKDVYIPRDYYTQEPRGFGFVQYFDPDDAADAKYYMDGQVILGREVAVVFAQENRKKPTEMRTRESSRGRSYDRRRSPSPRGRPSYRGRSYSRSPSPRPARRRFRDESPSRSRSPVDSGSRSASPLDGKYGRSSRRERSISVSG

SEQ ID NO: 9507 - protein, 206 aa, Avena sativa
MARGYSYSPSPPPRGYRGRARSPSPRGRYGARGGDIPTSLLVRNLRRDCRPDDLRRPFGQFGRLKDVYIPRDYHTQEPRGFGFVQYFDPADAADAKYYMDGQVVLGREIAVVFAQENRKKPAEMRTREGSRGRSYDRRYSPSPRGRPSYRGRSYSRSPSPRYARRRFREESYSRSPAESRSRSPTPSDGRHYNRSARRERSVSVSG

SEQ ID NO: 9508 - protein, 206 aa, Avena sativa
MARGYSYSPSPPPRGYRGRARSPSPRGRYGARGGDIPTSLLVRNLRRDCRPDDLRRPFGQFGRLKDVYIPRDYHTQEPRGFGFVQYFDPADAADAKYYMDGQVVLGREIAVVFAQENRKKPAEMRTREGSRGRSYDRRYSPSPRGRPSYRGRSYSRSPSPRYARRRFREESYSRSPAESRSRSPTPSDGRHYNRSTRRERSVSVSG

SEQ ID NO: 9509 - protein, 206 aa, Avena sativa
MARGYSYSPSPPPRGYRGRARSPSPRGRYGARGGDILTSLLVRNLRRDCRPDDLRRPFGQFGRLKDVYIPRDYHTQEPRGFGFVQYFDPADAADAKYYMDGQVVLGREIAVVFAQENRKKPAEMRTREGSRGRSYDRRYSPSPRGRPSYRGRSYSRSPSPRYARRRFREESYSRSPVESRSRSPTPSDGRHYNRSARRERSVSVSG

SEQ ID NO: 9510 - protein, 204 aa, Secale cereale
MRRGYSYSPSPPPRGYRGRARSPSPRDCYDGRGRDLPTSLLVRNLRRDCRPDDLRRPFTQFGRLKDVYIPRDYYTQEPRGFGFVQYFDPDDAADAKYYMDGQVILGREVAVVFAQENRKKPAEMRTRESSRGRSYDRRHSPSPRGRPSYRGRSYSRSPSPRPARRRFRDESPYAPARLCTADRGARVHWMGSTAGPHEERGRFR

SEQ ID NO: 9511 - protein, 212 aa, Lolium multiflorum
MARGYSYSPSPPPRGYRGRGRARSPSPRGDRYGAQGRDIPTSLLVRNLRRDCRPDDLRRPFGQFGRLKDVYIPRDYHTQEPRGFGFVQYFDPADAADAKYYMDGQVVLGREIAVVFAQENRKKPGEMRTRESSRGHSRGRSYDRRYSPSPRARPSYRGRSYSRSPSPRYSRRRFREESYSRSPADSRSRSPTPSDGRYRRSARRERSVSVSE

SEQ ID NO: 9512 - protein, 205 aa, Brachypodium distachyon
MGRGYSYSPSPPPRSYRGRARSPSPRVRYVGRGRDLPTSLLVRNLRRDCRPEDLRRPFGQFGRLKDVYIPRDYYTREPRGFGFVQYFDPEDAADAKYYMDGQVVLGREIAVVFAQENRKHPSEMRTRESSRGRSYDRRRSLSPRGRSPFRGRSYSRSPSPRYERRRFREDSYSRSPVDGRSRSGSPLHEHYSRSAQRERSISASG

SEQ ID NO: 9513 - protein, 423 aa, Secale cereale
MSPTTAASPAPAPATDVLPKPSPGAKRSLMGSLIDATALLRAASFKEDSYVAAALPASDLRALADLRALLATHPDQISIWGVPLNPPSDAPADERTDVVLLKFLRARDFRVRDAHAMLLRCAAWRAEFRADAVLDEDLGFKDLEGIVAYMHGWDREGHPVCYNAYGVFKDRDMYDRVFGDGDRLSRFLRWRVQIMERGVRALQLRPGGVNAIIQVTDLKDMPKRELRAASNQILSLFQDNYPEMVARKVFVNVPWYFSVLFSMISPFLTERTKSKFVIAREGNVAETLFKFIRPELVPVQYGGLSRASELENGPPKPASEFTIKGGEKVFLEIDGIEAGATITWDLVVGGWELEYGAEYVPAAEGGYTLCVERTRKVPAAADEPVHNAFTAKEPGKMVLSIDNSGSRKRKVAAYRYFVRKPSA

SEQ ID NO: 9514 - protein, 421 aa, Brachypodium distachyon
MSPTTTPSPAAAPKPSSGGAKRGLMGSLIDATALLRTASFKEDSYVAAALPASDLRALADLRALLATHPDQISIWGVPLNNTPGDADAPADERADVVLLKFLRARDFRVRDAHAMVLRCAAWRAEFRADAVLGEDLGFKDLEGVVAYMHGWDREGHPVCYNAYGVFKDRDMYDRVFGDGDRLARFLRWRVQIMERGVRALQLRPGGVNAIIQVTDLKDMPKRELRAASNQILSLFQDNYPEMVARKVFVNVPWYFSVLFSMISPFLTERTKSKFVIAREGNVAETLFKFIRPELVPVQYGGLSRASDLENGPPKPASEFTIKGGEKVFLEIDGIEAGATITWDLVVGGWDLEYGAEYVPAADGGYTLCVERTKKVPASADEPVHNAFTAKEAGKMVLSIDNSGSRKRKVAAYRYFVRKPSV

SEQ ID NO: 9515 - protein, 432 aa, Setaria italica
MSPTTTPSPAPAAAPAPSSKGAKRSLMSSLMDATALLRSASFKEDSYVAAALPPSELRALADLKALLATHPDPISIWGVPLNPQSPPPAAAADGTAATPAADERADVVLLKFLRARDFRVRDAHAMLLRCAAWRAEFGADAVLDEDLGFKDLEGVVAYMHGWDRDGHPVCYNAYGVFKDRGMYERVFGDGDRLARFLRWRVQVMERGVRALSLRPGGVNAIIQVTDLKDMPKRELRAASNQILSLFQDNYPEMVARKVFINVPWYFSVLFSMISPFLTERTKSKFVIAREGNVAETLYKFIRPELVPVQYGGLSRAGDLENGPPKPASEFTIKGGEKVFLEIDGIEAGATITWDLVVGGWDLEYGAEYVPAAEESYTLCVEKTRMVLATAEEPVHNAFTAREAGKMVLSIDNSGSRKRKVAAYRYFVRKPSA

SEQ ID NO: 9516 - protein, 431 aa, Sorghum bicolor
MSPTTTPSPAPVAAPASKGAKRSLMSSLMDATALLRSSSFKEDSYVAAALPSSELRALADLKALLATHPDPISIWGVPLNPHSPPAAADDAAPAPTPAPVDERADVVLLKFLRARDFRVRDAHAMLLRCAAWRAEFGADAVLDEDLGFKDLEGVVAYMHGWDRDGHPVCYNAYGVFKDRDMYERVFGDGDRLSRFLRWRVQVMERGVRALTLRPGGVNAIIQVTDLKDMPKRELRAASNQILSLFQDNYPEMVARKVFINVPWYFSVLFSMISPFLTERTKSKFVIAREGNVAETLYKFIRPELVPVQYGGLSRAGDLENGPPKPASEFTIKGGEKVFLEIDGIEAGATITWDLVVGGWDLEYGAEYVPAAEDSYTLCVEKTRMVSATADEPVHNAFTAREAGKMVLSIDNSGSRKRKVAAYRYFVRKPSV

SEQ ID NO: 9517 - protein, 428 aa, Zea mays
MSPATTPLPAPVAAPASKGGKRSLMSSLMDATALLRSSSFKEDSYVAAALPASELRALADLKALVATHPDPISIWGVPLNPHSPPPGAANDDADERADVVLLKFLRARDFRARDAHAMLLRCAAWRAEFGADAVVDEELGFKELEGVVAYMHGWDRDGHPVCYNAYGVFKDRAMYERAFGDGDRLARFLRWRVQVMERGVRALTLRPRGVNAIIQVTDLRDMPKRELRAASNQILSLFQDNYPEMVARKVFINVPWYFSVLFSMVSPFLTERTKSKFVIAREGNVAETLYKFIRPELVPVQYGGLSRAGELENGPPKPASEFTIKGGEKVFLEIDGIEAGATITWDLVVGGWDLEYGAEYVPAADGSYTLCVEKARTVPATTADADAGPLHNAFTAREAGRMVLSIDNSGSRKRKVAAYRYFVRKPSA

SEQ ID NO: 9518 - protein, 270 aa, Saccharum officinarum
MSPTTTPSPAPVAAPASKGAKRSLMSSLMDATALLRSSSFKEDSYVAAALPSSELRALADLKALLATHPDPISIWGVPLNAHSPPAAADDAAPAPTPAPVDERADVVLLKFLRARDFRVRDAHAMLLRCAAWRAEFGADAVLDEDLGFKDLEGVVAYMHGWDRDGHPVCYNAYGVFKDRDMYERVFGDGDRLARFLRWRVQVMERGVRALTLSRGASTPSYRSPTSRTCPSGSSEPPATRSSASSRTITRRWWRARCSSTCRGTSPCSSP

SEQ ID NO: 9519 - protein, 506 aa, Secale cereale
MAARKDNAVLIACQAPNGRVTRAQAATNRGRFGAPNPAPVPVRTERKPATKGKAKRGASDENTCASAVTSAPAPKRRAALKDVTNISCANSFRNCTTATKLQSRPTQKVGRNPSKNKQCAKKAPKPPLPAVSGTSFVVNDSHIVEEAKKAELLPPKEEPIALLDNKGPLSLWNVARNRESGVHEPFFQGRNTGDKSETADSNTGDYVGLNVIDIDKDNGNPQMCASYAAEIYRNLMAAELVRRPKSNYMETLQRDITKGMRGILIDWLVEVSEEYKLVPDTLYLTVYLIDQFLSRKYIERQKLQLLGITSMLIASKYEEICAPRVEEFCFITDNTYTKNQVLKMECEVLNDLGFHLSVPTIKTFLRRFLRAAHASQKAPCATLGYLGNYLAELTLTDYNFLKFHPSVVAASAVFLAKWTLDQSDLPWNCTLEHYTSYKSSDIQGCVRDLWELQQGNTSGSPPLNAIREKYRQEKFECVADMLSPAMPVSLFHRQANGTSPLLINNS

SEQ ID NO: 9520 - protein, 506 aa, Hordeum vulgare
MAARKENAVLIACQAPNGRVTRAQAATNRGRFGASLPAQVPVRTERKPATKGKAKRGASDDNTCASALISAPPPKRRAALKDVTNISCANSSRNSTAVTKHQARPTQKAGRNPSKNKQCMKKVPKPPLPAVSGTSFVVNDSHNVEEAQKAELLPPKEEPTALLENKGSFSLWNIARNRESGVHEPFFQGRNTRDKSETADSNTGDYVGLNVIDIDKDNGNPQMCASYVAEIYRNLMAAELIRRPKSNYMETLQRDITKGMRGILIDWLVEVSEEYKLVPDTLYLTVYLIDQFLSRKYIERQKLQLLGITSMLIASKYEEICAPRVEEFCFITDNTYTKNQVLRMECEVLNDLGFHLSVPTIKTFLRRFLRAAHASQKAPCATLGYLGNYLAELTLTDYSFLKFHPSVVAASAVFLAKWTLDQSDLPWNCTLEHYTSYKSSNIERCVRDLWELQQGNTSGSPPLNAIREKYRHEKFECVANMLSPAMPVSLFRRQANDTTPLLINDS

SEQ ID NO: 9521 - protein, 502 aa, Triticum aestivum
MASRKDIPVLIACQGPSGRVTRAQVANNSRRCGVAHPALVPVRTEQKPTVKGKTKRGALDENTCVSAVASAPHPKRRAVLKDVTNISCANSYRNCTAVTKLQSRPTQKVGRNPSKNKQRSKKVPKPPLPAVSGTSFVNDCHNVEEAQKEELSPPKEEPTALLENKGSLLQNTERNRESGFHEAFFQGRITRDKFETANSNTGDYAGLNIIDIDKDNGNPQMCVSYAAEIYTNLMAAELIRRPKSNYMETLQRDITKGMRGILIDWLVEVSEEYKLVPDTLYLTVYLIDQFLSWKYIERQKLQLLGITSMLIASKYEEICAPRVEEFCFITDNTYTKDQVLKMECQVLNGLGYNLSVPTTKTFLRRFLRAAQASHKAPSVTLGYLANYLAELTLTNYNFLRFLPSVVAASAVFLARWTLDQSDLPWNCTLEHYTSYKSSDIQICVCALWELQGNTSRCPLNAIREKYQHKKFECVANMLSPELAQSLFSRQANDTNPLLINDS

SEQ ID NO: 9522 - protein, 497 aa, Lolium multiflorum
MAARKDNPVLIACQAPSGRVTRAQAANNRGRFGVAHPAPVPVRKPPAKTNAKRGALDENACASAVTSAPQPKRRAVLRDVTNISCANSYKNCTAATKLQSKPPQKVARMPSKNKQCAKKAPKPPLPAVSEASFVNDSEEAQKGELFAPKEEPTALLEIKGSLSLQNIEWNRLSGFHEAFFQGRNTRDKSETADSKNGNYAGLNIIDIDKDNGNPQMCASYVAEIYANLMASELIRRPKSNYMETLQKDITKGMRGILIDWLVEVSEEYKLVPDTLYLTVYLIDIFLSRKYIERQKLQLLGITSMLIASKYEEICAPRVEEFCFITDNTYTKAEVLKMECQVLNDLGFHLSVPTTKTFLRRFLRAAQASHKAPSVTLGYLANYLAELTLTDYSFLRFLPSVVAASAVFLARWTLDQSDLPWNYTLEHYTSYKSSDIQMCVCALRELQGNTSGCPLNAIREKYRHEKFEGVANMLSPELSQSLFSIQANDINPLLIDNY

SEQ ID NO: 9523 - protein, 516 aa, Festuca arundinacea
MEFPQWASFLGVVLATVLFLKAVLQRRSSRKYNLPPGPKAWPIIGNLNLIGTLPHRSIHALSKQYGPLLQLQFGSFPCVVGSSVEMAKFFLKTHDVMFTDRPKFAAGKHTTYNYSDITWSPYGAYWRQARKMCLTELFSARRLQSYEYIRSEEVLALLRDLHRGATVGAGRALVLKDYLSTVSLNVITRMVMGKKYLEKEVRDGSGAVITTPDEFKWMIDELFLLNGVLNIGDSIPWLDWMDLQGYIKRMKKLSKMFDRFLEHVVDEHSERRRHEAESFVAKDMVDVLLQFASNPDLEVKLNREGVKAFTQDLIAGGTESSAVTVEWALSELLKKPEVFARATEELDRVVGRGRWVTEKDMPSLPYVDAIVKETMRLHPVAPMLVPRLSREVTTIGGYDIPAGTRVLVSVWTIGRDPELWDAPEEFMPERFLGSRLDVKGQDYELLPFGSGRRMCPGYSPGLKVIQVSLANLLHGFEWKLPDGVELSMEEIFGLSTPRKFPLEAVVEPKLPAHLYE

SEQ ID NO: 9524 - protein, 514 aa, Avena sativa
MELPQWASFLSIVVATVLFLKAVLGRRRSRKYNLPPGPKAWPIIGNLNLIGTLPHRSIHALAKQYGPLVQLQFGSFPVVVGSSVEMAKFFLKTHDVVFTDRPKTAAGKHTTYNYCDITWSPYGAYWRQARKMCLTELFSAKRLESYEYIRREEVLALLRDLHRGAATAGAGRALVLKDYLSTVSLNVITRMVMGKKYLEKEVRDETGAVITTPDEFKWMIDELFLLNGVLNIGDSIPWLDWLDLQGYIKRMKKLSKMFDRFLEHVVEEHSERRRCNGESFVAKDMVDVLLQFASDPNLEVKLNREGVKAFTQDLIAGGTESSAVTVEWALSELLKKPEVFAKATKELDSVIGRGRWVTEKDIPSLPYIEAIVKETMRLHPVAPMLVPRLSREDTSIGGYDIPAGTRVLVSVWSIGRDPELWDAPEEFMPERFLGSRLDVKGQDYELLPFGSGRRMCPGYSLGLKVIQVSLANLLHGFTWRLPNGVELSMEEIFGLSTPRKFPLEAVVEPKLPAH

SEQ ID NO: 9525 - protein, 521 aa, Brachypodium distachyon
MELPQWASFLGVVLATVVFLKAVLRRRGGSPKRTYNLPPGPKPWPIIGNLNLIGTLPHRSIHALSKQYGPLMQLQFGSFPVVVGSSVDMAKFFLKTHDVVFTDRPKTAAGKHTTYDYSDITWSPYGAYWRQARKICLTELFSAKRLESYEYIRGEEVLALLRDLHGASGRVVVLKDFLSTVSLNVITRMVMGKKYLEKEVKDEAGAVITTPDEFKWMLDELFLLNGVLNIGDSIPWLDWMDLQGYIKRMKKLSKMFDRFLEHVVDEHSERCRREGEGFVAKDMVDVLLQVASDPDLEVKLNREGVKAFTQDMIAGGTESSAVTVEWALSELLKKPEVFAKATEELDRVVGRGRWVTEKDMASLPYVEAIVKETMRLHPVAPLLVPRLSREDTSIGGHDIPAGTRVLVSVWSIGRDPALWDKPEEFAPERFLGSRIDVKGQDYELLPFGSGRRMCPGYSLGLKVIQVSLANLLHGFAWRLPDGVTKEELSMEEIFGLSTPRKSPLEAVVEPKLPAQLYAQAA

SEQ ID NO: 9526 - protein, 517 aa, Zea mays
MELPTWASFLGVVLATVMLLKAILGRRSRRVYNLPPGPKPWPIIGNLDLVGALPHRSIHELSRKYGPLMQLRFGSFPVVVGSSVDMAKFFLKTHDVVFTDRPKTAAGKYTTYNYRDITWSPYGAYWRQARKMCLTELFSAKRLESYEYIRAAEVRVLLRDLHSASGSGRAVMLKDYLSTVSLNVITRMVLGKKYLDREEAAAGAVTTPEEFKWMLDELFLLNGVLNIGDSIPWLDWMDLQGYIKRMKKLSKMFDRFLEHVVEEHHQRRLSEGKGFVAKDMVDVLLQIADDPTLEVELDRESVKAFTQDLIAGGTESSAVTVEWAISELLKKPEVIAKATEELDRVIGRGRWVTEKDIPSLPYVDAIVKETMRLHPVAPMLVPRLSREDTAVAGYDIPAGTRVLVSVWSIGRDPALWDAPEEFMPERFLGSRLDVKGQDYELLPFGSGRRMCPGYSLGLKVIQVSLANLLHGFAWSLPDGVTMEELSMEEIFGLSTPRKFPLEAVVQPKLPAHLYAEP

SEQ ID NO: 9527 - protein, 517 aa, Sorghum bicolor
MELPTWASFLGVVLATVMLLKAILGRRSRRVYNLPPGPKPWPIIGNLNLMGALPHRSIHELSRKYGPLMQLQFGSFPVVVGSSVDMAKFFLKTHDVVFTDRPKTAAGKYTTYNYRDITWSPYGAYWRQARKMCLTELFSAKRLESYEYIRAAEVRALLRDLHSASGSGRAVMLKDYLSTVSLNVITRMVLGKKYLDKEEAAAGSVTTPEEFKWMLDELFLLNGVLNIGDSIPWLDWMDLQGYIKRMKKLGKMFDRFLEHVVEEHNQRRLREGKGFVAKDMVDVLLQIADDPTLEVELNRESVKAFTQDLIAGGTESSAVTVEWAISELLKKPEVIAKATEELDRVIGRGRWVTEKDMPSLPYVDAVVKETMRLHPVAPLLVPRLSREDTTVAGYDIPAGTRVLVSVWSIGRDPALWDAPEEFMPERFLGSKLDVKGQDYELLPFGSGRRMCPGYSLGLKVIQVSLANLLHGFAWSLPDGVTKEELSMEEIFGLSTPRKFPLEAVVEPKLPAHLYAEP

SEQ ID NO: 9528 - protein, 519 aa, Setaria italica
MELPPWASFLGVVLATVMLLKAIVGRHRRRRAYNLPPGPKPWPIIGNLDLVGALPHRSIHELSRKYGPLMQLQFGSFPVVVGSSVDMAKFFLKTHDVVFTDRPKTAAGKYTTYNYRDITWSPYGAYWRQARKMCLTELFSAKRLESYEYIRAAEVRALLRDLHAVSGSGCAVMLKDYLSTVSLNVITRMVLGKKYLDKEVAAGGSSVTTPEEFKWMLDELFLLNGVLNIGDSIPWLDWMDLQGYIKRMKKLGKMFDRFLEHVVEEHNQRRLREGKSFVAKDMVDVLLQIADDPTLEVELNRESVKAFTQDLIAGGTESSAVTVEWAISELLKKPEVFAKATEELDRVIGRGRWVTEKDIPQLPYVDAIVKETMRLHPVAPMLVPRLSREDTTVAGYDIPAGTRVLVSVWSIGRDPTLWDAPEEFMPERFLGSKLDVKGQDYELLPFGSGRRMCPGYSLGLKVIQVSLANLLHGFSWSLPDGLTKEELSMEEIFGLSTPRKFPLEAVVEPKLPAHLYAEA

SEQ ID NO: 9529 - protein, 519 aa, Setaria italica
MELPPWASFLGVVLATVMLLKAIVGRRRRRRAYNLPPGPKPWPIIGNLDLMGALPHRSIHELSRKYGPLMQLQFGSFPVVVGSSVDMAKFFLKTHDVVFTDRPKTAAGKYTTYNYRDITWSPYGAYWRQARKMCLTELFSAKRLESYEYIRAAEVRALLRDLHAVSGSGRAVMLKDYLSTVSLNVITRMVLGKKYLDKEVAAGGSSVTTPEEFKWMLDELFLLNGVLNIGDSIPWLDWMDLQGYIKRMKKLGKMFDRFLEHVVEEHNQRRLREGKSFVAKDMVDVLLQIADDPTLEVELNRESVKAFTQDLIAGGTESSAVTVEWAISELLKKPEVFAKATEELDRVIGRGRWVTEKDIPQLPYVDAIVKETMRLHPVAPMLVPRLSREDTTVAGYDIPAGTRVLVSVWSIGRDPTLWDTPEQFMPERFLGSKLDVKGQDYELLPFGSGRRMCPGYSLGLKVIQVSLANLLHGFAWSLPDGLTKEELNMEEIFGLSTPRKFPLEAVVEPKLPAHLYAEA

SEQ ID NO: 9530 - protein, 519 aa, Zea mays
MELPPWASFLGIVLATVMLLKALTGRRSRRMYNLPPGPKPWPIIGNLDLVGALPHRSIHELSRKYGPLMQLRFGSFPVVVGSSVDMAKFFLKTHDVVFTDRPKTAAGKYTTYNYRDITWSPYGAYWRQARKMCLTELFSAKRLESYEYIRADEVRALLRDLHAASSSGRAVMLKDYLSTVSLNVITRMVLGKKYLDKEEAAAAGGSVTTPEEFKWMLDELFLLNGVLNIGDSIPWLDWMDLQGYIKRMKKLSKMFDRFLEHVVEEHNQRRLREGKGFVAKDMVDVLLQIADDPTLEVELDRESVKAFTQDLIAGGTESSAVTVEWAISELLKKPEVIAKATEELDRVIGRGRWVTEKDMPSLPYVDAIVKETMRLHPVAPLLVPRLAREDTTVAGYDIPAGTRVLVSVWSIGRDPALWDAPEEFMPERFLGSKLDVKGQDYELLPFGSGRRMCPGYSLGLKVIQVSLANLLHGFAWSLPDGVTKEEFSMEEIFGLSTPRKFPLEAVVEPKLPAHLYAEP

SEQ ID NO: 9531 - protein, 518 aa, Sorghum bicolor
MELPPWASFLGVVLATVMLLKAIIGRRRSRRVYNLPPGPKPWPIIGNLNLVGALPHRSIHELSRKYGPLMQLRFGSFPVVVGSSVDMAKFFLKTHDVVFTDRPKTAAGKYTTYNYRDITWSPYGAYWRQARKMCLTELFSVKRLESYEYIRAAEVRALLRDLNSASGSGRAVMLKDYLSTVSLNVITRMVLGKKYLDREEAAAGSVTTPEEFKWMLDELFLLNGVLNIGDSIPWLDWMDLQGYIKRMKKLGKMFDRFLEHVVEEHNQRRLREGKGFVAKDMVDVLLQIADDPTLEVELDRKSVKAFTQDLIAGGTESSAVTVEWAISELLKKPEVIAKATEELDRVIGRGRWVTEKDMPSLPYVDAVVKETMRLHPVAPLLVPRLAREDTTVAGYDIPAGTRVLVSVWSIGRDPALWDAPEEFMPERFLGSRLDVKGQDYELLPFGSGRRMCPGYSLGLKVIQVSLANLLHGFAWSLPDGVTKEELSMEEIFGLSTPRKFPLEAVVEPKLPAHLYSEA

SEQ ID NO: 9532 - protein, 522 aa, Panicum virgatum
MELPLPPWAPFLGVVLATVMLLKAVLGRRSRRAYNLPPGPKPWPIIGNLDLMGALPHRSIHELSRKYGQLMQLRFGSFPVVVGSSVDMAKFFLKTHDVVFTDRPKTAAGKYTTYNYRDITWSPYGAYWRQARKMCLTELFSAKRLESYEYIRAAEVRALLRDLHAASGSGRAVMLKDYLSTVSLNVITRMVLGKKYLDKEVAVAGGSSVTTPEEFKWMLDELFLLNGVLNIGDSIPWLDWMDLQGYIRRMKKLSKMFDRFMEHVVEEHNQRRLREGKSFVAKDMVDVLLQIADDPTLEVELNRESVKAFTQDLIAGGTESSAVTVEWAISELLKKPEVIAKAPEELDRVIGRGRWVTEKDIPQLPYVDAIVKETMRLHPVAPLLVPRLAREDATFAGYDIPAGTRVLVSVWSIGRDPALWDSPEEFMPERFLGSKLDVKGQDYELLPFGSGRRMCPGYSLGLKVIQVSLANLLHGFAWSLPDGVTKEELSMEEIFGLSTPRKFPLEAVVEPKLPAHLYAAEA

SEQ ID NO: 9533 - protein, 104 aa, Sorghum bicolor
MSLATKPLPSRSRRWLCSSTTCSRNRSNILPSFFIRLMYPCRSIQSSHGMESPMLSTPLSRNSSSSIHLNSSGVVTDPAAASSLSRYFLPSTMRVITFRLTVDR

SEQ ID NO: 9534 - protein, 519 aa, Triticum aestivum
MELQPWLTFLGIVLATVLFIKTVACRPSGRGHNLPPGPKPWPIIGNLNLIGALPHRSIHALSERYGPLMYLRFGSVPVVVGSSVEMAKFFLKTHDVVFTDRPKTAAGKYTTYNYRDITWSQYGPYWRQARKICLTELFSVKRLESYEYIRGEELRALLHDLHGASGRVVTLKDYLSTLSLNVISRMMLGKNYLDKEAAGSAITTPDEFRWMLDELFLLNGVLNIGDSIPWLDWMDVQGYVKRMKKLSKMYDRFLEHVVDEHNERRSREGESFVAKDMVDVLLQVASDPNLEVKLSRDGVKAFIQDLLAGGTESSTVTVEWAISELLKKPEIFGKATEELDRVVGRCRWVTEDDIPSLPYVDAIMKEAMRMHPVVPLLVPRLSREDTTVGGYDIPAGTRVHISVWSIGRDPALWDAPEHFMPERFLDSKLDVNGQDYELLPFGSGRRMCPGYSLGLKVIQMSLANLLHGFTWRLPDGVAAEQLSMEEIFGLSTPRKFPLETIMEPKLPGHLYDGATAFVE

SEQ ID NO: 9535 - protein, 682 aa, Sorghum bicolor
MRALLSLSRLARRVPASLAPVSAPTTFLLRHIHADVPPPPPPPPPHDSPLFVSRILESEPSLTPNAESEPASDPILDEFLARFVAAFRPRLTAAFPNHDRDVLDEMLRLVADAVLCRLTGADRGPDAIELNDDLWAVVWEVSASVREAMRRDQVRADLRQYLHCDEVKEMTRFAVDVGIRGAMLRELRFKWAREKLDEVEFYRGLDDKRSDAEAAADPAPAPVPRLTALPKRKGEVKFTMYGLDMSDPKWAEVAERVAEAEAHFVPEEAKAVEGRAKKAEERLLLVDPRRGDPVPAIEEWKEDLRPKRVDWIALLERIKARNVELYLKVAEILLDQESFEANIRDYSKLIDLHAKANHVESAERVLGKMKEKGIAPDVITSIVLVHMYSKAGNLEQAKEAFEFIRREGFKPDLKLFSSMINCYINHGEPEEAENLIKSMRGTRVIVKPTREIYTDIVRAYAQRGMMTCAQRVLNMMTHDEIKPTEELYAICIEAYGRIGDPIQARAMFDQIRRRLGHEPGDSSIAGVVAAHIEKNQLDEALQWLLSLEKEGVELGVKTNLVLLDWLSMLQLVLEAEQLVQKIKKLGEEPIEVHVFLAGMYAKSRQEEKARRSLKILEEKKKLLKSDQFERVIRGLLDGGFSEEANKYYKMMKSCGFEPSETIEVGVKASLRIRGASRHIGRH

SEQ ID NO: 9536 - protein, 345 aa, Triticum aestivum
MASSSLVVLAVLATVAALLLSPAMPLPVFTGDSSPGFHAASCPQLDGIVWSSVEAALRQEVAVAAGMLRLYFHDCFPQGCDASILLNTTAARETALGPNLSIQPRAMQLIESIRARAHAVCGPVVSCADITLLATRDIIVISGGPWFNVPQGNLDSLAPASQDKVFDLPAPDTASVATLVNSFATRGLGDVADLVALSGAHTIGRSQCGSFVDRSKRADDTFSRKLAANCSKHPERLQNLDVITPDLFDNAYYKALGFNQGVFTSDMALVKNKTTAPIVKRFAESKDAFFGQFARSMEKLARVPKPAGNVGEIRRFSCFRTNAQRADAAVEAAGEEEEEGFSASA

SEQ ID NO: 9537 - protein, 346 aa, Triticum aestivum
MATTSPAVVLAVLATAAALLLSPAMSLPVFTGDSSPGFHSASCPQLDGIVWSSVEAALRQEVAVAAGMLRLYFHDCFPQGCDASILLNNTAARETALGPNLTIQPRAMQLIESIRARAHAVCGPVVSCADITLLATRDIIVISGGPWFNVPQGNLDSLAPAAQDKVFDLPAPNTASVATLVESFATRGLGDVADLVALSGAHTIGRSQCGSFEDRSQRADDTFSRKLAANCSKHPERLQNLDVITPDLFDNAYYKALGFNQGVFTSDMALVKNKTTAAIVKRFAESKDAFFGQFARSMEKLARVPKPAGNVGEIRRFSCFRTNAQRADADHVDAAGEEEEGFAASA

SEQ ID NO: 9538 - protein, 345 aa, Pseudoroegneria spicata
MASSSLVVLAVVATVAALLLSPAISLPVFTGDADVDFHAASCPQLDGIVWSSVEAALRQEVAVAAGMLRLYFHDCFPQGCDASILLNNTAARETALGPNLTIQPRAMQLIESIRARAHAVCGPVVSCADITLLATRDIIVISGGPWFNVPQGNLDSLAPASQDKVFDLPAPNTASVATLVNSFATRGLGDVADLVALSGAHTIGRSQCGSFSDRSQRADDTFSRKLAANCSKHPDRLQNLDVITPDLFDNGYYKALGFNQGVFTSDMALVKNKTTAPIVKRFAESKEAFFGQFARSMEKLARVPKPAGNVGEIRRFSCFRTNAQRADAGSVDAAGEEEEGFAASA

SEQ ID NO: 9539 - protein, 347 aa, Secale cereale
MASSSSVVVLAVLATAAALVLSPAMSLPVFTGDDSPGFHAASCPQLDGIVWSSVEAALRQEVAVAAGMLRLYFHDCFPQGCDASILLNNTAARETALGPNLSIQPRAMQLIESIRARAHAVCGPVVSCADITLLATRDIIVISGGPWFNVPQGNLDSLAPAAQAKVFDLPAPDTASVATLVSSFATRGLGDVADLVALSGAHTIGRSQCGSFEDRSKRADDTFSRKLAANCSKHPDRLQNLDVITPDLFDNGYYRALGFNQGVFTSDMALVKNKTTAAIVKRFAESQDAFFGQFARSMEKLARVPKPAGNVGEIRRFSCFRTNAQRADAAAVDAAGEEEEDGFAASA

SEQ ID NO: 9540 - protein, 346 aa, Secale cereale
MATSSTVVVLAVLATAAALLLSPATSLPVFTGDSPSFHSASCPQLDGIVWSSVEAALRQDVAVAAGMLRLYFHDCFPQGCDASILLNNTDARETALDPNLSIQPRAMQLIESIRARAHAVCGPVVSCADITLLATRDIIVISGGPWFNVPQGNLDSLAPAAQGKVFDLPAPDTASVATLVNSFATRGLGDVADLVALSGAHTIGRSQCGSFEDRSKRADDTFSRKLAANCSKHPDRLQNLDVITPDLFDNGYYKALGFNQGVFTSDMALVKNKTTAAIVKRFAESQDAFFGQFARSMEKLARVPKPAGNVGEIRRFSCFRTNAQRADAAAVDAAGEEEEDGFAASA

SEQ ID NO: 9541 - protein, 341 aa, Triticum aestivum
MASSSAILAVLVTAAALLSPAMSLPVFTGDASPDFHAASCTQLDGIVWSSVEAALRQEVAVAAGMLRLYFHDCFPQGCDASILLNNTAARETALGPNLTIQPRAMQLIESIRARAHAVCGPVVSCADITLLATRDIIVISGGPWFNVPQGNLDSLAPAAQAKVFDLPAPNTASVATLVESFGTRGLGDVADLVALSGAHTIGRSQCGSFEDRSQRADDTFSRKLAANCSKHPDRLQNLDVITPDLFDNAYYKALGFNQGVFTSDMALVKNKTTAPIVKRFAESKEAFFGQFARSMEKLARVPKPAGNVGEIRRFSCFRTNAQGTDAAVDAAVEEEGFAASA

SEQ ID NO: 9542 - protein, 350 aa, Hordeum vulgare
MASSSVAALAVVLATAATLLLSPATSLPVFTGDDGASPGFHSASCPQLDGIVWSSVEAALRQDVAVAAGMLRLYFHDCFPQGCDASILLNDTAARETALGPNLTIQPRAMQLIESIRARAHAVCGPVVSCADITLLATRDIIVISGGPWFNVPQGNLDSLAPAAQEKVFELPAPDTASVATLVTSFATRGLGDVADLVALSGAHTIGRSQCGSFVDRSQRADDTFSRKLAANCSKHPDRLQNLDVITPDLFDNAYFKALGFNQGVFTSDMALVKNKTTAPIVKRFAESKEAFFGQFARSMEKLARVPKPAGNVGEIRRFSCFRPNAQRADAAVDDAAGEEEEEEGFAASA

SEQ ID NO: 9543 - protein, 347 aa, Secale cereale
MATSSTVVILAVLATAAALLLSPAMSSLPVFTGDDSPGFHSASCPQLDGIVWSSVEAALRQDVAVAAGMLRLYFHDCFPQGCDASILLNNTAARETALGPNLSIQPRAMQLIESIRARAHAVCGPVVSCADITLLATRDIIVISGGPWFNVPQGNLDSLAPAAQAKVFDLPAPDTASVATLVSSFATRGLGDVADLVALSGAHTIGRSQCGSFEDRSKRADDTFSRKLAANCSKHPDRLQNLDVITPDLFDNGYYKALGFNQGVFTSDMALVKNKTTAAIVKRFAESQDAFFGQFARSMEKLARVPKPAGNVGEIRRFSCFRTNAQRADAAAVDAAGEEEGGFAASA

SEQ ID NO: 9544 - protein, 345 aa, Secale cereale
MASSSSVVVLAVLVTVAALLSPAMSLPVFTGDDSPGFHAASCPQLDGIVWSSVEAALRQEVAVAAGMLRLYFHDCFPQGCDASILLNNTDARETAMDPNLSIQPRAMQLIESIRARAHAVCGPVVSCADITLLATRDIIVISGGPWFNVPQGNLDSLAPAAQAKVFDLPAPDTASVATLVSSFATRGLGDVADLVALSGAHTIGRSQCGSFEDRSKRADDTFSKKLAANCSKHPDRLQNLDVITPDLFDNGYYRALGFNQGVFTSDMALVKNKTTAAIVKRFAESQDAFFGQFARSMEKLARVPKPAGNVGEIRRFSCFRTNAQRADAAAVDAAGEEEEGFAASA

SEQ ID NO: 9545 - protein, 213 aa, Secale cereale
MASSSAILAVLVTVAALHSPAMSLPVFTGDDSPGFHAASCPQLDGIVWSSVEAALRQEVAVAAGMLRLYFHDCFPQGCDASILLNNTAARETALGPNLSIQPRAMQLIESIRARAHAVCGPVVSCADITLLATRDIIVISGGPWFNVPQGNLDSLTPAAQGKVFDLPAPDTASVATLVSSFATRGPRRRGRPRGALRRAHHRPVAVRQLRRPV

SEQ ID NO: 9546 - protein, 345 aa, Secale cereale
MATSSTVVVLAVLATAAALLLSPATSLPVFTGDSPSFHSASCPQLDGIVWSSVEAALRQDVAVAAGMLRLYFHDCFPQGCDASILLNNTDARETALDPNLSIQPRAMQLIESIRARAHAVCGPVVSCADITLLATRDIIVISGGPWFNVPQGNLDSLAPAAQAKVFDLPAPDTASVATLVSSFATRGLGDVADLVALSGAHTIGRSQCGSFEDRSKRADDTFSRKLAANCSKHPDRLQNLDVITPDLFDNGYYKALGFNQGVFTSDMALVKNKTTAAIVKRFAESQDAFFGQFARSMEKLARVPKPAGNVGEIRRFSCFRTNAQRGDAAAVDADGEEEDGFAASA

SEQ ID NO: 9547 - protein, 234 aa, Secale cereale
AILAVLVTVAALHSPAMSLPVFTGDDSPGFHAASCPQLDGIVWSSVEAALRQEVAVAAGMLRLYFHDCFPQGCDASILLNNTAARETALGPNLSIQPRAMQLIESIRARAHAVCGPVVSCADITLLATRDIIVISGGPWFNVPQGNLDSLAPAAQAKVFDLPAPDTASVATLVSSFATRGLGDVADLVALSGAHTIGRSQCGSFEDRSKRADDTFSRKLAANCSKHPDGCRTWT

SEQ ID NO: 9548 - protein, 348 aa, Leymus cinereus x Leymus triticoides
MASSSVVVLAVLATVAALLLSPAMSLPVFTGGDVGVSPGFHAASCPQLDGIVWSSVEAALRQEVALAAGLLRLYFHDCFPQGCDASILLNTTAARETALGPNLTIQPRAMQLIESIRARVHAACGPVVSCADITLLATRDIIVISGGPWFSVPQGNLDSLAPASQEKVFDLPAPNTASVAPLVQSFGTRGLGDVADLVALSGAHTIGRPQCGPFPDRSQRADDTFSPKLAANCSKHPDRLQNLDVVTPDLFDNGYYKALGFNQGVFTSDMALVKNKTTAPIVKPFAASKDAFFGQFARSMEKLARVPKPARNVGEIRRFSCFRTNAQRADAAVDAAGEEEEEGFAASA

SEQ ID NO: 9549 - protein, 347 aa, Secale cereale
MATSSTVVVLAVLATAAALLLSPATSSLPVFTGDDSPGFHSASCPQLDGIVWSSVEAALRQDVAVAAGMLRLYFHDCFPQGCDASILLNNTDARETALGPQLSIQPRAMQLIESIRARAHAVCGPVVSCADITLLATRDIIVISGGPWFNVPQGNLDSLAPAAQAKVFDLPAPDTASVATLVNSFATRGLGDVADLVALSGAHTIGRSQCGSFEDRSKRADDTFSKKLAANCSKNPDRLQNLDVITPDLFDNGYYRALGFNQGVFTSDMALVKNKTTAAIVKRFAESQDAFFGQFARSMEKLARVPKPAGNVGEIRRFSCFRTNAQGAYVDSDAAGEEGEEGFAASA

SEQ ID NO: 9550 - protein, 330 aa, Secale cereale
AALVLSPAMSLPVFTGDDSPGFHAASCPQLDGIVWSSVEAALRQEVAVAAGMLRLYFHDCFPQGCDASILLNNTAARETALGPNLSIQPRAMQLIESIRGRAHAVCGPVVSCADITLLATRDIIVISGGPWFNVPQGNLDSLTPAAQGKVFDLPAPDTASVATLVSSFATRGLGDVADLVALSGAHTIGRSQCGSFEDRSKRADDTFSKKLAANCSKHPDRLQNLDVITPDLFDNGYYRALGFNQGVFTSDMALVKNKTTAAIVKRFAESQDAFFGQFARSMEKLARVPKPAGNVGEIRRFSCFRTNAQRADAAAVDAAGEEEEGFAASA

SEQ ID NO: 9551 - protein, 241 aa, Secale cereale
MATSSTVVVLAVLATAAALLLSPATSLPVFTGDSPSFHSASCPQLDGIVWSSVEAALRQEVAVAAGMLRLYFHDCFPQGCDASILLNNTDARETAMDPNSASSRAPCSSSSPSAPGRTPCAGPSSPAPTSPCSPPATSSSSPAGPGSTCRRTTATASPRRHGTRCSTSRRRPPPASPLSWSPSAPGGSATWPTSWRSPARTPSAGRSAAASKTGPSAPTTPSPRSSPPTAARTLTVCRTWT

SEQ ID NO: 9552 - protein, 235 aa, Secale cereale
MQLIESIRARAHAVCGPVVSCADITLLATRDIIVISGGPWFNVPQGNLDSLAPAAQAKVFDLPAPDTASVATLVSSFATRGLGDVADLVALSGAHTIGRSQCGSFEDRSKRADDTFSKKLAANCSKHPDRLQNLDVITPDLFDNGYYRALGFNQGVFTSDMALVKNKTTAAIVKRFAESQDAFFGQFARSMEKLARVPKPAGNVGEIRRFSCFRTNAQRDDAAGEEEEDGFAASA

SEQ ID NO: 9553 - protein, 342 aa, Triticum aestivum
MASSSSVLAVLATLALLLSPAAAALSSTLSPDFHAETCPQLDGIVRAAVQAALTREIAIAAGLVRIYFHDCFPQGCDASILLNNTAARETALGPNLTIQPRAMQLIESIRSTAHGACGAVVSCADITLLATRAAIVASGGPTFPVPLGNLDSLAPAPQEKVFDLPSPATASVAALVQSFGTRGLGDVADLVALSGAHTIGRSQCGSFSDRSQRADDTFSRKLAANCSKNPDRLQNLDVITPDLFDNGYYKALGFNQGVFTSDMALVKNKTTAAIVKRFAESKDAFFAQFAKSMTKLASVPKPAGNIGEIRRFSCFRTNAQSVVLIEAAVDAADEEEGFAASA

SEQ ID NO: 9554 - protein, 307 aa, Cajanus cajan
MNDLLTESFDIPRGQGHGGGDLELGEYARNSGDLGLDSFFKKVQELDKQYAKLDKLLRKLQDAHEESRAVTKAPAMKAIKEKMEKDVDEVKKTGHYLKTKIEELDKENLANRQKPGCGKGSGVDRSRTATTISLKKKLKDKMAEFQTLRETIHQEYREVVERRVFTVTGARADEETIDRLIETGDSEQIFQKAIQEQGRGQIMDTLAEIQERHEAVRDVERKLLELQQIFLDIAVLVDAQGDMLDNIESQVTSAVDHVQQGNNALQKAKKLQKNSRKWMCIAIMILLIVIIIIVVAVIKPWVSKSGA

SEQ ID NO: 9555 - protein, 307 aa, Lupinus angustifolius
MNDLLTESFEIPRGQSRGGGDVELGAYALNSGELGLDFFFKKVQELDKQYAKLDKLLGKLQEAHEESKSVTKAPSMKNIKQRMEKDVDEVKKTAHHIKTKLEELDKENLANRQKPGCGKGSGVDRSRTATTISLKKKLKDKMAEFQTLREAIHQEYREVVERRVFTVTGTRADEETIDRLIETGDSEQIFKKAIQEQGRGQIMDTLAEIQERHDAVRDVERKLRDLNQIFMDIAVLVDAQGDMLNNIETQVSSAVDHVQQGNNALQKAKKLQRNSRKWMCIAIIILLIIVVIIVVAVIKPWGDKKGV

SEQ ID NO: 9556 - protein, 307 aa, Cicer arietinum
MNDLLTESFDIPRGQGHRGGDIELGEYARNSGELGLDTFFKKVQELDKQYAKLDSLLRKLQGAHEESKAVTKAPAMKAIKQRMEKDVDEVKKTAHYLKTKVEELDKENLANRQKPGCGKGSAVDRSRTATTISLKKKLKDKIAEFQTLRESIHEEYREVVERRVFTVTGTRADEETIDRLIETGDSEQIFQKAIQEQGRGQIVDTLAEIHERHEAVRDVEKKLLDLQQIFMDIAVLVDAQGDMLDNIESMVSSAADHIQQGNNTLHKAKKLQRNSRKWMCIAIMILLIVVIIIVVSVIKPWVNNNGA

SEQ ID NO: 9557 - protein, 305 aa, Medicago truncatula
MNDLLTESFEIPRGRGGGDIELGEYGRNSGELGLDSFFKKVQELEKQYVKLDNLLRKLQDAHEETKAVTKAPAMKAIKQRMEKDVDEVKKTAYFLKTKVEELDKENLANRQKPACGKGSAVDRSRTATTIALKKKLKEKMAEFQILREAIHEEYREVVERRVFTVTGARADEETIDRLIETGDSEQIFQKAIQEQGRGQVMDTLAEIQERHEAVRDVERKLLDLQQTFMDIAVLVDAQGDMLDNIESQVSSAVDHVQQGNNSLQKAKKMQRNSRKWMCIAIMILLIVVVIIVVSVIKPWVTKKGA

SEQ ID NO: 9558 - protein, 304 aa, Populus trichocarpa
MNDLLSESFEIPRGQGSRGGDIEMGMNSADLGLESFFKKVQEIEKQNEKLDKLLKKLQDAHEESKAVTKAPAMKGIKQRMEKDVDEVGKIARSIKSKLEELDKENLSNRQKPGCGKGTGVDRSRTSTTIALKKKLKDKMAEFQTLRENIHQEYREVVERRVFTVTGTRADEETIDTLIETGDSEQIFQKAIQEQGRGQITDTLAEIQERHDAVRDLERKLLDLQQIFLDMAVLVDAQGDMLDNIESQVSNAVDHVQSGNVALQKAKKLQRNSRKWMCIAIIILLIIVAIIVVTVLKPWNNNKGA

SEQ ID NO: 9559 - protein, 308 aa, Prunus persica
MNDLLKDSFEIPRGQASRDGDIELGTNGSMNSGEFGLENFFKKVQEIEKQNEKLNKLLKKLQDAHEESKAVTKAPSMKSIKQRMEKDVDEVGKIARWIKSKIEELDKENLANRQKPGCGKGTGVDRSRTATTLALKKKLKDKMAEFQTLRETIHQEYREVVERRVFTVTGTRADEETIERLIETGDSEQIFQKAIQEQGRGQIMDTLAEIQERHDAVRDLERKLLDLQQIFLDMAVLVDAQGDLLDNIETQVSSAVDHVQQGNTALQKAKKLQKSSRKWMCIAILILLIIVIIIVVAVLKPWNSNKGA

SEQ ID NO: 9560 - protein, 308 aa, Prunus mume
MNDLLKDSFEIPRGQASRDGDIELGTNGSMNSGEFGLENFFKKVQEIEKQNEKLNKLLKKLQDAHEESKAVTKAPSMKSIKQRMEKDVDEVGKIARWIKSKIEELDKENLANRQKPGCGKGTGVDRSRTATTLALKKKLKEKMAEFQTLRETIHQEYRDVVERRVFTVTGTRADEETIERLIETGDSEQIFQKAIQEQGRGQIMDTLAEIQERHDAVRDLERKLLDLQQIFLDMAVLVDAQGDLLDNIETQVSSAVDHVQQGNTALQKAKKLQKSSRKWMCIAILILLIIVIIIVVAVLKPWNSNKGA

SEQ ID NO: 9561 - protein, 306 aa, Theobroma cacao
MNDLLTESFEIPRGQGSRGGDIELGAQMNSGELGLQNFFKKVQDIDKQYEKLDKLLKKLQDAHEESKAVTKAPAMKSIKQRMEKDVDEVGKISRFIKAKIEELDKENLANRQKPGCGKGTGVDRSRTATTLAIKKKLKDKMAEFQTLRETIHQEYREVVERRVFTVTGTRPDEETIEKLIDTGDSEQIFQKAIQEQGRGRIMDTVSEIQERHEAVRDLERKLLELQQIFLDMAVLVDAQGDMLDNIESQVSSAVDHVQSGNTALQKAKKLQKNSRKWMCIAIIILLLIVVIIVVAVIKPWSSNKGA

SEQ ID NO: 9562 - protein, 304 aa, Rhizophora mangle
MNDLLTDSFEIPRGQGSRGGDIEMGMNSGDLALENFFKKVQEIDKQNEKLDKLLKKLQNAHEDSKAVTKAPAMKAIKQRMEKDVEEVGKIARSVKSKIEELDRENLANRQKPGCGKGTGVDRSRTSTTIALKKKLKDKMAEFQTLRETIHQEYREVVERRVFTVTGTRADEETIDKLIETGDSEQIFQKAIQEQGRGQIMDTLAEIQERHVAVRELERKLLELQQIFLDMAVLVNAQGDMLDNIESQVSSAVDHVQSGNTALQRAKSLQKNSRKWMCIAIIILLIIVAIIIVAVVKPWSNKKGA

SEQ ID NO: 9563 - protein, 308 aa, Malus domestica
MNDLLTDSFEIPRGQASRDQDIELGAHASMNSGELGLENFFKKVQEIEKQNEKLDKLLKKLQGAHEESKAITKAPSMKSIKQRMEKDVDEVGKVARWIKSKIEELDKENLANRQKAGCGKGTGVDRSRTATTLALKKKLKDKMAEFQTLRETIHQEYRDVVERRVFTVTGARADEETIERLIETGDSEQIFQKAIQEQGRGQIMDTLAEIQERHDAVRDLEKKLLDLQQIFMDMAVLVDAQGELLDNIETQVSSAVDHVQQGNTALQKAKKLQKNSRKWMCIAILILLIIVAIIVVAVFKPWQSNKGA

SEQ ID NO: 9564 - protein, 308 aa, Quercus alba
MNDLLTDSFEIPQGQASRGGDIELGAQASMNSGELGLESFFKQVTEIEKQYGKLDNLLKKLQDAHEESKAVTKAPAMKAIKQRMEKDIDEVGKVSRYIKSKIEGLDKENLTNRQKPGCGKGTAVDRTRMATTISLKKKLKDKMAEFQTLREAIHKEYCEVVERRVFTVTGTRADEETIERLIETGDSEQIFQKAIQEQGRGQIMATVAEIHERHDAVREVERKLLDLQQIFLDMAVLVDAQGEMLDNIESQVSSAVDHVQQGNTALQKAKKLQKNSRKWMCIAIIILLIIVAIIVVAVIKPWSSNKGA

SEQ ID NO: 9565 - protein, 304 aa, Manihot esculenta
MNDLLSESFEIPRGQSSRAGDVEMGMSSGDLGLESFFKKVQEIENQNEKLDKLLKKLQDAHEESKAVTKAPAMKAIKKRMEKDVDEVGKIARSVKSKVEELDKENLANRQKPGCGKGTGVDRSRTSTTMALKKKLKDKMAEFQSLRETIHQEYREVVERRVFTVTGTRADEETIDRLIETGDSEQIFQKAIHEQGRGQVMDTLAEIQERHDAVRDLEKKLLDLQQIFLDMAVLVDAQGEMLDNIESQVSSAVDHVQSGNTALQKAKKLQRNSRKWMCIAIIILLLIVVIIVVAVIKPWSNNKGA

SEQ ID NO: 9566 - protein, 308 aa, Castanea mollissima
MNDLLTDSFEIPRGQASRGGDIELGAQASMNSGELGLESFFKQATEIEKQYGKLDNLLKKLQGAHEESKAVTKAPAMKAIKQRMEKDIDEVGKVSRYIKSKIEGLDKENLTNRQKPGCGKGTAVDRTRMATTISLKKKLKDKMAEFQTLREAIHKEYCEVVERRVFTVTGTRADEETIERLIETGDSEQIFQKAIQEQGRGQIMATVAEIHERHDAVREVERKLLDLQQIFLDMAVLVDAQGEMLDNIESQVSSAVDHVQQGNTALQKAKKLQKNSRKWMCIAIIILLIIVAIIVVAVIKPWSSSKGA

SEQ ID NO: 9567 - protein, 304 aa, Manihot esculenta
MNDLLSESFEIPRGQGSRGGDIEMGMTSTETGLENFFKKVQEIEKQNEKLDKLLKKLQDANEESKAVTKAPAMKAIKQRMEKDVDEVGKIARSLKSKIEELDKENLANRQKPGCGKGTGVDRSRTSTTMALKKKLKDKMAEFQNLRETIHQEYREVVERRVFTVTGTRADEETIDRLIETGDSEQIFQNAIHEQGRGQIMDTLAEIQERHDAVRDLERKLLDLQQVFLDMAVLVDAQGEMLDNIESQVSSAVDHVQSGNTALQRAKSLQKSSRKWMCIAIIILLIIVAIIVVAVIKPWSSNKGA

SEQ ID NO: 9568 - protein, 138 aa, Fagus grandifolia
MNDLLSDSFEIPRSQASRGGDIELGANASMNSGELGLENFFKQVTEIEKQYGKLDNLLKKLQDAHEESKAVTKAPSMKAIKQRMEKDIDEVGKVSRYLKSKIEGLDKENLTNRQKPGCGKGTAVDRTRMATTVSLKKS

SEQ ID NO: 9569 - protein, 308 aa, Carica papaya
MNDLLKDSFEIPRGHSSRSGDIEMGGNAPSNSGDLGLEDFFKKVQEIEKQNEKLDKLLKKLQNAHEESKAVTKAPAMKAIKQRMEKDVDEVGKIARSMKGKIEELDRENLSNRQKPGCGKGSGVDRSRTATTLSLKKKLKDKMAEFQILRETIHQEYREVVERRVFTVTGTQADEETIDRLIETGDSEQIFQKAIQEQGRGQIMDTLAEIQERHDAVRDLEKKLLELQQIFLDMAVLVDAQGEMLDNIESHVSSAVDHVQSGNTALQKAKKLQKSSRKWMCIAIIILLIIVAIIVVGVLKPWTSNKGA

SEQ ID NO: 9570 - protein, 64 aa, Vaccinium corymbosum
MNDLLSGSFEIPRGQDNGGDLEMGTQRPMNSGELGLDNFFKQVQEIEKQYDKLNKLLKKAPGCP

SEQ ID NO: 9571 - protein, 308 aa, Tripterygium wilfordii
MNDLLADSFEIPRGQPSRGGDIEMGTNAPMNSGNLGLEDFFKKVQEIEKQNEKLDKLLKKLQDAHEQSKAVTKAPAMKAIKQRMEKDVDEVGKVARLIKTKIEQLDKENLANRQKPGCGKGTGVDRSRTATTIALKKKFKDKMTESQTLRENIHQEYREVVERRVFTVTGTRADEETIDRLIETGDSEQIFQKAIHEQGRGQVVDTVAEIQERHVAVRDLEKKLLELQQIFMDMAVLVDAQGDMLDNIESQVSSAVDHVQSGNTALQKAKSLQKSSRKWMCIAIIILLIIVAIIIVAVFKPWNKNNGA

SEQ ID NO: 9572 - protein, 232 aa, Tabernaemontana elegans
MKAIKQRMEKDVDEVGKIARFIKSKIEEIDRENLANRQKPGCGKGSAVDRSRSATTVSLKKKFKDKMSEFQTLRESIHQEYREVVERRVFTVTGTRADEETVDRLIETGDSEQIFQKAIQEQGRGQIMDTLAEIQERHDAVRELERKLLELQQIFMDMAVLVDAQGDMLDNIESQVSSAVDHVQSGNTALQKAKKLQKNSRKWMCIAIIILLIIVAIIVVGVLKPWKSNNGA

SEQ ID NO: 9573 - protein, 304 aa, Ricinus communis
MNDLLSESFEIPRGQGSRGGDIEMGMNSGDLGLENFFKNVQGIEKENEKLDRLLKKLQDAHEETKAVTRAPAMRAIRQRMDKDVDEVGKIARTVKSKIEELDRENISNRQKPGCGKGTGVDRSRTSTTMALKKKLKDKMAEFQNLRETIHQEYRDVVDRRVFTVTGARADEETIDRLIETGDSEQIFQKAIQEQGRGQIMDTLAEIQERHDAVRDLERKLLDLQQVFLDMAVLVDAQGEMLDNIESQVSSAVDHVQSGNTALQKAKKLQRNSRKWMCIAIIILLIIVVIIVVAVIKPWNNNKGA

SEQ ID NO: 9574 - protein, 311 aa, Fragaria vesca
MNDLLTDSFEIPRGQPPRNGDIELGTGSTDITMNSGELGLENFFKKVQEIEKQNEKLDKLLRKLQDAHEETKTVTKAPSMKAIKKRMEKDVDEVGKIARFIKSKIEELDRENLANRQKPGCGKGTGVDRSRTATTLALKKKLKNKMSEFQTLREIIHQEYREVVERRVFTVTGTRADEETIERLIETGDSEQIFQKAIHEQGRGQITDTLAEIQERHDAVRDLEKKLLDLQQIFLDMAVLVDAQGELLDNIETQVSSAVDHVQQGNTALHKAKKLQKNSRKWMCIAILILLIIVVIIVVAVLKPWSSNNGA

SEQ ID NO: 9575 - protein, 306 aa, Citrus clementina
MNDLLGGSFELPRDQSSRGGDIELGAQMNSGELGLENFFKKVQDIDKEYEKLEKLLKKLQGAHEESKSVTKAPAMKAIKKRMEKDVDEVGKISRFIKSKIEELDRENLTSRQKPGCGKGTGVDRSRTATTLGLKKKFKDKMGEFQVLRENIHQEYREVVERRVYTVTGKRADEETIDQLIETGDSEQIFQKAIQEQGRGQIMDTLAEIQERHDAVRDLERKLLELQQIFLDMAVLVDAQGDMLDNIESQVSSAVDHVQSGNTALQKAKKLQKNSRKWMCIAIIILLIIVAIIVVAVIKPWSSNKGA

SEQ ID NO: 9576 - protein, 308 aa, Gossypium hirsutum
  Sequence also found in Organisms: Gossypium raimondii
MNDLLSDSFEIPRGQGQGSHGGDIELGAQANADELGLQNFFKKVQEIDKQYEKLDKLLKKLQDAHEESKAVTKAPAMKSIKQRMEKDVDEVGKISRFVKGKIDELDRENLANRQKPGCGKGTGVDRSRTSTTLAVKKKLRDKMAEFQTLRETIHQEYRDVVERRVFTVTGTRPDEETIEKLIDTGDSEQIFQKAIQEQGRGRIMDTVSEIHERHEAVRDLEKKLLDLQQIFLDMAVLVDAQGDMLDNIESQVSSAVDHVQSGNTALQRAKSLQKNSRKWMCIAIIILLLIVVIIVVAVIKPWSSNKGA

SEQ ID NO: 9577 - protein, 308 aa, Olea europaea
MNDLLKDSFEIPRDQSSKNGDIEMGTQIAQNSGDLGLDNFFKQVQEIEKHSEKLNKLLKKLQDAHEESKAITKAAAMKAIKKRMEKDVDEVGKIARLIKSKIEELDKENLANRQKPGCGKGSGVDRSRTATTVAMKKKFKDKMSEFQTLRESIHQEYREVVERRVFTVTGNRADEETIDRLIETGDSEQIFHKAIQEQGRGQIMDTLAEIQERHDAVRDLEKKLLDLQQIFMDMAVLVDAQGDMLDNIESQVSSAVDHVQSGNTALQKAKSLQKNSRKWMCIAILILLIIVAIIVVGVLKPWQNNNGA

SEQ ID NO: 9578 - protein, 70 aa, Cucurbita pepo
MNDLLSDSFEIPRGQPSRGGDIELGTNAPTSAGDLGLDDFFKKVQDIENRMRSWTGYCESSRIHTRSPKL

SEQ ID NO: 9579 - protein, 285 aa, Tripterygium wilfordii
MGANAPMNSGDLGLEDFFKKVQEIEKQNEKLDKLLKKLQDAHEQSKAVTKAPAMKAIKQRMEKDVDEVGKVARLIKTKIEQLDKENLTNRQKPGCGKGTGVDRSRTVTTIALKKKFKDKMDEFQTLRENIQQEYREVVERRVFTVTGTRADEETVDRLIETGDSEQIFQKAIHEQGRGQVVDTVAEIQERHDAVRDLEKRLLELQQIFMDMAVLVDAQGDMLDNIESQVSSAVDHVQSGNTALQRAKSLQKNSRKWMCIAIIILLIIVVIIVVAVIKPWAKKNGA

SEQ ID NO: 9580 - protein, 308 aa, Fraxinus spp
MNDLLSDSFEIPRDQASRNGDIEMGTQIAQNSGDLGLDNFFKQVQEIEKHSEKLDKLLKKLQDAHEESKAITKAAAMKAIKKRMEKDVDEVGKIARLIKSKIEELDRENLANRQKPGCGKGSGVDRSRTATTIAMKKKFKDKMSEFQTLRESIHQEYREVVERRVFTVTGNRADEETIDRLIETGDSEQIFHKAIQEQGRGQIMDTLAEIQERHDAVRDLEKKLLDLQQIFMDMAVLVDAQGDMLNNIESQVSSAVDHVQSGNTALQKAKSLQKSSRKWMCIAILILLIIVAIIVVGVLKPWKNNNGA

SEQ ID NO: 9581 - protein, 308 aa, Olea europaea
MNDLLTDSFEVPRDQASRNGDIEMGTQLAQNSGDLGLDNFFKQVQEIEKNYEKLDKLLKKLQDAHEESKAITKAAAMKAIKKRMEKDVDEVGKIARLIKSKIEELDRENLANRQKPGCGKGSGVDRSRTATTVAMKKKFKDKMSEFQTLRESIHQEYREVVERRVFTVTGNRADEETIDKLIETGDSEQIFQKAIQEQGRGQIMDTLAEIQERHDAVRDLEKKLLDLQQIFMDMAVLVDAQGDMLNNIESQVSSAVDHVHSGNTALQKAKSLQKNSRKWMCIAIVILLIIVAIIVVGVLKPWQNNNGA

SEQ ID NO: 9582 - protein, 308 aa, Gossypium hirsutum
MNDLLSDSFEIPRGQGQGSHGGDIELGAQANADELGLQNFFKKVQEIDKQYEKLDKLLKKLQDAHEESKAVTKAPAMKSIKQRTEKDVDEVGKISRFVKGKIDELDRENLANRQKPGCGKGTGVDRSRTSTTLAVKKKLRDKMAEFQTLRETIHQEYRDVVERRVFAVTGTRPDEETIEKLIDTGDSEQIFQKAIQEQGRGRIMDTVSEIHERHEAVRDLEKKLLDLQQIFLDMAVLVDAQGDMLDNIESQVSSAVDHVQSGNTALQRAKSLQKNSRKWMCIAIIILLLIVVIIVVAVIKPWSSNKGA

SEQ ID NO: 9583 - protein, 308 aa, Triphysaria pusilla
MNDLLTDSFAAPRDQDNRGGDIEMGMERQMNSGDLGLEDFFKQVQEIEKQYEKLNTLLRKLQDAHEETKAVTKAASMKAIKKRMEKDVDEVGKIARSIKSKIEELDKENLANRQKPGCGKGSGVDRSRTSTTVALKKKFKDRMTEFQTLRENIHQEYREVVERRVFTVTGNRADEETIDQLIETGDSEQIFQKAIREQGRGQVMDTLAEIQERHDAVRDLEKKLLDLQQIFLDMAVLVDAQGDMLDNIESQVSSAVDHVQSGNTALQKAKSLQKNSRKWMCIAIIILLIIVAIVVVGVLKPWQNKNGA

SEQ ID NO: 9584 - protein, 304 aa, Euphorbia peplus
MNDLLSESFEIPRGQASRGGDIEMGITSEDTGLDTFFKKVQTIEKQNDKLDNLLKKLQAANEESKAVTKAPAMKAIKQRMEKDVDEVGKIARSLKSKIEELDRENLANRQKPGCGKGTAVDRSRTSTTMALKKKFKDKMGEFQNLRETIHQEYREVVERRVFTVTGTRADEETVERLIETGDSEQIFQKAIQEQGRGQVMDTLAEIQERHDAVRDLERKLLELQQVFLDMAVLVDSQGEILDNIESQVSSAVDHVQSGNTALQRAKKLQKNSRKWMCIAIIILLIIVAIIVVAVIKPWNSNKGA

SEQ ID NO: 9585 - protein, 308 aa, Echinacea purpurea
MNDLLSESFENPRGQDHGYGDLEMGTQRNADSGESGLDDFFKKVQAIEKQYEKLNKLLKKLQDAHEESKAVTKAAAMKAIKQRMEKDVDEVGKIARFIKSKIEELDKENLANRQKPGCGKGTGVDRSRTSTTLSLKKKFKDKMTEFQTLRESIHQEHREVVERRVYTVTGTRADEETIDRLIETGDSEQIFQKAIQEQGRGQVLDTLAEIQERHDAVREVERKLLDLQQIFMDMAVLVDAQGEMLDNIETQVSSAVDHVQDGNKALHKAKSLQKNSRKWMCIAILILLVIIAVVVVGVLKPWKSGNGA

SEQ ID NO: 9586 - protein, 308 aa, Flaveria ramosissima
MNDLLSESFENPRGQDNGYGDLEMGTQRNADSGELGLDDFFKKVQAIEKQYEKLNKLLKKLQDAHEESRAVTKAAAMKAIKQRMEKDVDEVGKIARFIKSKIEELDKENLANRQKPGCGKGTGVDRSRTATTLSLKKKFKDKMSEFQTLRESIHQEHREVVERRVYTVTGTRADEETIDRLIETGDSEQIFQKAIREQGRGQVLDTLAEIQERHDAVREVERKLLDLQQIFMDMAVLVDAQGEMLDNIETQVSSAVDHVQDGNKALHKAKSLQKNSRKWMCIAILILLIIIAVVVVGVLKPWKSGNGA

SEQ ID NO: 9587 - protein, 307 aa, Citrullus lanatus
MNDLLSDSFEIPRGQPSRGGDIELGTNVPTSGGDGLEDFFKKVQEIEKQNEKLDRLLRKLQDSHEESKAVTKAPAMKAIKQRMEKDVDEVGKVARFVKIKVEELDRENLANRQRPGCGKGSGVDRSRTATTLSLKKKLKDKMTEFQILREKIHQEYQEVVERRVFTVTGARADEETIEKLIETGDSEQIFQKAIQEQGRGQVMDTLAEIQERHSAVRELERKLLELQQVFLDMAVLVDAQGDMLDNIESHVTSAVDHVQQGNTALQKAKKLQKNSRKWMCIAIIILLIIVVVIVVGVLKPWNNGKGA

SEQ ID NO: 9588 - protein, 308 aa, Ambrosia trifida
MNDLLSESFDNPRGQDHGYGDLEMGTQRNADSGELGLDDFFKKVQAIEKQYEKLNKLLKKLQDAHEESRAVTKAAAMKAIKQRMEKDVDEVGKIARFIKAKIEELDKENLANRQKPGCGKGTGVDRSRTATTVSLKKKFKDKMTEFQTLRESIHQEHREVVERRVYTVTGTRADEETIDRLIETGDSEQIFQKAIREQGRGQVLDTLAEIQERHEAVREVERKLHDLQQIFMDMAVLVDAQGEMLDNIETQVSSAVDHVQDGNKALHKAKSLQKNSRKWMCIAILILLVIIAVVVVGVLKPWKNGNGA

SEQ ID NO: 9589 - protein, 595 aa, Zea mays
MVGLQYDLVGNPLGAVRATFERTAAAAAAQSGGADPVAAFRGKDWGAGDLFRSFLFEQDGLGKVPVLDSSNLGLIKPNTLVRYRGMVQDMLGNEYYIGAFKDGSTWRTNKYTDFSPYSMPHPCDSHLWERHLFHCVPAPGQNSWTLESSPGPDVCRMSNCLAPELREKRKRDGDDDAMDVSENGHGNSSFCKKPKEGDVHVSSSSTEVAGTIPEMNGGDHHIPGSSFSCLVKIYDMPDSQVKLNDVIEFIGVYTFDPELAAPSDNPDDIMLDLIEDVTVQLPPSKVPRLHCLVWRKLSFHDFISRPVVEPSPSLLRGIRQSLLSHLTLVLGNDELAAQCLLLHLLSRLRNRVDVVTVGRLSLNFTGFNRESASIFGNQLYSLIQKLVPYSQAIPLSIEYLNTATLQPRKDNKSGRLVTGVLQLPQGTHLIFDETLLQTGSLTSKGVENTMLLKNLMESQKVDYDFEYYKLEMAADVQLLTLSEGKSNILPSDLVVPFRPSSVPTVNAGAEETESWRWFLTTVRSLPQSTEPETYQMIQDEMVSAMRDDRSLGCSELSRWLTMAQIMASSFGEKSLSLEHWQMVKELERLRKQRMQ

SEQ ID NO: 9590 - protein, 596 aa, Setaria italica
MVGPQYDLVGNPLGAVRATFERTAAAAAAESGGSDPVAAFRGKDWGACDLFRSFLLEEDGLDKVPVLNASNLGLIKPNTLVRYRGMVQDMLGNEYYIGAFKDGSTWRTNKFTDFSPFSMPHPCDSHLWERHLFHCVPAPGQNSWTMESSPGPDLRRMSSCLATELREKRKRDGDKDDMDVSENGHEESSALCKKPKEDDVHVSSGSNEVAEGVPEMNRGDHIPGSSFSCLVKVYDMPDSQVKLNDVIEFIGVYTFDPELAAPSDNPDDIMLDLIEDVIVQLPPSKVPRLHCLVWRKLSPHDFISRPPVVEPSPSILKGIRQSLLSHLTLVLGNDELAAQCLLLHLLSRLRNRVDLVTVGRLSLNFTGFNRESASIFGNQLYSLIQKLVPYSQAIPMSIEYLNTATLQPRKDNKSGRLVTGVLQLPQGSHLTFDETLLQTGSLTSKGVENTMLLKNLMESQKVDYDFEYYKLDMATDVQLLTLSEGKSNILPSDLVVPFRPSSVPTIDAGSEELENWRWYLATVRSLPQSTEPETYQMIQDEMVSAMRDDRSLGCSELSRWLTMAQIMASSFGEKSLSLEHWQMVKELERLRKQRLQ

SEQ ID NO: 9591 - protein, 595 aa, Panicum virgatum
MVGPQYDLVGNPLGAVRATFERAAAAAAAESGGSDPVAAFRGKDWGACELFRSFLFEEDGVDKVPVLNASNLGLVKPNTLVRYRGMVQDMLGNEYYIGAFKDGSTWRTNKFTDFPPFSMPHPCDFHLWERHLFHCVPAPGQNSWTLESSPGPDVRRMSSCLATELREKRKRDGDNDDMDVSENGHEESPLLCKKAKEDDVHVSSSSTEVADGVPEMNGGDHHIPGSSFSCLVKVYDMPDSQVKLNDVIEFFGVYTFDPELATPSDNSDDIMLDLIEDVTVQLPPSKVPRLHCLVWRKLSPHDFISRSPVVEPSPSILKGIRQSLLSHLTLVLGNDELAAQCLLLHLLSRLRNRVDVVTVGRLSLNFTGFNRESASIFGNQMYSLIQKLVPYSQTIPMSIEYLNTATLQPRKDKSGRLVTGVLQLPQGSHLTFDETLLQTGSLTSKGVENTMLLKNLMESQKVDYDFEYYKLDMPTDVQLLTLSEGKSNILPSDLVVPFRPSSVPTINEGSEELENWRWYLATVRSLPQSTEPETYQMIQDEMVSAMRDDRSLGCSELSRWLTMAQIIASSFGEKSLSLEHWQMVKELERLRKQRL

SEQ ID NO: 9592 - protein, 599 aa, Secale cereale
MVGPQYDLVGNPLGAVRATFERAAAAAAAESGGRDPVAAFRSKDWGASEIFRSFLFEQGGLDKVPLLDASNLGLIKPNTLVRFRGMVQDMLGNEFYAGAFKDGSTWRTNKFTDFSPFTMPHPCDSHLWERHLFHCVPVPGQNSWTLESSPGPDVRQMANCLTPEQREKRKRDGDDDAMDVSENGNGESSSCSKKPKEDDVQIPSSSAEMPASENVPQMNGNDHHIPGSSFSCLVKIYDMPESQVKLNDVAEFIGVYTFDPELAAPNDNSDDIMYDLIEDVTAQLPPSKVPRLHCLVLRKLSSVDFLAKHPAVEPSPSLLKGIRQSLLSHLTLVLGKDDLAANCLLLHLLSRLRTRVDVVTVGRLSLNLTGFNRESVSIFGKQLNTLIQGLMPYSQAIPLSIEYLNTATLQPRKDNKSGRLVTGVLQLPQGSHLTFDETLLQSGSLASKGVENTVLLKNLMESQMVEYDFEYYKLEMATDVQLLTLSEGKSNILPSDLVVPFRPSTVSAVNATSEELESWRWYLATVRSLPQSSEPDIYQTIQDEMVSAMRNDRSLGCTELSRWLTMAQITASSFGEKSLSLEHWQMVKELERLRKERMQ

SEQ ID NO: 9593 - protein, 599 aa, Hordeum vulgare
MVGPQYDLVGNPLGAVRATFERAAAAAAAESGGRDPVAAFRSKDWGASEVFRSFLFEQGGLDKVPVLDASNLGLIKPNTLVRFRGMVQDMLGNEFYAGAFKDGATWRTNKFTDFSPFSMPHPCDSHLWERHLFHCVPVPGQNSWTLDSSPGPDLRQMVNCLSPEQREKRKRDGDDDAMDVSENGNGESSSCSKKPKEDDVQIPSSSAEMPASENMPQMNGNDHHIPGSSFSCLVKIYDMPESQVKLNDVAEFIGVYTFDPELAAPNDNSDDIMYDLIEDVTAQLPPSKVPRLHCLVWRKLSSVDFLAKHPAVEPLPSLLKGIRQSLLSHLTLVLGKDDLAANCLLLHLLSRLRTRVDVVTVGRLSLNFTGFNRESVSIFGKQLNTLIQGLMPYSQAIPLSIEYLNTATLQPRKDNKSGRLVTAILQLPQGTHLTFDETLLQSGSLASKGVENTVLLKNLMESQMVEYDFEYYKLEMATDVQLLTLSEGKSNILPSDLVVPFRPSTVSEVNATSEELESWRWYLATVRSLPQSSEPEIYQTIQDEMVSAMRNDRSLGCTELSRWLTMAQITASSFGEKSLSLEHWQMVKELERLRKERMQ

SEQ ID NO: 9594 - protein, 597 aa, Lolium multiflorum
MVGPQYDLVGNPLGAVRTTFEKAAAAAAAESGGRDPVAAFRSKDWGASEVFRSFLFDQGGIDKVPLLDASNLGLIKPNTLVRFRGMVQDMLGNEFYAGAFKDGSTWRTNKFTDFSPFAMPHPCDSHLWERHLFHCVPVPGQNSWTLESTPGPDLRQMSSCMSPEQREKRKRDGDDDVMDVSENGNGESSSSKKPKEDGIQISSNSAEMPATEAVPEMNGNDHHIPGSSFSCLVKIYDMPESQVKLNDVAEFIGVYTFDPELAAPNDNSDDIMFDLIEDVTAQLPPSKVPRLHCLVWRKLSSQDFLAKQPVEPLPSLLKGIRQSLLSHLTQLLGNDDLAAQCLLLHLLSRLRTRVDVVTVGRLSLNFTGFNRESASIFGNQLNTLIQRLVPYSQAIPLSIEYLNTTTLQPRKDNKSGRLVTGVLQLPQGTHLTFDETIMQSGSLTSKGVENTMLLKNLMESLMVEYDFEYYKLEMATDVQMLTLSEGKSNILPSDLVVPFRPSTVPAVTATPEELESWRWYLATVRSLPQSNEPEILQTIQDEMVNAMREDRSLGCSELSRWLTMAQITASSFGEKSLSMEHWQMVKELERLRKQRMQ

SEQ ID NO: 9595 - protein, 600 aa, Brachypodium distachyon
MVGPQYDLVGNPLGAVRSTFERAAAAAAAESGGRDPVAAFRAKDWGATEVFRSFLFDQGGIDKVPVLDASNLGLIKPNTLVRFRGMVQDMLGSEFYAGAFKDGSTWRTNKFTDFSPFTMPHPCDSHLWERHLLHCVPVPGQNSWTMESSPGPDLRQMSNCSTSEQRDKRKRDGDDDAMDVSENGNGEGSSFSKKPKEDGVQGSSSSPEMPVSEDRVPEMNGDDHHIPGSFFSCLVKVYDMPESQVKLNDVAEFIGVYTFDPELAAPVDNSDDIMFDLLEDVTAQLPPSKVPRLHCLMSRKLSCHDFLSKQPAVEPSPSLLKGIRQSLLSHLTLVLGKDDLAAHCLLLHLLSRLRTKVDLVTVGRLSLNFTGFNRESASIFGNRLNTLVQRLVPYSQAIPLSIDYLNTATLQPRKDNKSGRLVTGVLQLPQGTHLTFDETLLQSGSLASKGVENTVLLKNLMESQMVEYDFEYYKLEMATDVQLLTLSEAKSNILPSDLVVPFRPSSVPAVNASLEELESWRWYLATVRSLPQLSEPETYQAIQDDMVNVMRNDRSLGCSELSRWLTMAQLTASSFGEKSLSMEHWQMVKELERLRKERMQ

SEQ ID NO: 9596 - protein, 600 aa, Brachypodium distachyon
MVGPQYDLVGNPLGAVRSTFERAAAAAAAESGGRDPVAAFRAKDWRATEVFRSFLFDQGGIDKVPVLDASNLGLIKPNTLVRFRGMVQDMLGSEFYAGAFKDGSTWRTNKFTDFSPFTMPHPCDSHLWERHLLHCVPVPGQNSWTMESSPGPDLRQMSNCSTSEQRDKRKRDGDDDAMDVSENGNGEGSSFSKKPKEDGVQGSSSSPEMPVSEDRVPEMNGDDHHIPGSFFSCLVKVYDMPESQVKLNDVAEFIGVYTFDPELAAPVDNSDDIMFDLLEDVTAQLPPSKVPRLHCLMSRKLSCHDFLSKQPAVEPSPSLLKGIRQSLLSHLTLVLGKDDLAAHCLLLHLLSRLRTKVDLVTVGRLSLNFTGFNRESASIFGNRLNTLVQRLVPYSQAIPLSIDYLNTATLQPRKDNKSGRLVTGVLQLPQGTHLTFDETLLQSGSLASKGVENTVLLKNLMESQMVEYDFEYYKLEMATDVQLLTLSEAKSNILPSDLVVPFRPSSVPAVNASLEELESWRWYLATVRSLPQLSEPETYQAIQDDMVNVMRNDRSLGCSELSRWLTMAQLTASSFGEKSLSMEHWQMVKELERLRKERMQ

SEQ ID NO: 9597 - protein, 544 aa, Pennisetum glaucum
SFLFQEDGLDKVPVLNASNLGLIKPNTLVRYRGMVQDMLGNEYYIGAFKDGSTWRTNKFTDFSPFSMPHPCDSHLWERHLFHCVPAPGQNSWTLESSPGPDVRRMSSCLTTELRDKRKRDGDNADMDVSENGHEESSALCKKPKEDDVNISSSSTEVAEGVPEMNGGNHHIPGSSFSCLVKVYDMPDSQVKLNDVIEFIGVYTFDPELAAPSDNTDDIMLDLIEDVTVQLPPSKVPRLHCLVWRKLSPHDFISRPAVEPSPSILKGIRQSLLSHLTLVLGNDELAAQCLLLHLLSRLRNRVDVVTVGRLSLNFTGFNRESASIFGNQLYSLIQKLVPYSQAIPMSIEYLNTATLQPRKDNKSGRLVTGVLQLPQGSHLTFDETLLQTGSLTSKGVENTMLLKNLMESQKVDYDFEYYKLDMATDVQLLTLSEGKSNILPSDLVVPFRPSSVPKINEGSEELENWRWYLATVRSFPQSTEPETYQMIQDEMVSAMRDDRSLGCSELSRWLTMAQIVASSFGEKSLSLEHWQMVKELERLRKQRLQ

SEQ ID NO: 9598 - protein, 597 aa, Oryza sativa
MVGPQYDLVGNPLGAVRSTFERAAAESGGHEPVAAFRGKDWGATEVFRSFLFEQGGLDKVPVLDESNLGLIKPNTLVRFRGMVQDMLGNEFYVGAFKDGSTWRTNKFSDSSPFSMPHPCDSHLWERHLFHCVPVPGQNSWTRESSPGPDLRRIASCFTSEQREKRKRGADNDAMDVSESGSGETSSSSKKTKDDGVKISNSSVEMSMNEEHHVPEMNGGDHHIPGSSFSCLVKVYDMPESQVKLNDVSEFIGVYTFDPELAAPNDNSDDIMFDLMEDVTAQLPPSKVPRLHCLVWRNLSAHDFLPRPPAVEPSPILLRGIRQSLLSHLTLVLGKDELAAQCLLLHLLSRLRNKVDVVTVGRLSLNFTGFNRESVSIFGNQLNNLFQRLLPYSQVIPLSIEYLNTATLQPRKDNQSGRLVTGVLQLPQGTHLTFDETLLQSGSLTSKGVENTMLLKNLIESQKVEYDFEFYKLEMATDVQLLILSEGKSNILPSDLIVPFRPSSVPAVNASSEELESWRWYLATVRSLPQSTETDTYQMIQDEMVNAMRDDRSLGCSELSRWLTMAQIMAASFGEKSLSMEHWQMVKELERLRKERLQ

SEQ ID NO: 9599 - protein, 542 aa, Panicum virgatum
MSRKKYLQVPVLNASNLGLIKPNTLVRYRGMVQDMLGNEYYIGVFKDGSTWRTNKFTDFSPFSMPHPCDSHLWERHLFHCLPAPGQNSWTLESSPGPDVRRLSSYLAPELREKRKREGDNDDMDVSENGHEGSPLLCKKPKEDDVHVSSSSTEVADGVPEMNGGDHHIPGSSFSCLVKVYDMPDSQVKLNDVIEFFGVYTFDPELATPSDNSDDIMLDLIEDVTVQLPPSKVPRLHCLVWRKLSPHDFISRPPVVEPSPSILKGIRQSLLSHLTLVLGNDELAAQCLLLHLLSRLRNRVDVVTVGRLSLNFTGFNRESASIFGNQLYCLIQKLVPYSQAIPMSIEYLNTATLQPRKDNKSGRLVTGVLQLPQGSHLTFDETLLQSGSLTSKGVENTMLLKNLMESQKVDYDFEYYKLDMATDVQLLTLSEGKSNILPSDLVVPFRPSSVPTINEGSEELESWRWYLATVRSLPQSTEPETYQMIQDEMVSAMRDDRSLGCSELSRWLTMAQIIASSFAEKSLSLEHWQMVKELERLRKQRLQ

SEQ ID NO: 9600 - protein, 623 aa, Zea mays
MDAAKSVTPGAVSYILAHPSTGSDGAVSDLVVQVLDLKSIGMGSRFSFTATDGNDKIKAMLPTYFASEVHSGNLKNFGLIRILDYTCNSVKGNADKVLIVVKCETVCEALDAEINGEAKKEDPPIVLKPKDEGSVVAEETNSPPLVMKPKQEVKSASQIVTEQRGNAAPATRLSMTRRVHPLITLNPYQGNWVIKVRVTSKGNLRTYRNARGEGCVFNVELTDEDGTQIQATMFNEAAKKFYPIFELGKVYYVSKGSLRIANKQFKTVKNDYELSLNENAIVEEAEGETFLPPVQYNLVKIDQLGPYVGGRELVDIVGVVQSVSPTLSVRRKIDNETIPKRDIVVADDSGKTVTISLWNDLATTTGQELLDMVDSSPVVAIKSLKVSDFQGVSLSTIGRSTLEINPDLPEAKNLKSWYDSEGKDTSLAPISAEVGATRAGGFKSMYSDRVFLSHITSDPAMGQEKPVFFSLYAIISHIKPDQNMWYRACTTCNKKVTEAFGSGYWCEGCQKNYSECSLRYIMVIKLSDPTGEAWVSVFNEHAEKIIGCSADELDRIRKEEGDDSYVLKLKEATWVPHLFRVSVTQHEYMNEKRQRITVRGEAPVDFAAESKYLLEEIAKLTAC

SEQ ID NO: 9601 - protein, 617 aa, Zea mays
MDAAKLVTPVAVSHILAHPSAGSDGAVTDLVVQVLDLKSVGTGSRFSFTATDGKDKIKAMLPTNFGSEVRSGNLKNLGLIRIIDYTCNVVKGKDDKVLVVIKCELVCQALDAEINGEAKKEEPPIVLKPKDECVGVTPPLAMKPKQEVKSASQIVNEQRGNTAPVKPLSMTKRVHPLITLNPYQGNWVIKVRVTSKGNLRTYRNARGEGCVFNVELTDEDGTQIQATMFNDAAKKFYPIFELGKVYYVSKGSLRIANKQFKTVQNDYEMSLNENAIVEEAEGETCIPQVQYNLVKIDQLGSYVGGRELVDIVGVVQSVSPTLSVRRKIDNETIPKRDIVVADDSGKTVSISLWNDLATTTGQELLDMADSSPVVAIKSLKVSDFQGVSLSTVGKSTLAINPDLHEAQNLKSWYDSEGKDTSLAPIGAEMGAARAGGFKSTYSDRVFLSHITSDPAMGQEKPVFFSLYATISHIKPDQNMWYRACKTCNKKVTETFGSGYWCEGCQKNDSECSLRYIMVIKVSDPTGEAWVSVFNEHAEKIIGCSADELDRIRKEEGDDSYVLKLKEATWVPHLFRVSVTQHEYNNEKRQRITVRSEAPVEHAAESKYLLEQIAKLTA

SEQ ID NO: 9602 - protein, 623 aa, Setaria italica
MDAAKSVTPGAVSHILEKPSPADAATVPELVVQVVDLKSIGNRFGFMASDGKDKIKAMLPTQFAAEVRSGNLQNLGLIRILDYTCNAVGGNNDNKALIITKCEVVSQALDAEIKSEAKKEEEPAIVIKPKDEEMVLSKPVNAPPVVLKPKLEVKSASQIVNEQRGNAAPAARLSMTRRVHPLISLNPYQGNWVIKVRVTSKGNLRTYKNARGEGCVFNVELTDEDGTQIQATMFNEAAKKFYPMFELGKVYYVSKGSLRIANKQFKTVQNDYEMTLNESAVVEEAEGETFIPPVQYNFVKIDQLGSYVNGRELVDIVGVVQSVSPTMSIRRKLDNETIPKRDIVVADDSGKTVSISLWNDLATTTGQELLDMVDSSPIIAIRSLRVSDFQGVSLSTVGKSTLMVNPDLPEVHNLKSWYDNEGKGTSMAPIGADMGAARAGGLRSMYSDRVFLSHITSDPNMGQEKPVFFSLNAIISHIKPDQNMWYRACKTCNKKVTEAVGGGYWCEGCNKNDAECSLRYIMVIKVSDPTGEAWVSVFNEHAERIIGCSADELDRIRKEEGDDSYIQKLKEATWVPHLFRVSVAQHEYMNERRQRITVRTEAPVDYAAESKYLLEEIAKLTAC

SEQ ID NO: 9603 - protein, 624 aa, Panicum virgatum
MDAAKSVTPGAVSHILANPSPGDAAEVPELVVQVVDLKSIGTGSRFSFVASDGKDKMKAMLPTQFAEEVRSGKLQNLGLIRILDYTCNDVPRSNDKALIISKCEVVSQALDAEIKSEAKKEEEPAIVLKPKDEGVVVPKPVNAPPVVLKPKQEVKSASQIVNEQRGNAAPAARLAMTRRVHPLISLNPYQGNWVIKVRVTNKGNLRTYKNARGEGCVFNVELTDEDGTQIQATMFNEAAKKFYPMFELGKVYYVSKGSLRIANKQFKTVQNDYEMTLNENAVVEEAWGETIIPQVQFNFVKIDQLGSYVNGRELVDIVGVVQSVSPTLSVRRKRDDETIPKRDIVVADDSGKTVSVSLWNDLATTTGEELLDMVDSSPIIAIKSLRVSDFQGLSLSTVGKSTLLVNPDLPEAQNLKSWYDSEGKGTKMAPIGADMGAVRAGGLRSMYSDRVFLSHITSDPNLGQEKPVFFSLNAIISHIKPDQNMWYRACKTCNKKVTEAVEGGYWCEGCNKNDAECSLRYIMVIKVSDPTGEAWVSVFNEHAEKIIGCSADELDQIRREEGEDSYILKLKEVTWVPHLFRVSVAQHEYMNERRQRITVRTEAPVDYVAESKYLLEEIAKLTAC

SEQ ID NO: 9604 - protein, 686 aa, Panicum virgatum
KLSTGTNGRSLAISPPNPPYKRAHRPGQLRCISAAAQSSPPVRAKPTFLPGDESADERRHGRRHVRHAGHHVPHPCEPVTGDAAEIPELVVQVVDLKSIGTGSRFSFMASDGKDKIRAMLPTQLAPEVHSGNLQNLGLIRILDYTCNALPPKNDKALIISKCEVASQALDAEIISEDKKQEGPAIVLKPKDEGVVLSKPANAPLVVLKPKQEVKSASQIVNEQRGNACSAAPAARLAMTRRVHPLISLNPYQGNWVIKVRVTNKGNLRTYKNARGEGCVFNVELTDEDGTQIQATMFNEAAKKFYPMFELGKVYFVSKGSLRIANKQFKTVQNDYEMTLNENAVVEEAEGETIIPQVQFNFVKIDQLGSYVNGRELIDIVGVVQSVSPTLSVRRKRDDETIPKRDIVVADDSGKTVSVSLWNDLATTTGQELMDMVDSSPIVAIKSLRVSDFQGVSLSTVGKSTLLVNPDLPEAQNLKSWYDSEGKGTSMAPIGADMGVARAGGLRSMYSDRVFLSHITSDPNMGQEKPVFFSLNAIISHIKPDQNMWYRACKTCNKKVTEAVEGGYWCEGCNKNDAECSLRYIMVIKVSDPTGEAWVSVFNEHAERIIGCSADELDRIRREEGDDSYILKLKEATWVPHLFRVSVAQHEYMNERRQRTTVRTEAPVDYAAESKYLLEEIAKLTAC

SEQ ID NO: 9605 - protein, 292 aa, Zea mays
MGSPGSANGRRGEYVRIPEEVEVASKGEADAAAAIKAAVAAECPRVLRCRAIRWWAKVAVLGIFLAGAGAAAVVFLGPLVIKKVVAPILYWESITFSRPAIALICFGTIALFPSVLLPSSPFMWLAGMTFGYLYGFLIITVGMSIGMSLPYFIGSAFHCRIHRWLEKWPKKAAFVRLAGEGDWHHQFKAVALLRISPFPYLVFNYASVATNVKYYPYIAGSMAGTIHETFLAIYSGKLLQSLAVATSQGSFLSVDQIIYNGIGFTIAATSTAAITIYAKKALQKLQAEDEIF

SEQ ID NO: 9606 - protein, 292 aa, Setaria italica
MGSPGSANGRHGEYVRIPEEVEVAVKGEADAATAVKAAAAAECPTVLRWRAIRWWAKVAVLGIFLAGAGAAAVVFLGPLVIKKVVAPILYWESTTFSRPAIALICFGAIALFPSVLLPSSPFMWLAGMTFGYLYGFLIITAGMSIGMSLPYFIGSAFHCRIHRWLEKWPKKAAFVRLAGEGDWHHQFKAVALLRISPFPYIVFNYASVATNVKYCPYIAGSMAGTIHETFLAIYSGKLLQSLALATSQGSFLSVDQIIYNGIGFTIAAASTAAITIYAKKALQKLQAEDEIF

SEQ ID NO: 9607 - protein, 292 aa, Panicum virgatum
MGSPGSANGRRGEYVRIPEEVEAAAKGEADAATALKAAAAAECPRVLRWRAIRWWAKVAVLGIFLAGAGAAAVVFLGPLVIKKVVAPILYWESTTFSRSAIALICFGAIALFPSVLLPSSPFMWLAGMTFGYLYGFLIIQAGMSIGMSLPYFIGSAFHCRIHRWLEKWPKKAAFVRLAGEGDWHHQFRAVALLRISPFPYIVFNYASVATNVKYCPYIAGSMAGTIHETFLAIYSGKLLQSLAVATSKGSFLSVDQIIYNGIGFTIAAASTAAITIYAKKALQKLQAEDEIF

SEQ ID NO: 9608 - protein, 292 aa, Panicum virgatum
MGSPGSANGRRGEYVRIPEEVEVAAKGEADTATALKAAAAAECPRVLRWRAIRWWAKVAVLGIFLAGAGAAAVVFLGPLVIKKVVAPILYWESTTFSRPAIALICFGAIALFPSVLLPSSPFMWIAGMTFGYLYGFLIIQAGMSIGMSLPYFIGSAFHCRIHRWLEKWPKKAAFVRLAGEGDWHHQFRAVALLRISPFPYIVFNYASVATNVKYCPYIAGSMAGTIHETFLAIYSGKLLQSLAVATSEGSFLSVDQIIYNGIGFTIAAASTAAITIYAKKALQKLQAEDEIF

SEQ ID NO: 9609 - protein, 292 aa, Echinochloa colona
MGSPGSANGRRGEYVRIPEEVEVAAKGEADAATAVKAAAAAECPRVLRWRAIRWWAQVAVIGILLAGAGAAAVVFLGPLAIKKVVAPILYWESTTFSRPATALICFGAIALFPSVLIPSSPFMWLAGMTFGYFYGFLIITAGMSIGMSLPYFIGSAFHCRIHRWLEKWPKKAAFVRLAGEGDWHHQFRAVALLRISPFPYIVFNYASVATNVKYCPYIAGSMAGTIHETFLAIYSGKLLQSLAVATSKGSFLSLDQIIYNGIGFTIAAASTAAITIYAKKALQKLQAEDEIF

SEQ ID NO: 9610 - protein, 292 aa, Zea mays
MGSPGSANGRRGDYVRIPEEAEVASKGEGDAAAAVKAAAAAECPRVLRCSAIRWWAKVAVLGIFLAGAGAAAVVFLGPLLIKKIVVPILHWESTTFSRPSIALICFGTIALFPSVLLPSSPFMWLAGMTFGYLYGFLIITVGMSIGMSLPYFIGSAFHCRIHRWLEKWPKKAAFVRLAGEGDWHHQFKAVALLRISPFPYIVFNYASVATNVKYYPYIAGSMAGTIHETFLAIYSGKLLQSLAVATSQGSFLSVDQIIYNGIGFIVAAASTATITIYAKKALQRLQAEEEIL

SEQ ID NO: 9611 - protein, 266 aa, Pennisetum glaucum
PEEVEVAVKGEAVAAECPTVLRWRAIRWWAKVAVLGIFLAGAGAAAVVFLGPLVIKKIIAPILYWESTTFSRPAIALICFGAIALFPSVLLPSSPFMWLAGMTFGYFYGFLIITAGMSIGMSLPYFIGSAFHCRIHRWLEKWPKKAAFVRLAGEGDWHHQFKAVALLRISPFPYIVFNYASVATNVKYCPYIAGSMAGTIHETFLAIYSGKLLQSLALATSQGSFLSVDQIIYNGIGFTIAAASTAAITIYAKKALQKLQAEDEIF

SEQ ID NO: 9612 - protein, 253 aa, Saccharum officinarum
AAECSRVLRCRAIRWWAKVAVLGIFLAGAGAAAVVFLGPLLIKKVVAPILYWESTTFSRPAIALICFGAIALFPSVLLPSSPFMWLAGMTFGYLYGFLIITVGMSIRMSLPYFIGSAFHCRIHRWLEKWPKKAAFVRLAGEGDWHHQFKAVALLRISPFPYIVFNYASVATNVKYYPYIAGSMAGTIHETFLAIYSGKLLQSLAVATSHGSFLSLDQIIYNGIGFTIAAASTAAITIYAKKALQKLQAEDEIF

SEQ ID NO: 9613 - protein, 287 aa, Triticum aestivum
MGMSGAASGGAGCGRGEYMRIPEDVDAIKEAVKEEGECPRLLRCRAIRWWAKVAVLGIFLAGAAAAAVVFLGPLVIKKVVVPIIDWQSRTFSRPVILLICFGAIALFPSVLIPSSPFMWIAGMTFGYGYGFLIITTAMSIGMSLPFCIGSAFHSRIHRWLEKWPKKAAFVRLAGEGDWFHQFRAVALLRISPFPYIVFNYASVATNVKYCPYIAGSMAGTIHETLLAIYSGKLVQSLAAATSQGSFLSVDQIIYNGIGFTVAAVSTAAITIYAKKALQKLQAEDELC

SEQ ID NO: 9614 - protein, 995 aa, Setaria italica
MDDSLYDEFGNYIGPELADSDADDDSDAGGASPSPSASRSPSPAARSPSGSPSRPAALMDVDDDEDGDPSQQAVVLAEDKKYYPTAEEVYGPGVEALVMDEDEQPLEQPIVAPPRVVKFEVGTRAAATSTYASTDFLLGLAGNPALVRNVALVGHLQHGKTVFMDMLVEQTHEVDTFDSEGERHVRFTDTRVDEQERQVSIKAVPMSLVLEGGNGKSYLCNIMDTPGHVNFSDEMTAALRLADGAVLVVDAAEGVMVNTERAIRHAIQERLPIVVVINKVDRLITELKLPPNDAYFKLRHTLEAINDLISSCSTTVGGTQLVDPAAGNVCFASGAAGWSFTLQSFAHLYLKIHGIQFDHEKFASRLWGDVYFHPDSRTFKKKPPKEGANRSFVEFILEPLYKIYSLVVGEQKGNVESKLAELGVTLSNAAYKLNVRPLLRLACRSIFGTATGFTDMLVKHIPSVKDAAARKIDHIYTGPQDSSIVDAMKKCDPNGHLMVNVTKLYPKSDCSVFDAFGRVYSGTIQTGQTVRVLGEGYSPDDEEDMTVKEVTKLWVYQARYRVAISKAPAGSWVLIEGVDASIMKTATICPMNIDEDVYIFRPLRFNTLPVVKIAAEPLNPSELPKMVEGLRKISKSYPLAITKVEESGEHTILGTGELYLDSIMKDLRELYSEVEVKVADPVVTFCETVVDTSSMKCFAETPNKRNKITMVAEPLEKGLTEDIENGLVNLDSRQKEITDFFRQRYQWDVLAARSIWAFGPDKQGPNILLDDTLSVEVDKNLLNAIKDSIVQGFQWGAREGPLCDEPIRNVKFKILHANIAPEPLHRGGGQIIPTARRVVYSAFLMANPRLMEPVYYVEIQTPIDCVSAIYTVLSRRRGHVTADVPKPGTPIYIVKAFLPVIESFGFETDLRYHTQGQAFCVSVFDHWAIVPGDPLDKSIVLRPLEPAPIQHLAREFMVKTRRRKGMSEDVSISKFFDEAMMHELAQQAADLHIQM

SEQ ID NO: 9615 - protein, 995 aa, Panicum virgatum
MDDSLYDEFGNYIGPELADSDADDDSDAGGASPSPAASRSPSPAARSPSGSPSRPAALMDVDDDEDGDPSQQAVVLAEDKKYYPTAEEVYGPGVEALVMDEDEQPLEQPIVAPPRVVKFEVGTRAAATSTYASTDFLLGLAGNPALVRNVALVGHLQHGKTVFMDMLVEQTHEVDTFDSEGERHVRFTDTRVDEQERQVSIKAVPMSLVLEGGNGKSYLCNIMDTPGHVNFSDEMTAALRLADGAVLVVDAAEGVMVNTERAIRHAIQERLPIVVVINKVDRLITELKLPPNDAYFKLRHTLEAINDLISSYSTTVGGTQLVDPAAGNVCFASGAAGWSFTLQSFAHLYLKIHGIQFDHEKFASRLWGDLYFHPDSRTFKKKPPKEGANRSFVEFILEPLYKIYSLVVGEQKGNVESKLAELGVTLSNAAYKLNVRPLLRLACRSIFGTATGFTDMLVKHIPSVKDAAARKIDHIYTGPQDSSIVDAMNKCDPNGPLMVNVTKLYPKSDCSVFDAFGRVYSGTIQTGQTVRVLGEGYSPDDEEDMTVKEVTKLWVYQARYRVAISKAPAGSWVLIEGVDASIMKTATICPMNIDEDVYIFRPLRFNTLPVVKIAAEPLNPSELPKMVEGLRKISKSYPLAITKVEESGEHTILGTGELYLDSIMKDLRELYSEVEVKVADPVVTFCETVVDTSSMKCFAETPNKRNKITMVAEPLEKGLAEDIENGLVNLDFRQKEITDFFRQRYQWDVLAARSIWAFGPDKQGPNILLDDTLSVEVDKNLLNAINDSIVQGFQWGAREGPLCDEPIRNVKFKILHANIAPEPLHRGGGQIIPTARRVVYSAFLMANPRLMEPVYYVEIQTPIDCVSAIYTVLSRRRGHVTADVPKPGTPIYIVKAFLPVIESFGFETDLRYHTQGQAFCVSVFDHWAIVPGDPLDKSIVLRPLEPAPIQHLAREFMVKTRRRKGMSEDVSISKFFDEAMMHELAQQAADLHIQM

SEQ ID NO: 9616 - protein, 995 aa, Panicum virgatum
MDDSLYDEFGNYIGPELADSDADDDSDAGGASPSPSASRSPSPAARSPSGSPSRPAALMDVDEEEDGDPSQQAVVLAEDKKYYPTAEEVYGPGVEALVMDEDEQPLEQPIVAPPRVVKFEVGTRAAATSTYASTDFLLGLAGNPALVRNVALVGHLQHGKTVFVDMLVEQTHEVDTFDSEGERHVRFTDTRVDEQERQVSIKAVPMSLVLEGGNGKSYLCNIMDTPGHVNFSDEMTAALRLADGAVLVVDAAEGVMVNTERAIRHAIQERLPIVVVINKVDRLITELKLPPNDAYFKLRHTLEAINDLISSCSTTVGGTQLVDPVAGNVCFASGAAGWSFTLQSFAHLYLKIHGIQFDHEKFSSRLWGDLYFHPDSRTFKKKPPKEGANRSFVEFILEPLYKIYSLVVGEQKGNVESKLAELGVTLSNAAYKLNVRPLLRLACRSIFGSATGFTDMLVKHIPSVKDAAARKIDHIYTGPQDSSIVDAMKKCDPNGPLMVNVTKLYPKSDCSVFDAFGRVYSGTIQTGQTVRVLGEGYSPDDEEDMTVKEVTKLWVYQARYRVAISKAPAGSWVLIEGVDASIMKTATICPMNIDEDVYIFRPLRFNTLPVVKIAAEPLNPSELPKMVEGLRKISKSYPLAITKVEESGEHTILGTGELYLDSIMKDLRELYSEVEVKVADPVVTFCETVVDTSSMKCFAETPNKRNKITMVAEPLEKGLAEDIENGLVNLDSRQKEITDFFRQRYQWDVLAARSIWAFGPDKQGPNILLDDTLSVEVDKNFLNSIKDSIVQGFQWGAREGPLCDEPIRNVKFKILHANIAPEPLHRGGGQIIPTARRVVYSAFLMANPRLMEPVYYVEIQTPIDCVSAIYTVLSRRRGHVTADVPKPGTPIYIVKAFLPVIESFGFETDLRYHTQGQAFCVSVFDHWAIVPGDPLDKSIVLRPLEPAPIQHLAREFMVKTRRRKGMSEDVSISKFFDEAMMHELAQQAADLHIQM

SEQ ID NO: 9617 - protein, 997 aa, Oryza sativa
MDDSLYDEFGNYIGPELADSDADDSDADASPSPSPSRSPSPSARSPSGSPSRPAALMDVDGGDDDDDADPSQSAVVLAEDKKYYPTAEEVYGPGVEALVMDEDEQPLEQPIVAPPRVVRFEVGTRAEATSTYATTDFLLGLAANPALVRNVALVGHLQHGKTVFMDMLVEQTHEVDTFDSEGERHVRFTDTRVDEQERRVSIKAVPMSLVLEGGNGKSYLCNIMDTPGHVNFSDEMTAALRIADGAVLVVDAAEGVMVNTERAIRHATQERLPIVVVINKVDRLITELKLPPNDAYFKLRHTLEAINDLISSCSTTVGGTQLVDPAAGNVCFASGSAGWSFTLQSFAHLYLKIHGIQFDHEKFASRLWGDLYYHPDTRTFKKKPPKEGANRSFVEFVLEPLYKIYSQVVGESKGKVEATLSELGVTLSNAAYKLNVRPLLRLACRSIFGTSTGFTDMLVKHIPSVKDAAPRKIEHIYTGPQDSTIVDAMKKCDPHAPLMVNVTKLYPKSDCSVFDAFGRVYSGTIQTGQTVRVLGEGYSPDDEEDMTVKEVTKLWVYQARYRVPISKAPAGSWVLIEGVDASIMKTATICPMKMDEDVYIFRPLRFNTLPVVKIAAEPLNPSELPKMVEGLRKISKSYPLAVTKVEESGEHTILGTGELYLDSIMKDLRELYSEVEVKVADPVVTFCETVVDTSSMKCFAETPNKRNKITMVAEPLEKGLAEDIENGLVSLDSRQKEITDFFRQRYQWDVLAARSIWAFGPEKQGPNILLDDTLSVEVDKNLLNAVKDSIVQGFQWGAREGPLCDEPIRNVKFKILNANIAPEPLHRGGGQIIPTARRVVYSAFLMANPRLMEPVYYIEIQTPIDCVSAIYTVLSRRRGHVTADVPKPGTPIYVVKAFLPVIESFGFETDLRYHTQGQAFCLSVFDHWAIVPGDPLDKNIVLRPLEPAPIQHLAREFMVKTRRRKGMSEDVSINKFFDEAMMNELAQQAADLHLQMM

SEQ ID NO: 9618 - protein, 995 aa, Brachypodium distachyon
MDDSLYDEFGNYIGPELADSDADDSDAAASPSPSPSRSPSPARSLSGSPNSRRPAALMDVDDDDYADASPNAVVLAEDKKYYPTAEEVYGPGVEALVMDEDEQALEQPIVAPPRVVKFEVGTRAGATSTYASTDFVLGLAANPLLVRNVALVGHLQHGKTVFMDMLVEQTHEVDTFDSEGERHVRFTDTRVDEQERRVSIKAVPMSLVLEGGNGKSYLCNIMDTPGHVNFSDEMTAALRLADGAVLVVDAAEGVMVNTERAIRHAIQERLPIVVVINKVDRLITELKLPPNDAYFKIRHTLDTINDLISSCSTTVGGTQLVDPAAGNVCFASGSAGWSFTLQSFAHLYGKIHGIPFDHEKFASRLWGDLYYHHGSRTFKKKPPAEGANRSFIEFILEPLYKIYSQVVGEQKSLVESTLADLGVTLSNAAYKLNVRPLLRLACRSIFGTATGFTDMLVKNIPSVKDAAARKIEHIYTGPQDSSIVEAMKKCDSNGPLMVNVTKLYPKSDCSVFDAFGRVYSGTIQTGQTVRVLGEGYSPDDEEDMTVKEVTKLWVYQARYRVPISKAPAGSWVLIEGVDASIMKTATICPMNMDDDVYIFRPLRFNTLPVVKIAAEPLNPSELPKMVEGLRKISKSYPLAITKVEESGEHTILGTGELYLDSIMKDLRELYSEVEVKVADPVVTFCETVVDTSSMKCFAETPNKRNKITMLAEPLEKGLAEDIENGLVSLDSRQKEVTDFFRQRYQWDVLAARSIWAFGPDKQGPNILLDDSLSVEVDKNLLNAVKDSIVQGFQWGAREGPLCDEPIRNVKFKILNANIAPEPLHRGGGQIIPTARRVVYSAFLMANPRLMEPVYYIEIQTPIDCVSAIYTVLSRRRGHVTADVPKPGTPIYVVKAFLPVIESFGFETDLRYHTQGQAFCVSVFDHWAIVPGDPLDKSIVLRPLEPAPIQHLAREFMVKTRRRKGMSEDVSINKFFDEAMMNELAQQAADLHLQMM

SEQ ID NO: 9619 - protein, 937 aa, Triticum aestivum
MDVDDDDYADAAQNAVVLAEDKKYYPTAEEVYGPGVEALVMDEDEQALEKPIVAPPRVVKFEVGTRAGATSTYASTDFILGLASNPLLVRNVALVGHLQHGKTVFMDMLVEQTHEVDTFDSEGERHIRFTDTRVDEQERRVSIKAVPMSLVLESGNGKSYLCNIMDTPGHVNFSDEMTAALRLADGAVLVVDAAEGVMVNTERAIRHAIQERLPIVVVINKVDRLITELKLPPNDAYFKLRHTLDTINDLISSCSTTVGGTQLVDPAAGNVCFASGSAGWSFTLQSFAHLYLKIHGIQFDHEKFASRLWGDLYYDHNSRTFKKKPPAAGANRSFIEFILEPLYKIYSQVVGEQQKILEITLADLGVTLSNAAYKLNVRPLLRLACRSIFGTATGFTDMLVKNIPNVKDGAARKIEHIYTGQQDSSIVDAMKKCDSHGPLMVNVTKLYPKPDCSVFDAFGRVYSGTIQTGQTVRVLGEGYSPDDEEDMTVKEVTKLWVYQARYRVPISKAPAGSWVLIEGVDASIMKTATICPMNMDEDVYIFRPLRFNTLPVVKIAAEPLNPSELPKMVEGLRKISKSYPLAITKVEESGEHTILGTGELYLDSIMKDLRELYSEVEVKVADPVVTFCETVVDTSSMKCFAETPNKRNKITMLAEPLEKGLAEDIENGLVSLDSRQKEVTDFFRQRYQWDVLAARSIWAFGPDKQGPNILLDDSLSVEVDKNLLNAVKDSIVQGFQWGAREGPLCDEPIRNVKFKILNANIAPEPLHRGGGQIIPTARRVVYSAFLMANPRLMEPVYYIEIQTPIDCVSAIYTVLSRRRGHVTADVPKPGTPVYVVKAFLPVIESFGFETDLRYHTQGQAFCVSVFDHWAIVPGDPLDKGIVLRPLEPAPIQHLAREFMVKTRRRKGMSEDVSINKFFDEAMMNELAQQTADIHLMM

SEQ ID NO: 9620 - protein, 907 aa, Lolium multiflorum
YGPGVEALVMDEDEQALEKPIVAPPRDVKFEVGTRAGATSTYASTDFVLGLASNPLLVRNVALVGHLQHGKTVFMDMLVEQTHEVDTFDSEGERHVRFTDTRVDEQERRVSIKAVPMSLVLEGGNGKSYLCNIMDTPGHVNFSDEMTAALRLADGAVLVVDAAEGVMVNTERAIRHAIQERLPIVVVINKVDRLITELKLPPTDAYFKLRHTLDTINDLISSCSTTVGGTQLVDPAAGNVCFASGSAGWSFTLQSFAHLYLKIHGIPFDHEKFASRLWGDLYYDHTSRTFKKKPPAVGANRSFIEFILEPLYKIYSQVVGEQKRNVESTLADLGVTLSNAAYKLNVMPLLRLACRSIFGTATGFTDMLVKNIPNVKDAAARKIEHIYTGQQDSALVDAMKKCDSQGPLMVNVTKLYPKPDCSVFDAFGRVYSGTIQTGQTVRVLGEGYSPDDEEDMTVKEVTKLWVYQARYRVPISKAPAGSWVLIEGVDASIMKTATICPMNMDDDVYIFRPLRFNTLPVVKIAAEPLNPSELPKMVEGLRKISKSYPLAITKVEESGEHTILGTGELYLDSIMKDLRELYSEVEVKVADPVVTFCETVVDTSSMKCFAETPNKRNKITMLAEPLEKGLAEDIENGLVSLDSRQKEVTDFFRQRYQWDVLAARSIWAFGPDKQGPNILLDDSLSVEVDKNLLNAVKDSIVQGFQWGAREGPLCDEPIRNVKFKILNANIAPEPLHRGGGQIIPTARRVVYSAFLMANPRLMEPVYYIEIQTPIDCVSAIYTVLSRRRGHVTADVPKPGTPVYVVKAFLPVIESFGFETDLRYHTQGQAFCVSVFDHWAIVPGDPLDKNIALRPLEPAPIQHLAREFMVKTRRRKGMSEDVSINKFFDEAMMNELAQQAADLHLQMM

SEQ ID NO: 9621 - protein, 995 aa, Elaeis guineensis
MDESLYDEFGNYIGPEIESDRDSDDAGDSGDESPAGSARSDDEADATPSPSANGWITASGAGADDMDTDPAASQIVLAEDKKYYPTAEEVYGEGVETLVMDEDEQPLEQPIIKPVRTVKFEVGVKDSSTYVSTEFLLGLASNPSLVRNVALVGHLHHGKTVFMDMLVEQTHEISTFDPDSERHMRYTDTRIDEQERRISIKAVPMSLVLEDSNAKSYLCNIMDTPGHVNFSDEMTAALRLADGAVLVVDAAEGVMVNTERAIRHAIQERLPIVVVINKVDRLITELKLPPTDAYFKLRHTLEVINDLISSFSTSVGGTQVVDPAAGNVCFASASAGWSFTLQSFAKLYVKLHGIPFDYSKFAARLWGDLYYHPNERVFRKKPPMGGGERSFVQFILEPLYKIYSQVIGEHKKSVEATLSELGVTLSNAAYKLNVRPLLRLACSSVFGSATGFTDMLVQHIPSAKDAAAKKIEHIYTGPQDSYIAEAMKDCDPYGPLMVNVTKLYPKSDCSVFDAFGRVYSGTIQTGQTLRVLGEGYSPDDEEDMTVKEVTKLWVYQARYRIPISKAPAGSWVLIEGVDASIMKTATLCPLDMDEDVCIFRPLRFNTLPVVKTATEPLNPSELPKMVEGLRKISKSYPLAITKVEESGEHTILGTGEIYLDSIMKDLRELYSEVEVKVADPVVTFCETVVETSSMKCFAETPNKRNKITMIAEPLERGLAEDIENGVVSIDSKQKDISDFFQKRYDWDLLSARSIWAFGPDKQGPNILLDDTLPSEVDKNLLSAVKDSIVQGFQWGAREGPLCDEPIRNVKFKILNASIAAEPLHRGGGQIIPTARRVVYSAFLMANPRLMEPVYYVEIHTPIDCVSAIYTVLSRRRGHVTADVPKPGTPVYVVKAYLPVIESFGFETDLRYHTQGQAFCLSVFDHWAIVPGDPLDKSIVLRPLEPAPIQHLAREFMVKTRRRKGMSEDVSINKFFDEAMMVELAQQAADLHLQMM

SEQ ID NO: 9622 - protein, 995 aa, Cocos nucifera
MDESLYDEFGNYIGPEIESDGDSEDAGDSGDESPAGSARSDDEADASPSPSANGWITTNGAGADDMDTDPAASQIVLAEDKKYYPTAEEVYGEGVEALVMDEDEQPLEQPIIKPVRTVKFEVGVKDSSTYVSTEFLLGLASNPSLVRNVALVGHLHHGKTVFMDMLVEQTHEISTFDADSERHMRYTDTRIDEQERRISIKAVPMSLVLEDGNAKSYLCNIMDTPGHVNFSDEMTAALRLADGAVLVVDAAEGVMVNTERAIRHAIQERLPIVVVINKVDRLITELKLPPTDAYFKLRHTLEVINDLISSFSTSVGGTQVVDPAAGNVCFASASAGWSFTLQSFAKLYVKLHGIPFDYSKFAARLWGDLYYHPNERVFRKKPPMGGGERSFVQFILEPLYKIYSQVIGEHKKSVETTLGELGVTLSNAAYKLNVRPLLRLACSSVFGSATGFTDMLVQHIPSAKDAAAKKIEHIYTGPQDSYIAEAMKNCDPYGPLMVNVTKLYPKSDCSVFDAFGRVYSGTIQTGQTLRVLGEGYSPDDEEDMTVKEVTKLWVYQARYRIPISKAPAGSWVLIEGVDASIMKTATLCPLDMDEDVYIFRPLRFNTLPVVKTATEPLNPSELPKMVEGLRKISKSYPLAITKVEESGEHTILGTGEIYLDSIMKDLRELYSEVEVKVADPVVTFCETVVETSSMKCFAETPNKRNKITMIAEPLERGLAEDIENGVVSIDSKQKDISDFFQKRYDWDLLSARSIWAFGPDKQGPNILLDDTLPSEVDKNLLSAVKDSIVQGFQWGAREGPLCDEPIRNVKFKILNASIAAEPLHRGGGQIIPTARRVVYSAFLMANPRLMEPVYYVEIHTPIDCVSAIYTVLSRRRGHVTADVPKPGTPVYVVKAYLPVIESFGFETDLRYHTQGQAFCLSVFDHWAIVPGDPLDKSIVLRPLEPAPIQHLAREFMVKTRRRKGMSEDVSINKFFDEAMMVELAQQAADLHLQMM

SEQ ID NO: 9623 - protein, 971 aa, Musa acuminata
MDDSLYDEFGNYIGPEIESDVGSDASDDDASTVDNAGGPDDMDVDAAASQIVLAEDKKYYPTAEEVYGEGVETLVMDEDEQPLEQPIIKPVRTLKFEVGVKDSSTYVSTEFLLGLASNPSLVRNVALVGHLQHGKTVFMDMLVEQTHEISTFDVQNERHIRYTDTRIDEQERRISIKAVPMSLVLEDSNAKSYLCNIMDTPGHVNFSDEMTAALRLADGAVLVVDAAEGVMVNTERAIRHAIQERLPIVVVMNKVDRLITELKLPPTDAYFKLRHTLEAINDLISSCSTTVGGTQMVDPVAGNVCFASANAGWSFTLQSFAKLYLKLHGIPFDSVKFASRLWGDMYYHPDQRVFKKKPPMAGGERSFVQFILEPLYKIYSQVIGEHKKSVEATLAELGVTLSNAAYKLNVKPLLRLACSSVFGFATGFTDMLVQHIPSARDAATKKVEHIYTGPQDSYIAEAMKNCDPYGPLMINITKLYPKSDCSVFDAFGRVYSGTIQTGQTLRVLGEGYSPEDEEDMTVKEVTKLWVYQARYRIPISKAPAGSWVLIEGVDASIMKTATLCPLYMDEDVYIFRPLRFNTLSVVKTATEPLNPSELPKMVEGLRKISKSYPLAITKVEESGEHTILGTGEIYLDSIMKDLRELYSEVEVKVADPVVTFCETVVETSSMKCFAETPNKRNKITMVAEPLEKGLAEDIENGVVSIDARQRDISDFFQKRYDWDLLSARSIWAFGPDKQGPNILLDDTLPSEVDKNLLNAVRDSIVQGFQWGAREGPLCDEPIRNVKFKILNASIAPEPLHRGGGQIIPTARRVVYSAFLMANPRLMEPVYYVEIQTPIDCVSAIYTVLSRRRGHVTQDVPKPGTPVYIVKAFLPVIESFGFETDLRYHTQGQAFCLSVFDHWAIVPGDPLDKNIVLRPLEPAPIQHLAREFMVKTRRRKGMSEDVSINKFFDEAMVVELAQQAADVHLQIM

SEQ ID NO: 9624 - protein, 971 aa, Musa acuminata
MDDSLYDEFGNYIGPEIESDVGSDASDDDASTGDNAGGPDDMDVDAAASQIVLAEDKKYYPTAEEVYGEGVETLVMDEDEQPLEQPIIKPVRTLKFEVGVKDSSTYVSTEFLLGLASNPSLVRNVALVGHLQHGKTLFMDMLVEQTHEISTFDVQNERHIRYTDTRIDEQERRISIKAVPMSLVLEDSNAKSYLCNIMDTPGHVNFSDEMTAALRLADGAVLVVDAAEGVMVNTERAIRHAIQERLPIVVVMNKVDRLITELKLPPTDAYFKLRHTLEAINDLISSCSTTVGGTQMVDPVAGNVCFASANAGWSFTLQSFAKLYLKLHGIPFDSVKFASRLWGDMYYHPDQRVFKKKPPMAGGERSFVQFILEPLYKIYSQVIGEHKKSVEATLAELGVTLSNAAYKLNVKPLLRLACSSVFGFATGFTDMLVQHIPSARDAATKKVEHIYTGPQDSYIAEAMKNCDPYGPLMINITKLYPKSDCSVFDAFGRVYSGTIQTGQTLRVLGEGYSPEDEEDMTVKEVTKLWVYQARYRIPISKAPAGSWVLIEGVDASIMKTATLCPLYMDEDVYIFRPLRFNTLSVVKTATEPLNPSELPKMVEGLRKISKSYPLAITKVEESGEHTILGTGEIYLDSIMKDLRELYSEVEVKVADPVVTFCETVVETSSMKCFAETPNKRNKITMVAEPLEKGLAEDIENGVVSIDARQRDISDFFQKRYDWDLLSARSIWAFGPDKQGPNILLDDTLPSEVDKNLLNAVRDSIVQGFQWGAREGPLCDEPIRNVKFKILNASIAPEPLHRGGGQIIPTARRVVYSAFLMANPRLMEPVYYVEIQTPIDCVSAIYTVLSRRRGHVTQDVPKPGTPVYIVKAFLPVIESFGFETDLRYHTQGQAFCLSVFDHWAIVPGDPLDKNIVLRPLEPAPIQHLAREFMVKTRRRKGMSEDVSINKFFDEAMVVELAQQAADVHLQIM

SEQ ID NO: 9625 - protein, 422 aa, Allium cepa
MDDSLYDEFGNYIGPDILSDNEDESDHSVSDEPDSPSPSDAMGPALTNGGGLDAMDEDDVDPTSNQIVLAEDKKYYPTAEEVYGEDVETLVMDEDDQPLELPIINPVRVVKHEVPQTKDLENAASTYVSTDFLLGLASNPSLVRHVALVGHLQHGKTVFMDMLVEQTHDKIVTFDVERERHVRFTDTRVDEQERRISIKAMPMSLVLEDGNGKSYLCNIMDTPGHVNFSDEMTAALRLADGAVLVVDAAEGVMVNTERAIRHAIQERLPIVVVINKVDRLITELKLPPQDAYFKLRHTLEVINDLISSASTSAGGIQNVDPAAGNVCFASGSAGWSFTLQSFAKLYVKLHGIPFDHNKFASRLWGDIYYHPDTRTFKKKPPAGGGERSFVQFILEPLYKIYSQVIGEHKKVLRLLCLNSALH

SEQ ID NO: 9626 - protein, 987 aa, Amborella trichopoda
MDDSLYDEFGNYIGPDIDSDQDASDADDRPSDDDDEMPDAAAGASPSRAGSPENWLGEVAEGEAPGQVVLAEDKKYYPTAQEVYGEGVEALVMDEDAQPLEQPIIKPPRNVKFEIGVKDSSTYVSTQFLLGLASNPSLVRNVALVGHLQHGKTVFMDMLVEQTHMIETFDPDSEKHMRYTDTRIDEQERRVSIKAVPMSLVLEDSNAKSYLCNIFDTPGHVNFSDEMTAALRLADGAVVVVDAAEGVMVNTERAIRHAIQERLPIVVVINKVDRLITELKLPPADAYHKLRHTLEVINDFISSFSTTAGGIQAIDPAAGNVCFASASAGWSFTLQSFAKLYVKLHGIPFDAARFASLLWGDIYYHPNERTFKRKPPLSGGERSFVQFLLEPLYKIYSQVIGEHRKSVEVTLAELGVTLSNAAYKLNVRPLLRLACSSIFGSATGFTDMLVEHIPSAKDAAIKKVEHIYTGPQDSLVVEAMKDCDPSGPLMVNVTKLFPKSDCSVFDAFGRVYSGTIQTGQTVRVLGEGYSPEDEEDMTVKEVTKLWVYQARYRLPISKAPAGSWVLIEGVDASIMKTATLCPEYMDEDIYIFRPLRFNTLPVVKTATEPLNPSELPKMVEGLRKISKSYPLAITKVEESGEHTILGTGELYLDSIMKDLRELYSEVEVKVADPVVSFCETVVESSSIKCFAETPNKKNKITMLAEPLEKGLAEDIENGVVSIDWPRKKLGDFFQSKYDWDLLAARSIWAFGPDKQGPNILLDDTLPSEVDKNMLNAVKDSIVQGFQWGAREGPLCDEPIRNVKFKILDATIAPEPLHRGGGQIIPAARRVAYSAFLMATPRLMEPVYYVEIQTPIDCVSAIYTVLSRRRGHVTADVPKPGTPSYIVKAFLPVIESFGFETDLRYHTQGQAFCVSVFDHWAIVPGDPLDKSVVLRPLEPAPVQHLAREFMVKTRRRKGMSEDVSISKFFDDPMLLELARQDADLQHIL

SEQ ID NO: 9627 - protein, 989 aa, Aristolochia fimbriata
MDDSLYDEFGNYIGPEIDSDRESGQDSQEEEEDGDKPIEEAEGSDGEATAAPPNGWLTTSADMDVDNQIVLAEDKKYYPTAEEVYGEDVETLVMDEDEQPLEQPIIKPVRNIKFEVGVKDSSTYVSTQFLLGLMSNPSLVRNVALIGHLQHGKTVFMDMLVEQTHHISTFDQNSEKHMRYTDTRIDEQERKISIKAVPMSLVLEDSNAKSYLCNIMDTPGHVNFSDEMTAALRLADGAVLIVDAAEGVMVNTERAIRHAIQERLPIVVVINKVDRLITELKLPPIDAYHKLRHTLEVINDLISSFSTKAGGIQTVDPVAGNVCFASATAGWSFTLQSFAKLYVKLHGVPFDAGHFAKRLWGDMYYHPEDRKFKRKPPISGGQRSFVQFILEPLYKIYSQVVGEHKKSVEATLAELGVTLSNSAYRLNVRPLLRLACSSVFGTATGFTDMLVEHIPSAKVAAASKIEHIYMGPQDSSNVEAMKDCDAEGPLMVNVTKLYPKSDCSVFDAFGRVYSGTIQTGQTIRVLGEGYSPDDEEDMTVKEVTKLWVYQARYRIPISKAPAGSWVLIEGVDASIMKTATLCPMDLDEEVFIFRPLKFNTLPVVKTATEPLNPSELPKMVEGLRKISKSYPLAITKVEESGEHTILGTGEIYLDSIMKDLRELYSEVEVKVADPVVSFCETVVESSSMKCFAETPNKRNKITMLAEPLERGLAEDIENGVVSIDWPRRKIGDFFQSKYEWDLLAARSIWAFGPDKQGPNILLDDTLPSEVDKNLLNAVKDSIVQGFQWGAREGPLCDEPIRNVKFKILDATIASEPLHRGGGQIIPTARRVAYSAFLMATPRLMEPVYYVEIQTPMDCVSAIYTVLSRRRGHVTADVPQPGTPAYIVKAFLPVIESFGFETDLRYHTQGQAFGLSVFDHWAIVPGDPLDKSIVLRPLEPAPIQHLAREFMVKTRRRKGMSEDVSINKFFDEAMVVELAQQAADLHQQMI

SEQ ID NO: 9628 - protein, 988 aa, Vitis vinifera
MDDSLYDEFGNYIGPEIESDRESDGDDQDEDIPDKPDEEEMVSDVEDAVAASNGWITASNDVDMDNQIVLAEDKKYYPTAEEVYGEDVETLVMDEDEQPLEQPIIKPVRNIKFELGVKDSSTYVSTQFLLGLMSNPALVRNVALVGHLQHGKTLFMDMLVEQTHHISTFDSNSEKHMRYTDTRIDEQERRISIKAVPMSLVLEDSNSKSYLCNIMDTPGHVNFSDEMTAALRLADGAVLIVDAAEGVMVNTERAIRHAIQERLPIVVVINKVDRLITELKLPPKDAYHKLRHTLELINNHISAASSTAGNVQIIDPAAGNVCFASASAGWSFTLQSFAKLYVKLHGVPFDANKFASRLWGDMYYHPDARVFRKKPPASGGERSFVQFVLEPLYKIYSQVIGEHKKSVESTLAELGVTLSNAAYKLNVRPLLRLACSSVFGSATGFTDMLVQHIPSAKDAAAKKVDHIYTGPKDSAIYQAMEDCDSSGPLMVNVTKLYPKSDCSVFDAFGRVYSGEIQTGQTLRVLGEGYSPEDEEDMTVKEVTKLWVYQARYRIPISKAPPGSWVLIEGVDASIMKTATLCNLDYDEDVYIFRPLLFNTLPVVKTATEPLNPSELPKMVEGLRKISKSYPLAITKVEESGEHTILGTGELYLDSIMKDLRELYSEVEVKVADPVVSFCETVVESSSMKCFAETPNKKNKITMIAEPLEKGLAEDIENGVVSIDWHRKKLGDFFQTKYDWDLLAARSIWAFGPDKQGPNILLDDTLSSEVDKNLLNAVKDSIVQGFQWGAREGPLCDEPIRNVKFKIVDARIAPEPLHRGTGQIIPTARRVAYSAFLMATPRLMEPVYYVEIQTPIDCVSAIYTVLSRRRGHVTADVPQPGTPAYIVKAFLPVIESFGFETDLRYHTQGQAFCASVFDHWAIVPGDPLDKSIVLRPLEPAPIQHLAREFMVKTRRRKGMSEDVSINKFFDEAMVVELAQQAADLHQQMI

SEQ ID NO: 9629 - protein, 988 aa, Sesamum indicum
MDDSLYDEFGNYIGPEIESDQESDREEEDEELPERAEDEQPVSDDEHGPGKPNGWLTTTEDVDMDGQIVLAEDKKYYPTAEEVYGEEVETLVMDEDEQPLEQPIIKPVKNLKFELGVKDSSTYVSTQFLLGLMSNPALVRNVALVGHLHHGKTTFMDMLVEQTHHISTFDQNSEKHMRYTDTRIDEQERRISIKAVPMSLVLEDSNSKSYLCNIMDTPGHVNFSDEMTAALRLADGAVLIVDAAEGVMVNTERAIRHAIQERIPIVVVINKVDRLITELKLPPKDAYHKLRHTIEVINNHITAASSTAGNVQVVDPAVGNVCFASASAGWSFTLQSFAKLYVKLHGIPFDANKFASRLWGDYYFDPDTRSFKKKQPASGAERSFVQFVLEPLYKIYSQVIGEHKKSVEATLAELGVTLSNAAYRLNVRPLLRLACSSVFGSATGFTDMLVQHIPSAKDAAPRKVEHIYTGPKDSTIYQAMEDCDASGPLMVNVTKLYPKSDCSVFDAFGRVYSGEIMTGQTVRVLGEGYSPDDEEDMTVKEVTKLWVYQARYRIPISKAPPGSWVLIEGVDASIMKTATLCNLEYDDDVYIFRPLQFNTLPVVKTATEPLNPSELPKMVEGLRKISKSYPLAITKVEESGEHTILGTGELYLDSIMKDLRELYSEVEVKVADPVVSFCETVVESSSMKCFAETPNKKNKITMIAEPLERGLAEDIENGVVSIDWPRKKLGDFFQTKYDWDLLAARSIWAFGPDKQGPNILLDDTLSSEVDKSLLNAVKDSIVQGFQWGAREGPLCDEPIRNVKFKIVDAKIAPEPLNRGTGQIIPTARRVAYSAFLMATPRLMEPVYYVEIQTPIDCVSAIYTVLSRRRGHVTADVPQPGTPAYIVKAFLPVIESFGFETDLRYHTQGQAFCLSVFDHWAIVPGDPLDKSIVLRPLEPAPIQHLAREFMVKTRRRKGMSEDVSINKFFDEAMVVELAQQAADLHQQMM

SEQ ID NO: 9630 - protein, 685 aa, Amorphophallus konjac
PMMRTAAPPPGPPPTAGITAGGDDMEVDAAASQIVLAEDKKYYPTAEEVYGEGVEALVMDEDAQPLEQPIIKPVRTVKFEVGVKDASTYVSTEFLLGLASNPALVRNVALVGHLHHGKTVFMDMLVEQTHHISTFDSGSERHMRYTDTRIDEQERRISIKAVPMSLVLEDSNAKSYLCNIMDTPGHVNFSDEMTAALRLADGAVLIVDAVEGVMVNTERAIRHAIQERLPIVVVINKVDRLITELKLPPTDAYFKLRHTLEAINDLISTFSTTAGGIKPVDPAAGNVCFASASDGLSFTLQSFAKLYVKLHGIPFDHLKFASRLWGDLYYHPDTRSFKRKPPESGGERSFVQFILEPLYKIYSQVIGEHKKSVETTLSELGVTLSNAAYKLNVRPLLRLACSSVFGSATGFTDMLVQHIPSAKDAAGKKIEHIYTGPHDSFIVESMKDCDPSGPLMVNVVKLYPKSDCSVFDAFGRVYSGTIQTGQTLRVLGEGYSPDDEEDMTVKEVTKLWVYQARYRIPISKAPAGSWVLIEGVDASIMKTATLCPLHMDEDVYIFRPLHFNTLSVVKTATEPLNPSELPKMVEGLRKISKSYPLAITKVEESGEHTILGTGEIYLDSIMKDLRELYSEVEVKVADPVVTFCETVQDSSSLKCFAETPNKKTKLLCSLNLWKRDWLRILKMAL

SEQ ID NO: 9631 - protein, 986 aa, Phaseolus vulgaris
MDDSLYDEFGNYIGPEMESDQDSDRDSDPEADDNADGKSDGGAASDGEDPSNGWMTTISEDMENQVVLAEDKKYYPTAEEVYGDDVETLVMDEDEQPLEQPIIKPVRNIKFEVGVKDSSTYVSSQFLLGLMSNPTLVRNVALVGHLQHGKTVFMDMLVEQTHHMSTFDPQSEKHTRYTDTRIDEQERKISIKAIPMSLVLEDSNSKSYLCNIMDAPGHVNFSDEMTAALRLADGAVLIVDAAEGVMVNTERAIRHAIQERLPIVVVINKVDRLITELKLPPKDAYHKLRHTLEVINTHISAASSIAGDVQVVDPVAGNVCFASGTAGWSFTLQSFAKLYGKLHGIPLEASKFASRLWGDYYFHPDTRAFKKKPPATGGERSFVEFVLEPLYKIYSQVIGEHKKSVETTLAELGVTLSNAAYRLNVRPLLRLACSSVFGQASGFTDMLVQHIPSPRDAAITKVDHIYTGPKDSSIYKAMAQCDADGPLMVNVTKLYPKSDCSVFDAFGRVYSGKIQTGQTVRVLGEGYSPDDEEDMTVKEVTKLWVYQARDRMPVAEAPPGSWVLIEGVDASIMKTATLCNVDYDEDVYIFRPLQFNTLSVVKTATEPLNPSELPKMVEGLRKISKSYPLAVTKVEESGEHTILGTGELYLDSIMKDLRELYSEVEVKVADPVVSFCETVVESSSMKCFAETPNKKNKITMITEPLERGLAEDIENGVVSTDWNRKKLGEFFQTKYDWDLLAARSIWAFGPDKQGPNILLDDTLPTEVDKNLLNAVKDSIVQGFQWGAREGPLCDEPIRNVKFKIVDARIAPEPLHRGSGQIIPTARRVAYSAFLMATPRLMEPVYYVEIQTPIDCVSAIYTVLSRRRGHVTADVPQPGTPAYIVKAFLPVIESFGFETDLRYHTQGQAFCMSVFDHWAIVPGDPLDKNIVLRPLEPAPIQHLAREFMVKTRRRKGMSEDVSINKFFDEAMMVELAQQAADLHQQMM

SEQ ID NO: 9632 - protein, 986 aa, Glycine max
MDDSLYDEFGNYIGPEIESDRDSDRDSDADDNPDDQSDAVGAAHSDGEDPSNGWMTTISDELENQVVLAEDKKYYPTAEEVYGEDVETLVMDEDEQPLEQPIIKPVRNIKFEVGVKDSSTYVSSQFLLGLMSNPTLVRNVALVGHLQHGKTVFMDMLVEQTHHMSTFDSQSEKHMRYTDTRIDEQERRISIKAVPMSLVLEDSNSKSYLCNIMDTPGHVNFSDEMTAALRLADGAVLIVDAAEGVMVNTERAIRHAIQERLPIVVVINKVDRLITELKLPPKDAYHKLRHTLEVINTHISAASSIAGGVQVVDPVAGNVCFASATAGWSFTLHSFAKLYGKLHGIPLEANKFASRLWGDYYFHPDTRAFKKKPPASGGERSFVEFVLEPLYKIYSQVIGEHKKSVETTLAELGVSLSNAAYRLNVRPLLRLACSSVFGPASGFTDMLVQHIPSPRDAAIKKVDHIYAGPKDSSIYKAMAQCDSYGPVMVNVTKLYPKSDCSVFDAFGRVYSGKIQTGQTVRVLGEGYSPDDEEDMTVKEVTKLWVYQARDRMPVAEAPPGSWVLIEGVDASIMKTATLCNVDYDEDVYIFRPLQFNTLSVVKTATEPLNPSELPKMVEGLRKISKSYPLAVTKVEESGEHTILGTGELYLDSIMKDLRELYSEVEVKVADPVVSFCETVVESSSMKCFAETPNKKNKITMVAEPLERGLAEDIENGVVSTDWSKKKLGDFFQTKYDWDLLAARSIWAFGPDKQGPNILLDDTLPTEVNKDLMNAVKDSIVQGFQWGAREGPLCDEPIRNVKFKIVDAKIATESLHRGSGQIIPTARRVAYSAFLMATPRLMEPVYYVEIQTPIDCVSAIYTVLSRRRGHVTADVPQPGTPAYIVKAFLPVIESFGFETDLRYHTQGQAFCMSVFDHWAIVPGDPLDKSIVLRPLEPAPIQHLAREFMVKTRRRKGMSEDVSINKFFDEAMMVELAQQAADLHQQMM

SEQ ID NO: 9633 - protein, 988 aa, Glycine max
MDDSLYDEFGNYIGPEIESDQDSDRDSDADADDNPDDQSDGGGTAHSDGEGPSNGWMTTISDELENQVVLAEDKKYYPTAEEVYGEDVETLVMDEDEQPLEQPIIKPVRNIKFEVGVKDSSTYVSSQFLLGLMSNPTLVRNVALVGNLQHGKTVFMDMLVEQTHHMSTFDSQSEKHMRYTDTRIDEQERRISIKAIPMSLVLEDSNSKSYLCNIMDTPGHVNFSDEMTAALRLADGAVLIVDAAEGVMVNTERAIRHAIQERLPIVVVINKVDRLITELKLPPKDAYHKLRHTLEVINTHISAASSIAGGVQVVDPVAGNVCFASATAGWSFTLQSFAKLYGKLHGIPLEANKFASRLWGDYYFHPDTRTFKKKPPASGGERSFVEFVLEPLYKIYSQVIGEHKKSVETTLAELGVTLSNAAYRLNVRPLLRLACSSVFGPASGFTDMLVQHIPSPRDAAIKKVDHIYTGPKDSSIYKAMAQCDSYGPLMVNVTKLYPKSDCSVFDAFGRVYSGKIQTGQAVRVLGEGYSPDDEEDMTVKEVTKLWVYQARDRMPVAEAPPGSWVLIEGVDASIMKTSTLCNVDYDEDVYIFRPLQFNTLSVVKTATEPLNPSELPKMVEGLRKISKSYPLAVTKVEESGEHTILGTGELYLDSIMKDLRELYSEVEVKVADPVVSFCETVVESSSMKCFAETPNKKNKITMIAEPLERGLAEDIENGVVSTDWSKKKLGEFFQTKYDWDLLAARSIWAFGPDKQGPNILLDDTLPTEVNKDLMNAVKDSIVQGFQWGAREGPLCDEPIRNVKFKIVDAKIANESLHRGSGQIIPTARRVAYSAFLMATPRLMEPVYYVEIQTPIDCVSAIYTVLSRRRGHVTADVPQPGTPAYIVKAFLPVIESFGFETDLRYHTQGQAFCMSVFDHWAIVPGDPLDKSIVLRPLEPAPIQHLAREFMVKTRRRKGMSEDVSINKFFDEAMMVELAQQAADLHQQMM

SEQ ID NO: 9634 - protein, 986 aa, Cajanus cajan
MDDSLYDEFGNYIGPEIESDQDSDRDSDPDAEDTAADPDDEAAQSDGEGPNNGWLTTISNDMENQVVLAEDKKYYPTAEEVYGEDVETLVMDEDEQPLEQPIIKPVRSIKFEVGVKDSSTYVSSQFLLGLMSNPTLVRNVALVGHLQHGKTVFMDMLVEQTHHMSTFDAQSEKHMRYTDTRIDEQERRISIKAVPMSLVLEDSNSKSYLCNIMDTPGHVNFSDEMTASLRLADGAVLIVDAAEGVMVNTERAIRHAIQERLPIVVVINKVDRLITELKLPPKDAYHKLRHTLEVINTHISAASSIAGDVQVVDPVVGNVCFASATAGWSFTLQSFAKLYGKLHGIPLEANKFASRLWGDYYFHPDTRAFKKKPPASGGERSFVEFVLEPLYKIYSQVIGEHKKSVETTLAELGVTLSNAAYRLNVRPLLRLACSSVFGPASGFTDMLVQHIPSPREAAIKKVDHIYTGPKDSSIYKAMSQCDSYGPLMVNVTKLYPKSDCSVFDAFGRVYSGKIQTGQTVRVLGEGYSPDDEEDMTVKEVTKLWVYQARDRMPVAEAPPGSWVLIEGVDASIMKTATLCNVDYDEDVYIFRPLLFNTLSVVKTATEPLNPSELPKMVEGLRKISKSYPLAVTKVEESGEHTILGTGELYLDSIMKDLRELYSEVEVKVADPVVSFCETVVESSSMKCFAETPNKKNKITMIAEPLERGLAEDIENGVVSTDWNRKKLGEFFQTKYDWDLLAARSIWAFGPDKQGPNILLDDTLPTEVDKNLLNAVKDSIVQGFQWGAREGPLCDEPIRNVKFKIVDARIAPEPLHRGSGQIIPTARRVAYSAFLMATPRLMEPVYYVEIQTPIDCVSAIYTVLSRRRGHVTADVPQPGTPAYIVKAFLPVIESFGFETDLRYHTQGQAFCLSVFDHWAIVPGDPLDKSIVLRPLEPAPIQHLAREFMVKTRRRKGMSEDVSISKFFDEAMMVELAQQAADLHQQMM

SEQ ID NO: 9635 - protein, 990 aa, Theobroma cacao
MDDNLYDEFGNYIGPEIESDQESEGEEEEEEEFPDRHAQEEGEESDGEAPPGASNGWITAANDVDMDNQIVLAEDKKYYPTAEEVYGEDVETLVMDEDEQPLEQPIIKPVKNVKFEVGVKDSSTYVSTQFLIGLMSNPGLVRNVALVGHLQHGKTVFMDMLVEQTHHMNTFDENSEKHMRYTDTRIDEQERRISIKAIPMSLVLEDSNSKSYLCNIMDTPGHVNFSDEMTAALRLADGAVFIVDAAEGVMVNTERAIRHAIQERLPIVVVINKVDRLITELKLPAKDAYHKLRHTLEVINNHISAASTTAGNVPVIDPAAGNVCFASASAGWSFTLQSFAKLYVKLHGIPFDAEKFASRLWGDIYYHPDTRAFKRKPPAGGGERSFVEFVLEPLYKIYSQVIGEHKKSVESTLAELGVTLSNAAYKLNVRPLLRLACSTVFGSASGFTDMLVQHIPSPKDAAVKKVDHAYTGPKHSMIYKAMVDCDPSGPLMVNVTKLYPKSDCSVFDAFGRVYSGRIQTGQTLRVLGEGYSPDDEEDMTVKEVTKLWIYQARYRIPISSAPPGSWVLIEGVDASIMKTATLCNMDLDEDVYIFRPLQFNTLPVVKTATEPLNPSELPKMVEGLRKISKSYPLAITKVEESGEHTILGTGELYLDSIMKDLRELYSEVEVKVADPVVSFCETVVESSSMKCFAETPNKKNKITMIAEPLERGLAEDIENGVVSVDWSRKQLGDFFKTKYDWDLLAARSIWAFGPDKQGPNILLDDTLPTEVDKTLLGAVRDSIVQGFQWGAREGPLCDEPIRNVKFKIVDARIASEPLHRGSGQIIPTARRVAYSAFLMATPRLMEPVYYVEIQTPIDCVSAIYTVLSRRRGHVTADVPQPGTPAYIVKAFLPVIESFGFETDLRYHTQGQAFCLSVFDHWAIVPGDPLDKSIVLRPLEPAPIQHLAREFMVKTRRRKGMSEDVSINKFFDEAMVVELAQQAADLHQQMI

SEQ ID NO: 9636 - protein, 988 aa, Panax ginseng
MDDSLYDEFGNYIGPEIESDQDSDREDEDENLTDKHDGDATASDDENAAGGSNGWITTTDDVDIDNQIVLAEDKKYYPTAEEVYGEEVETLVMDEDEQPLEQPIIKPVRNVKFELGVKDSSTYVSTQFLLGLSSNPSLVRNVALVGHLQHGKTVFMDMLVEQTHHITTFDQNSEKHMRYTDTRIDEQERRISIKAVPMSLVLEDSNSKSYLCNIMDTPGHVNFSDEMTAALRLADGAVLVVDAAEGVMVNTERAIRHAIQERLPIVVVINKVDRLITELKMPPKDAYHKLRHTIEVINNHITAASSTAGDVQIIDPAAGNVCFASGSAGWCFTLHSFAKLYVKLHGIPFDAMNFASRLWGDYYFDPDTRGFKKKQPSGGVERSFVQFVLEPLYKIYSQVVGEHKKSVETTLAELGVTLSNAAYKLNVRPLLRLACSSVFGSATGFTDMLVHHIPSAKDSVARKAEHIYTGPKDSAIYKAMEDSDPSGPLMVNVTKLYPKSDCSVFDVFGRVYSGEIHTGQIVRVLGEGYSPDDEEDMTVKEVTKLWVYQARYRIPVSKAPPGSWVLIEGVDASIMKTATLCNFDYDEDIYIFRPLQFNTLPVVKTATEPLNPSELPKMVEGLRKISKSYPLAITKVEESGEHTILGTGELYLDSIMKDLRELYSEVEVKVADPVVSFCETVVESSSMKCFAETPNKKNKITMIAEPLERGLAEDIENGVVSIDWPRKKLGDFFQTKYDWDLLAARSIWAFGPDKQGPNILLDDTLSSEVDKSLLNAVKDSIVQGFQWGAREGPLCDEPIRNVKFKIVDARIAPEPLNRGTGQIIPTARRVAYSAFLMATPRLMEPVYYVEIQTPIDCVSAIYTVLSRRRGHVTADVPQPGTPAYIVKAFLPVIESFGFETDLRYHTQGQAFCLSVFDHWAIVPGDPLDKSIILRPLEPAPIQHLAREFMVKTRRRKGMSEDVSINKFFDEAMVVELAQQDADLHLQMI

SEQ ID NO: 9637 - protein, 989 aa, Citrus sinensis
MDDSLYDEFGNYIGPEIESDRESEADDDEDEDLPDKADEDGHASDREVAATASNGWITASNDVDMDNQIVLAEDKKYYPTAEEVYGEDVETLVMDEDEQPLEQPIIKPVKNIKFEVGVKDSSTYVSTQFLVGLMSNPTLVRNVALVGHLHHGKTVFMDMLIEQTHHMSTFDPNSEKHTRYTDTRIDEQERRISIKAVPMSLVLEDSNSKSYLCNIMDSPGHVNFSDEMTAALRLADGAVLIVDAAEGVMVNTERAIRHAIQERLPIVVVVNKVDRLITELKLPPKDAYHKLRHTIEVINNHISAASTTAGNVQVIDPAAGNVCFASASAGWSFTLHSFAKLYVKLHGVPFDAEKFASRLWGDMYFHPDTRVFKKKPPASGGERSFVQFVLEPLYKIYSQVIGEHKKSVEATLAELGVTLSNATYRLNVRPLLRLACSSVFGSASGFTDMLVKFIPSAKDAAARKVDHIYTGPKNSTIYKAMVDCDPSGPLMVNVTKLYPKSDCSVFDAFGRVYSGIIQTGQSVRVLGEGYSPEDEEDMTVKEVTKLWIYQARDRIPISSAPPGSWVLIEGVDASIMKSATLCNLEYDEDVYIFRPLQFNTLPVVKTATEPLNPSELPKMVEGLRKISKSYPLAITKVEESGEHTILGTGELYLDSIMKDLRELYSEVEVKVADPVVSFCETVVESSSMKCFAETPNKKNKITMIAEPLERGLAEDIENGVVSIDWSRKTLGDFFKTKYDWDLLAARSIWAFGPDKQGPNILLDDTLPTEVDKSLLNAVKDSIVQGFQWGAREGPLCDEPIRNVKFKIVDARIAPEPLHRGSGQIIPTARRVAYSAFLMATPRLMEPVYYVEIQTPIDCVSAIYTVLSRRRGHVTADVPQPGTPAYIVKAFLPVIESFGFETDLRYHTQGQAFSLSVFDHWAIVPGDPLDKSIVLRPLEPAPIQHLAREFMVKTRRRKGMSEDVSINKFFDEAMVVELAQQAADLHQQMI

SEQ ID NO: 9638 - protein, 211 aa, Tripterygium wilfordii
MDDSLYDEFGNYVGPEMESDQESDGEDDEEFPDQPHEEEVTSDGEGGTSGPNGWITASHDVDMDNQIVLAEDKKYYPTAEEVYGEDVETLVMDEDEQPLEQPIIKPVKNIKFEVGVKDSSTYVSTQFLIGLMSNPALVRNVALVGHLQHGKTVFMDMLVEQTHHMSTFDPNNERHMRYTDTRIDEQERRISIKAVPMSLVLEDSNSKYIPV

SEQ ID NO: 9639 - protein, 989 aa, Citrus clementina
MDDSLYDEFGNYIGPEIESDRESEADDDEDEDLPDKADEDGHASDREVAATASNGWITASNDVDMDNQIVLAEDKKYYPTAEEVYGEDVETLVMDEDEQPLEQPIIKPVKNIKFEVGVKDSSTYVSTQFLVGLMSNPTLVRNVALVGHLHHGKTVFMDMLIEQTHHMSTFDPNSEKHTRYTDTRIDEQERRISIKAVPMSLVLEDSNSKSYLCNIMDSPGHVNFSDEMTAALRLADGAVLIVDAAEGVMVNTERAIRHAIQERLPIVVVVNKVDRLITELKLPPKDAYHKLRHTIEVINNHISAASTTAGNVQVIDPAAGNVCFASASAGWSFTLHSFAKLYVKLHGVPFDAEKFASRLWGDMYFHPDTRVFKKKPPASGGERSFVQFVLEPLYKIYSQVIGEHKKSVEATLAELGVTLSNATYRLNVRPLLRLACSSVFGSASGFTDMLVKFIPSAKDAAARKVDHIYTGPKNSTIYKAMVDCDLSGPLMVNVTKLYPKSDCSVFDAFGRVYSGIIQTGQSVRVLGEGYSPEDEEDMTVKEVTKLWIYQARDRIPISSAPPGSWVLIEGVDASIMKSATLCNLEYDEDVYIFRPLQFNTLPVVKTATEPLNPSELPKMVEGLRKISKSYPLAITKVEESGEHTILGTGELYLDSIMKDLRELYSEVEVKVADPVVSFCETVVESSSMKCFAETPNKKNKITMIAEPLERGLAEDIENGVVSIDWSRKTLGDFFKTKYDWDLLAARSIWAFGPDKQGPNILLDDTLPTEVDKSLLNAVKDSIVQGFQWGAREGPLCDEPIRNVKFKIVDARIAPEPLHRGSGQIIPTARRVAYSAFLMATPRLMEPVYYVEIQTPIDCVSAIYTVLSRRRGHVTADVPQPGTPAYIVKAFLPVIESFGFETDLRYHTQGQAFSLSVFDHWAIVPGDPLDKSIVLRPLEPAPIQHLAREFMVKTRRRKGMSEDVSINKFFDEAMVVELAQQAADLHQQMI

SEQ ID NO: 9640 - protein, 988 aa, Cucumis sativus
MDDSLYDEFGNYIGPEIDSDKDSDIEDEDENLMEKPEEDEGVSDGEDAGGASNGWITTSNDVDMDNQIVLAEDKKYYPTAEEVYGEDVETLVMDEDELPLEQPIIKPVRNVKFEVGVKDSRTYVSNQFLVGLMSNPTLVRNVALVGHVHHGKTVFMDMLIEQTHHMSTFDIKGEKHLRYTDTRIDEQERGISIKAVPMSLVLEDGNSKSYLCNIMDTPGHTNFSDEMTAALRLADGAVLIVDAAEGVMVNTERAIRHAIQERLPIVVVINKVDRLITELKLPPRDAYYKLRHTLEIINNHISAASSTAGNVQVIDPAAGNVCFASATAGWSFTLQSFAKLYVKLHGIPFDADKFATRLWGDYYYHPDTRGFKKKQPASGGERSFVQFVLEPLYKIYSQVIGEHRKSVETTLAELGVTLSNAAYKLNVRPLLRLACSSVFGGASGFTDMLVQHIPSPRDASSRKVDHIYTGPKDSMIYKAMKECDPSGPLMVNITKLYPKSDCSVFDAFGRVYSGKIQTGQTVRVLGEGYSPDDEEDMVVKEVTKLWLYQARDRVPIAEAPPGSWVLIEGVDASIMKTATLSNVDYDEDVYIFRPLQFNTLPVVKTATEPLNPSELPKMVEGLRKISKSYPLAITKVEESGEHTILGTGELYLDSIMKDLRELYSEVEVKVADPVVSFCETVVESSSMKCFAETPNKKNKITMIAEPLERGLAEDIENGVVSLDWSRKKLGDFFQTKYEWDLLAARSIWAFGPDKQGPNILLDDTLSSEVDKNLLNAVKDSIVQGFQWGAREGPLCDEPIRNVKFKIVDARIAPEPLHRGSGQIIPTARRVAYSSFLMATPRLMEPVYYVEIQTPIDCVSAIYTVLSRRRGHVTADVAQPGTPAYIVKAFLPVIESFGFETDLRYHTQGQAFCLSVFDHWAIVPGDPLDKSIVLRPLEPAPIQHLAREFMVKTRRRKGMSEDVSINKFFDEAMMVELAQQAADLHQQMI

SEQ ID NO: 9641 - protein, 992 aa, Lupinus angustifolius
MDDSLYDEFGNYIGPEIDSDFDSDREEDNDDDGEDNRDSLTNQHDGAASDGEGPTNGWITTSNDIDMVDNQVVLAEDKKYYPTAEEVYGEDVETLVMDEDEQSLEQPIIKPVRNIKFEVGVKDSSTYVSSQFLLGLMSNPTLVRNVALVGNLQHGKTVFMDMLVEQTHHMSTFDPQSEKHMRYTDTRVDEQERRISIKAVPMSLVMEDSNSKSYLCNIMDTPGHVNFSDEMTAALRLADGAVLIVDAAEGVMVNTERAIRHATQERLPIVVVINKVDRLITELKLPPKDAYHKIRHTLEVINNHISAASSIAGDVQVIDPVAGNVCFASGTAGWSFTLQSFAKLYGKIHGIPLEANKFASRLWGDFYYHPDTRTFKKKPPASGGERSFVEFVLEPLYKIYSQIIGEHKKSLETTLAELGVTLSNAAYRLNVRPLLRLACSSVFGAASGFTDMLVQHIPSPRDAAIKKVDHIYTGPKDSTIYKAMSQCDSSGPLMVNVTKLYPKSDCSVFDVFGRVYSGKIQTGQTVRVLGEGYSPDDEEDMTVKEVTKLWVYQARDRMPIAEAPPGSWVLIEGVDASIMKTATICNVDYDEDVYIFRPLQFNTLSVVKTATEPLNPSELPKMVEGLRKISKSYPLAVTKVEESGEHTILGTGELYLDSIMKDLRELYSEVEVKVADPVVSFCETVVESSSMKCFAETPNKKNKITMIAEPLERGLAEDIENGVVSTDWNRKKLGEFFQTKYDWDLLAARSIWAFGPDKQGPNILLDDTLPTEVDKNLLNAVKDSIVQGFQWGAREGPLCDEPIRNVKFKIVDARIAPEPLHRGSGQIIPTARRVAYSSFLMATPRLMEPVYYVEIQTPIDCVSAIYTVLSRRRGHVTADVPQPGTPAYIVKAFLPVIESFGFETDLRYHTQGQAFCLSVFDHWAIVPGDPLDKSIVLRPLEPAPIQHLAREFMVKTRRRKGMSEDVSIGKFFDEAMMVELAQQAADLHQQMI

SEQ ID NO: 9642 - protein, 987 aa, Echinacea purpurea
MDDSLYDEFGNYIGPEIESDQESDREEEDEDLPEKIEERADSDEENAAAGPNGWLTNGEDVDMENQIVLAEDKKYYPTAEEVYGEEVETLVMDEDEQPLELPIIKPVRDIKFEVGVKDSSTYVSTQFLLGLSSNPTLVRNVALVGHLQHGKTVFMDMLVEQTHHISTFDQNSEKHMRYTDTRVDEQERRISIKAVPMSLVLEDSNSKSYMCNIMDTPGHVNFSDEMTAALRLADGAVLVVDAAEGVMVNTERAIRHAIQERLPIVVVINKVDRLITELKLPPKDAYHKLRHTIEVINNHITAVSSTAGNVQIIDPAAGNLCFASGSAGWCFTLQSFAKLYVKLHGIPFDANKFASRLWGDYYYDPATRTFKKKQPASGAERSFVQFILEPLYKIYSQVIGEHKKSVETTLAELGVTLSNAAYKLNVRPLLRLACRSVFGSATGFTDMLVHHIPSAKEAASKKVEHIYTGPRNSTIYTAMSDCDPSGPLMVNITKLYPKSDCSVFDAFGRVYSGEIHTGQTVRVLGEGYSPDDEEDMTVKEVTKLWVYQARYRIPINKAPPGSWVLIEGVDASIMKTATLCDSEYDDDVYIFRPLQFNTLPVVKTATEPLNPSELPKMVEGLRKISKSYPLAITKVEESGEHTILGTGELYLDSIMKDLRELYSEVEVKVADPVVSFCETVVESSSMKCFAETPNKKNKITMIAEPLERGLAEDIENGVVSVDWPKKKLGDFFQKRYEWDLLAARSIWAFGPDKQGPNILLDDTLSSEVDKSLLNSVKDSIVQGFQWGAREGPLCDEPIRNVKFKIVDAKIAPEPLHRGTGQIIPTARRVAYSAFLMATPRLMEPVYYVEIQTPIDCVSAIYTVLSRRRGHITADVPQPGTPAYIVKAFVPVIESFGFETDLRYHTQGQAFAVSTFDHWAIVPGDPLDKSIVLRPLEPAPIQYLAREFMVKTRRRKGMSEDVSINKFFDEAMMVELAQQEADLHQQMM

SEQ ID NO: 9643 - protein, 989 aa, Populus trichocarpa
MDDNLYDEFGNYIGPEIESDRESDGEEEDEELPDKPHEDEEESDGEEAVHASNGWLTAPNDVDMDNQVVLAEDKKYYPTAEEVYGPGVETLVNDEDEQPLEQPIIKPVRNIKFEVGVKDSSTYVSSQFLVGLMSNPSLVRNVALVGHLQHGKTVFMDMLVEQTHHTPTFDINSEKHIRYTDTRIDEQERRISIKAVPMSLVLEDSNSKSYLCNIMDTPGHVNFSDEMTAALRLADGAVLVVDAAEGVMVNTERAIRHAIQEQLPIVVVINKVDRLITELKLPPKDAYHKLRHTIEVINNHISAVSSTAGNVQVIDPAAGNVCFAGATAGWSFTLHSFARLYLKLHGIPFDAEKFASRLWGDMYYNPEDRTFKKKPPASGAERSFVQFVLEPLYKIYSQVIGEHKKSVEATLAEFGVTLPNSAYKLNVRPLLRLACSQVFGSASGFTDMLVKHIPSAKVAAARKVDHTYTGPKDSMIYQAMLDCDPAGPLMVNVTKLYPKSDCSSFDAFGRVYSGKIMTGQSVKVLGEGYSPEDEEDMTVKEVTKLWVYQARYRLPISMAPPGSWVLIEGVDASIMKTATLCNVNYNEEDVYIFRPLQFNTLPVVKTATEPLNPSELPKMVEGLRKISKSYPLAITKVEESGEHTILGTGELYLDSIMKDLRELYSEVEVKVADPVVSFCETVVESSSMKCFAETPNKKNKITMIAEPLEKGLAEDIENGVVSIDWNRKALGDFFKTKYDWDLLAARSIWAFGPDKQGPNILLDDTLPTEVDKGLLGAVKDSIVQGFQWGAREGPLCDEPIRNVKFKIVDARIAPEPLHRGSGQIIPTARRVAYSAFLMATPRLMEPVYYVEIQTPIDCLTAIYTVLSRRRGHVTADVPQPGTPAYIVKAFLPVIESFGFETDLRYHTQGQAFSLSVFDHWAIVPGDPLDKSIVLRPLEPAPIQHLAREFMVKTRRRKGMSEDVSINKFFDEAMVVELAQQAADIHQQMM

SEQ ID NO: 9644 - protein, 988 aa, Prunus mume
MDDSLYDEFGNYIGPEIESDQESDREDEDGELPDRQDDGAASDGDDAAAASNGWLAATSNDVDMDNQVVLAEDKKYYPTAEEVYGEDVETLVMDEDAQPLEQPIIKPVRNVKFEVGVKDSSTYVSNQFLLGLMSNPSLVRNVALVGHLQHGKTIFMDMLVEQTHHMSTFDSNSDKHMRYTDTRIDEQERRISIKAVPMSLVLEDSKSKSYLCNIMDTPGHVNFSDEMTAALRLADGAVLIVDAAEGMMVNTERAIRHAIQDRLPIVVVINKVDRLITELKLPPRDAYFKLRHTLEVINNHITAASSTAGNVQIIDPLAGNVCFASATAGWSFTLQSFAKLYIKLHGVDLDADKLASRLWGDMYYHRGDRTFRRKPPVDGGERSFVEFVLEPLYKIYSQVIGEHKKSVEATLAEFGVTLSNAAYKLNVRPLLRLACSSVFGSASGFTDMLVQHIPSPKDAATRKVDHIYTGPKDSLIYKAMKNCEPDGPLMVNVTKLYPKSDCSVFDAFGRVYSGKIQTGQTVRVLGEGYSPEDEEDMTVKEVTKLWLYQARDRIPIAEAPPGTWVLIEGVDASIMKTATLCNEYYDEDAYIFRPLQFNTLPVVKTATEPLNPSELPKMVEGLRKISKSYPLAITKVEESGEHTILGTGELYLDSIMKDLRELYSEVEVKVADPVVSFCETVVESSSMKCFAETPNKKNKITMIAEPLERGLAEDIENGVVSIDWSRKDIGNFFQTRYEWDVLAARSIWAFGPDKQGPNILLDDTLSTEVDKSLLNAVKDSIVQGFQWGAREGPLCDEPIRNVKFKIVDARIAQEPLHRGSGQIIPTSRRVAYSSFLMATPRLMEPVYYVEIQTPIDCISAIYTVLSRRRGHVTADVPQPGTPAYIVKAFLPVIESFGFETDLRYHTQGQAFCLSVFDHWAIVPGDPLDKSIVLRPLEPAPIQHLAREFMVKTRRRKGMSEDVSINKFFDEAMMVELAQQAADLHQQMI

SEQ ID NO: 9645 - protein, 898 aa, Malus domestica
MDDSLYDEFGNYIGPEIESDQESDREDEDEELPDRQEDRDASDGDDAAAGPNGWLTASNDVDMDNQVVLAEDKKYYPTAEEVYGEDVETLVMDEDAQPLEQPIIKPVRNVKFEVGVKDSSTYVSNQFLLGLMSNPSLVRNVALVGHLQHGKTVFMDMLVEQTHHMSTFDSNSDKHMRYTDTRIDEQERRISIKTVPMSLVLEDSKCKSYLCNIMDTPGHVNFSDEMTAALRLADGAVLIVDAAEGMMVNTERAIRHAIQERLPIVVVINKVDRLITELKLPPRDAYFKIRHTLDVINTHITAASSTAGNVQIIDPVAGNVCFASATAGWSFTLQSFAKLYLKLHGADNTDVDKFASRLWGDMYYHPDDRSFRRKPPASGGERSFVQFVLEPLYKIYSQVIGEHKKSVEATLAEFGVTLSNAAYKLNVRPLLRLACSSVFGYASGFTDMLVQHIPSPKGAATRKVDHIYTGPKDSLIYKAMKDCDPDGPLMVNVTKLYPKSDCSVFDAFGRVYSGKIQTGQTVRVLGEGYSPEDEEDMTVKEVTKLWLYQARDRIPIAEAPPGTWVLIEGVDASIMKTATICNEYYDEDVYIFRPLQFNTLPVVKTATEPLNPSELPKMVEGLRKISKSYPLAITKVEESGEHTILGTGELYLDSIMKDLRELYSEVEVKVADPVVSFCETVVESSSMKCFAETPNKKNKITMIAEPLERGLAEDIENGVVSIDWSRKDIGNFFQTRYEWDVLAARSIWAFGPDKQGPNILLDDTLSTEVDKSLLNAVKDSIVQGFQWGAREGPLCDEPIRNVKFKIVDARIAQEPLHRGSGQIIPTSRRVAYSSFLMATPRLMEPVYYVEIQTPIDCISAIYTVLSRRRGHVTADVPQPRDPCLYRQGVLTSDRIIWL

SEQ ID NO: 9646 - protein, 988 aa, Ambrosia trifida
MDDSLYDEFGNYIGPEIESDQESDREEEDEDLPEKVEAERGDSDEENAAAGPNGWLTNGEDVDMDNQIVLAEDKKYYPTAEEVYGEEVETLVMDEDEQPLELPIIKPVRDIKFEVGVKDSSTYVSTQFLLGLSSNPTLVRNVALVGHLQHGKTVFMDMLVEQTHHISTFDQNSEKHMRYTDTRVDEQERRISIKAVPMSLVLEDSNSKSYMCNIMDTPGHVNFSDEMTAALRLADGAVLIVDAAEGVMVNTERAIRHAIQERLPIVVVINKVDRLITELKLPPKDAYHKLRHTIEVINNHITAVSSTAGDVQIIDPAAGNLCFASGSAGWCFTLQSFAKLYVKLHGIPFDANKFASRLWGDYYYDPATRTFKKKQPASGAERSFVQFILEPLYKIYSQVIGEHKKSVETTLAELGVTLSNAAYKLNVRPLLRLACRSVFGSATGFTDMLVHHIPSAKEAASKKVDHIYTGPKSSSIYTAMSTCDPSGPLMVNITKLYPKSDCSVFDAFGRVYSGEIHTGQTVRVLGEGYSPDDEEDMTVKEVTKLWVYQARYRIPINKAPPGSWVLIEGVDASIMKTATLCDSEYDDDVYIFRPLQFNTLPVVKTATEPLNPSELPKMVEGLRKISKSYPLAITKVEESGEHTILGTGELYLDSIMKDLRELYSEVEVKVADPVVSFCETVVESSSMKCFAETPNKKNKITMIAEPLERGLAEDIENGVVSVDWPRKKLGDFFQKRYDWDLLAARSIWAFGPDKQGPNILLDDTLSSEVDKSLLNSVKDSIVQGFQWGAREGPLCDEPIRNVKFKIVDAKIAPEPLHRGTGQIIPTARRVAYSAFLMATPRLMEPVYYVEIQTPIDCVSAIYTVLSRRRGHITADVPQPGTPAYIVKAFVPVIESFGFETDLRYHTQGQAFAVSTFDHWAIVPGDPLDKSIVLRPLEPAPIQYLAREFMVKTRRRKGMSEDVTINKFFDEAMVVELAQQEADLHQQMI

SEQ ID NO: 9647 - protein, 987 aa, Echinacea purpurea
MDDSLYDEFGNYIGPEIESDQESDREEEDEELPEKIEESVDFDDENAAAGPNGWLTNGEDVDMENQIVLAEDKKYYPTAEEVYGEEVETLVMDEDEQPLELPIIKPVRDIKFEVGVKDSSTYVSTQFLLGLSSNPTLVRNVALVGHLQHGKTVFMDMLVEQTHHISTFDQNSEKHMRYTDTRVDEQERRISIKAVPMSLVLEDSNSKSYMCNIMDTPGHVNFSDEMTAALRLADGAVLVVDAAEGVMVNTERAIRHAIQERLPIVVVINKVDRLITELKLPPKDAYHKLRHTIEVINNHITAVSSTAGNVQIIDPAAGNLCFASGSAGWCFTLQSFAKLYVKLHGIPFDANKFATRLWGDYYYDPATRTFKKKQPASGAERSFVQFILEPLYKIYSQVIGEHKKSVETTLAELGVTLSNAAYKLNVRPLLRLACRSVFGSATGFTDMLVHHIPSAKEAASKKVEHIYTGPRNSTIYTAMSDCDPSGPLMVNITKLYPKSDCSVFDAFGRVYSGEIHTGQTVRVLGEGYSPDDEEDMTVKEVTKLWVYQARYRIPINKAPPGSWVLIEGVDASIMKTATLCDSEYDDDVYIFRPLQFNTLPVVKTATEPLNPSELPKMVEGLRKISKSYPLAITKVEESGEHTILGTGELYLDSIMKDLRELYSEVEVKVADPVVSFCETVVESSSMKCFAETPNKKNKITMIAEPLERGLAEDIENGVVSVDWPKKKLGDFFQKRYEWDLLAARSIWAFGPDKQGPNILLDDTLSSEVDKSLLNSVKDSIVQGFQWGAREGPLCDEPIRNVKFKIVDAKIAPEPLHRGTGQIIPTARRVAYSAFLMATPRLMEPVYYVEIQTPIDCVSAIYTVLSRRRGHITADVPQPGTPAYIVKAFVPVIESFGFETDLRYHTQGQAFAVSTFDHWAIVPGDPLDKSIVLRPLEPAPIQYLAREFMVKTRRRKGMCEDVSINKFFDEAMMVELAQQEADLHQQMM

SEQ ID NO: 9648 - protein, 989 aa, Euphorbia peplus
MDDNLYDEFGNYIGPEIESDQESDRDEEDEELPDRTQQDDDASDGDEGINASNGWLTTSNDVDMDNQIVLAEDKKYYPTAEEVYGEDVETLVMDEDEQPLEQPIIKPVRNIKFEVGVKDSSTYVSTQFLVGLMSNPSLVRNVALVGHLQHGKTLFMDMLVEQTHHMPTFDSNSEKHVRYTDTRIDEQERRISIKAVPMSLVLEDSNSKSYLCNIMDTPGHVNFSDEMTAALRISDGAVLIVDAAEGVMVNTERAIRHAIQERLPIVVVINKVDRLITELKLPPKDAYHKLRHTLEVLNHHITAASSTAGNVQTIDPVAGNVCFASGTAGWSFTLQSFAKLYLKLHGIPFDADKFASRLWGDMYYHPDTRAFKKKPPGSGGERSFVQFVLEPLYKIYSQVIGEHKKSVEATLAELGVTLPNVAYKLNVKPLLRLACSRVFGSASGFTDMLVQHIPSAKSAQAKKADHIYTGPKDSIIYNAMVDCDPSGPLMVNVTKLYPKPDCSSFDAFGRVYSGQIMTGQSVRVLGEGYSPDDEEDMTVKEVTKLWVYQARYRLPISMAPPGSWVLIEGVDASIMKTATLCNEKYDQEDVYIFRPLQFNTLPVVKTATEPLNPSELPKMVEGLRKISKSYPLAITKVEESGEHTILGTGELYLDSIMKDLRELYSEVEVKVADPVVSFCETVVESSSMKCFAETPNKKNKITMIAEPLEKGLAEDIENGVVSIDWNRKTLGDFFKTKYDWDLLAARSIWAFGPDKQGPNILLDDTLPTEVDKGLLGAVKDSIVQGFQWGAREGPLCDEPIRNVKFKIVDARIAPEPLHRGSGQIIPTARRVAYSAFLMATPRLMEPVYYVEIQTPIDCLSAIYTVLSRRRGHVTADVPQPGTPAYIVKAFLPVIESFGFETDLRYHTQGQAFCLSVFDHWAIVPGDPLDKSIVLRPLEPAPIQHLAREFMVKTRRRKGMSEDVSINKFFDEAMVMELAHQAADIHLQMI

SEQ ID NO: 9649 - protein, 997 aa, Pinus taeda
MDDSLYDEFGNYIGPEIDSDEESEQDEEQDDVRMHDRDEEDANEDGDAAWLARTHGPLDHHNQQGPDDDDDVDMEGQVVLAEDKKYYPTAEEVYGEGVETLVMEEDAQPLEQPIVKPVRNIKFEVGVKDSTTYVSTDFLLGLMSNPTLVRNVALVGHLQHGKTLFMDMLIEQTHHIATFDVNSEKHMRYTDTRVDEQERQISIKAVPMSLVLEDGNAKSYLCNIMDTPGHVNFSDEMTAALRLADGAVLVVDAADGVMVNTERAIRHAIQERLPIVVVINKVDRLITELKLPPTDAYHKLKHTIEEVNNLITAFSTGAGGSQLVDPAIGNVCFASASAGWSFTLQSFAKIYVKLHGIPFDSARFASRLWGDMYFQPDTRTFKKRPPPTGGERSFVQFVLEPLYKIYSQVIGEHRKSVETTLAELGVTLSNAAYKLNVRSLLRLSCSSIFGSATGFTDMLVQHIPSAKDAAAKKIEHIYTGPQDTPLVQAMKDCAPEGPLMVNVTKLYPKSDCSVFDSFGRVYSGTIQTGQTVRVLGEGYSPDDEEDMAVKEVTKLWVYQARYRIPISKAPAGSWVLIEGVDASIMKTATLCPEYLDEDVFIFRPLRFNTLSVVKTATEPLNPSELPKMVEGLRKISKSYPLAITKVEESGEHTILGTGEIYLDSIMKDLRELYSEVEVKVADPVVSFCETVVESSSMKCFAETPNKKNKITMLAEPLEKGLAEDIENGVVSIDWPRKKLGDFFQTRYDWDLLAARSIWAFGPDKQGPNILLDDTLPSEVDKNLLNSVKDSIVQGFQWGAREGPLCDEPIRNVKFKILDATIAPEPLHRGGGQIIPTARRVAYSAFLMANPHLMEPVYYVEIQTPADCISAIYTVLSRRRGHVTADIAKPGTPAYIVKAFLPVIESFGFETDLRYHTQGQAFCLSVFDHWSIVPGDPLDKSVVLRPLEPAPVQHLAREFMVKTRRRKGMSEDVSINKFFDDPMLLEMARQDADFQQIL

SEQ ID NO: 9650 - protein, 988 aa, Daucus carota
MDDSLYDEFGNYIGPEIESDQESDREDEDEELPDKTDEENGDASDEENAGRANGWMTTTDDIDIDNQIVLAEDKKYYPTAEEVYGEEVETLVMDEDAQPLEQPIIKPVRNVKFELGVKDSSTYVSTDFLLGLSSNPSLVRNVALVGHLQHGKTVFMDMLIEQTHHISTFDQNSEKHMRYTDTRIDEQERRISIKAVPMSLVLEDSNSKSYLCNIMDTPGHVNFSDEMTAALRLADGAVLVVDAAEGVMVNTERAIRHAIQERLPIVVVINKVDRLITELKLPPKDAYHKLRHTIEVINNFITAVSATAGDVQIIDPVAGNVCFASGSAGWCFTLHSFAKLYVKLHGIPFDASKFASRLWGDYYFDPDTRGFKRKQPSGGVERSFVQFVLEPLYKIYSQVVGEHKKSVETTLAELGVTLSNAAYKLNVKPLLRLACSSVFGSATGFTDMLVHHIPSAKDSAPRKVEHTYTGPNDSAIYRAMVDSDPSGPLMVHVTKLYPKSDCSVFDAFGRVYSGELHTGQTVRVLGEGYSPDDEEDMTVKEVTKLWVYQARYRIPVGKAPPGSWVLIEGVDASIMKTATLCSSNYDEDVYIFRSLQFNTLPVVKTATEPLNPSELPKMVEGLRKISKSYPLAITKVEESGEHTILGTGELYLDSIMKDLRELYSEVEVKVADPVVSFCETVVESSSMKCFAETPNKKNKITMIAEPLERGLAEDIENGVVSIDWPRKKLGDFFKSKYDWDLLAARSIWAFGPDKQGPNILLDDTLSGEVDKLTLNAVKDSIVQGFQWGAREGPLCDEPIRNVKFKIVDARIAPEPLHRGTGQIIPTARRVAYSAFLMATPRLMEPVYYVEIQTPIDCVSAIYTVLSRRRGHVTADVPQPGTPAYIVKAFLPVIESFGFETDLRYHTQGQAFCVSVFDHWAIVPGDPLDKNIVLRPLEPAPIQHLAREFMVKTRRRKGMSEDVSISKFFDEAMVVELAQQDADLHLQMI

SEQ ID NO: 9651 - protein, 990 aa, Gossypium raimondii
MDDNLYDEFGNYIGPDIESDQGSEGEEEEDEDLPDRHVQEEGQQSDGEAPDGVSNGWITAANDVDMDNQIVLAEDKKYYPTAEEVYGEDVETLVMDEDEQPLEQPIIKPVKNIKFEVGVKDSSTYVSTQFLIGLMSNPGLIRNVALVGHLQHGKTVFMDMLVEQTHHMNTFDRNSEKHMRYTDTRIDEQERRISIKAVPMSLVLEDSNGKSYLCNIMDTPGHVNFSDEMTAALRLADGAVLIVDAAEGVMVNTERAIRHAIQERIPIVVVINKVDRLITELKLPPKDAYHKLRHTLEVINNHISAASTTAGNVPVIDPAAGNVCFASASAGWSFTLQSFAKLYVKLHGIPFDAEKFASRLWGDIYYHPDTRAFKRKPPAGGGERSFVEFVLEPLYKIYSQVIGEHRKSVESTLAELGVTLSNAAYKLNVRPLLRLACSTVFGSASGFTDLLVQHIPSPKDAAAKKVDHTYTGPKHSMIYKAMVECDPSGPLMVNVTKLYPKSDCSVFDAFGRVYSGRIQTGQSLRVLGEGYSPDDEEDMTLKEVTKLWIYQARYRIPISSAPPGSWVLIEGVDASIMKTATLCNMDLDEDVYIFRPLQFNTLPVVKTATEPLNPSELPKMVEGLRKISKSYPLAITKVEESGEHTILGTGELYLDSIMKDLRELYSEVEVKVADPVVSFCETVVESSSMKCFAETPNKKNKITMIAEPLERGLAEDIENGVVSVDWSRKQLGDFFKTKYDWDLLAARSIWAFGPDKQGPNILLDDTLPTEVDKGLLGSVRDSIVQGFQWGAREGPLCDEPIRNVKFKIVDARIASEPLHRGSGQIIPTARRVAYSAFLMATPRLMEPVYYVEIQTPIDCVSAIYTVLSRRRGHVTADVPQPGTPAYIVKAFLPVIESFGFETDLRYHTQGQAFCLSVFDHWAIVPGDPLDKSIVLRPLEPAPIQHLAREFMVKTRRRKGMSEDVSINKFFDEAMVVELAQQAADLHQQMI

SEQ ID NO: 9652 - protein, 989 aa, Lotus japonicus
MDDSLYDEFGNYIGPEIESDQDSDREPSDDEQPSDADTAQPSDGEAPATNGWITASGDPNDVDMVDNQVVLAEDKKYYPTAEEVFGEDVETLVMDEDEQPLEQPIIKPVRKMKFEVGVKDSSTYVSSQFLLGLMSNPSLARNVALVGHLQHGKTVFMDMLVEQTHHMSTFDSQSEKHLRYTDTRIDEQERRISIKAVPMTMVLEDSNSKSYLCNIMDTPGHVNFSDEMTAALRLADGAVLVVDAAEGVMVNTERAIRHAIQERLPIVVVLNKVDRIITELKLPPKDAYHKIRHTLEVINTHISAASSTAGDVQVIDPVAGNVCFASGTAGWSFTLQSFAKLYGKLHGVPLEPNKFASRLWGDYYFHPDTRTFKKKPPVSGGERSFVEFVLEPLYKIYSQVIGEHKKSVETTLAELGVTLSNAAYRLNVRPLLRLACSSVFGQASGFTDMLVQHIPSPRDAAVKKVDHIYTGPKDSSIYKAMTQCDSSGPLMVNVTKLYPKSDCSVFDAFGRVYSGKIQTGQTVRVLGEGYSPDDEEDMTVKEVTKLWVYQARDRMPISEAPPGSWVLIEGVDASIMKTATLCNVDYDEDVYIFRPLLFNTLSVVKTATEPLNPSELPKMVEGLRKISKSYPLAVTKVEESGEHTILGTGELYLDSIMKDLRELYSEVEVKVADPVVSFCETVVESSSMKCFAETPNKKNKITMIAEPLERGLAEDIENGVVSTDWNRKKLGEFFQTKYDWDLLAARSIWAFGPDKQGPNILLDDTLPTEVDKNLLNAVKDSIVQGFQWGAREGPLCDEPIRNVKFKIVDARIAPEPLNRGSGQIIPTARRVAYSSFLMATPRLMEPVYYVEIQTPIDCVSAIYTVLSRRRGHVTADVPQPGTPAYLVKAFLPVIESFGFETDLRYHTQGQAFCVSVFDHWAIVPGDPLDKGIVLRPLEPAPIQHLAREFMVKTRRRKGMSEDVSISKFFDEAMMVELAQQEADLHQQMM

SEQ ID NO: 9653 - protein, 988 aa, Prunus persica
MDDSLYDEFGNYIGPEIESDQESDREDEDGELPDRQDDGAASDGDDAAAASNGWLAATSNDVDMDNQVVLAEDKKYYPTAEEVFGEDVETLVMDEDAQPLEQPIIKPVRNVKFEVGVKDSSTYVSNQFLLGLMSNPSLVRNVALVGHLQHGKTIFMDMLVEQTHHMSTFDANSDKHMRYTDTRIDEQERRISIKAVPMSLVLEDSKSKSYLCNIMDTPGHVNFSDEMTAALRLADGAVLIVDAAEGMMVNTERAIRHAIQDRLPIVVVINKVDRLITELKLPPRDAYFKLRHTLEVINNHITAASSTAGNVQIIDPLAGNVCFASATAGWSFTLQSFAKLYIKLHGVNLDADKLASRLWGDMYYHRGDRTFRRKPPVDGGERSFVEFVLEPLYKIYSQVIGEHKKSVEATLAEFGVTLSNAAYKLNVRPLLRLACSSVFGSASGFTDMLVQHIPSPKDAATRKVDHIYTGPKDSLIYKAMKNCEPDGPLMVNVTKLYPKSDCSVFDAFGRVYSGKIQTGQTVRVLGEGYSPEDEEDMTVKEVTKLWLYQARDRIPIAEAPPGTWVLIEGVDASIMKTATLCDEYYDEDAYIFRPLQFNTLPVVKTATEPLNPSELPKMVEGLRKISKSYPLAITKVEESGEHTILGTGELYLDSIMKDLRELYSEVEVKVADPVVSFCETVVESSSMKCFAETPNKKNKITMIAEPLERGLAEDIENGVVSIDWSRKDIGNFFQTRYEWDVLAARSIWAFGPDKQGPNILLDDTLSTEVDKSLLNAVKDSIVQGFQWGAREGPLCDEPIRNVKFKIVDARIAQEPLHRGSGQIIPTSRRVAYSSFLMATPRLMEPVYYVEIQTPIDCISAIYTVLSRRRGHVTADVPQPGTPAYIVKAFLPVIESFGFETDLRYHTQGQAFCLSVFDHWAIVPGDPLDKSIVLRPLEPAPIQHLAREFMVKTRRRKGMSEDVSINKFFDEAMMVELAQQAADLHQQMI

SEQ ID NO: 9654 - protein, 987 aa, Solanum lycopersicum
MDDSLYDEFGNYIGPEIESDQESDREEEDDELPDRSDDERAVSDDEQPGASNGWLATQDDIDMDNQVVLAEDKKYYPTAEEVYGEEVETLVMDEDEQPLEMPIIKPVKNLKFELGVKDSSTYVSTQFLLGLMSNPALVRNVALVGHIHHGKTLFMDMLVEQTHHISTFDQNSEKHMRYTDTRIDEQERRISIKSVPMSLVLEDSNSKSYLCNIMDAPGHVNFSDEMTAALRLADGAVLIVDAVEGVMVNTERAIRHAILERIPIVLVINKVDRLITELKLPPKDAYFKLKHIVETVNSQITAASSTAGNAQVIDPALGNVCFASATAGWSFTLQSFAKLYVKLHGIAFDANKFASRLWGDFYFDPDTRSFKKKPPASGVERSFVQFVLEPLYKIYSQVIGEHKKSVEATLAELGVTLSNAAYRLNVRPLLRLACSAVFGTATGFTDMLVHHIPSAKAAAARKVEHIYTGPKDSAIYKAMENCDSAGPLMVNVTKLYPKPDCSVFDAFGRVYSGEIMTGQTVRVLGEGYSPDDEEDMTVKEVTKLWVYQARYRIPISKAPPGAWVLIEGVDASIMKTATLCNLEFDEDVYIFRPLQFNTLPVVKTATEPLNPSELPKMVEGLRKISKSYPLAITKVEESGEHTILGTGELYLDSIMKDLRELYSEVEVKVADPVVSFCETVVESSSMKCFAETPNKKNKITMIAEPLERGLAEDIENGVVSIDWPRKKLGEFFQTKYDWDLLAARSIWAFGPDKQGPNILLDDTLSSEVDKSLLNAVKDSIVQGFQWGAREGPLCDEPIRNVKFKIVDAKIAPEPLHRGTGQIIPTARRVAYSAFLMATPRLMEPVYYVEIQTPMDCLSAIYTVLSRRRGHVTADVPQPGTPAYIVKAFLPVIESFGFETDLRYHTQGQAFCLSVFDHWAIVPGDPLDKSIVLRPLEPAPIQHLAREFMVKTRRRKGMSEDVSINKFFDEAMMVELAQQDADLHLQMM

SEQ ID NO: 9655 - protein, 988 aa, Citrullus lanatus
MDDSLYDEFGNYIGPEIDSDKDSDIEDEDEDLMEKPDEDEGVSDGEDAGGASNGWITTSNDVDMDNQIVLAEDKKYYPTAEEVYGEDVETLVMDEDELPLEQPIIKPVRNIKFEVGVKDSRTYVSNQFLVGLMSNPTLVRNVALVGHLHHGKTVFMDMLVEQTHHMTTFDIKGEKHLRYTDTRIDEQERGISIKAVPMSLVLEDGNSKSYLCNIMDTPGHTNFSDEMTAALRLADGAVLIVDAAEGVMVNTERAIRHAIQERLPIVVVINKVDRLITELKLPPRDAYYKLRHTLEIINNHISAASSTAGNVQVIDPAAGNVCFASATAGWSFTLQSFAKLYVKLHGIAFDADKFASRLWGDYYYHSDTRGFKKKQPASGGERSFVQFVLEPLYKIYSQVIGEHRKSVETTLAEFGVTLSNAAYKLNVRPLLRLACSSVFGGASGFTDMLVQHIPSPRDFSSQKVDHIYTGPKDSVIYKAMKECAPSGPLMVNVTKLYPKSDCSVFDAFGRVYSGKIQTGQTVRVLGEGYSPEDEEDMTIKEVTKLWLYQARDRVPIAEAPPGSWVLIEGVDASIMKTATLSNVDYDEDVYIFRPLQFNTLPVVKTATEPLNPSELPKMVEGLRKISKSYPLAITKVEESGEHTILGTGELYLDSIMKDLRELYSEVEVKVADPVVSFCETVVESSSMKCFAETPNKKNKITMIAEPLERGLAEDIENGVVSLDWSRKKLGDFFQTKYEWDLLAARSIWAFGPDKQGPNILLDDTLSSEVDKNLLNAVKDSIVQGFQWGAREGPLCDEPIRNVKFKIVDAKIAPEPLHRGSGQIIPTARRVAYSSFLMATPRLMEPVYYVEIQTPIDCVSAIYTVLSRRRGHVTADVAQPGTPAYIVKAFLPVIESFGFETDLRYHTQGQAFCLSVFDHWAIVPGDPLDKSIVLRPLEPAPIQHLAREFMVKTRRRKGMSEDVSINKFFDEAMMVELAQQAADLHQQMI

SEQ ID NO: 9656 - protein, 719 aa, Zea mays
MAEETANDAQVAQDNEIALSNEAIQGDELVHVEELSQGDDLVQGNELVVSEVTTPTIGTRRRRKKSLVWEHFTIEAVAGGATRACCKLCKQTFAYSSGSKIAGTSHLKRHITLGSCPKIKNQEQRLALPSTGGTDNDGEGTIERRTKRRYRYTGYANAAFDQDRSCSYLAKLIIQHDYPLHIVQQPSFAIFIESLQPRFKIVDVETMEGEVYAVYQKEKENLLQAFNSMPGRISLTIGLWTTSQTLGYVSLAGQFIDSEWKVHRRMLNFMMVSSPHSENALSEAISMSLSDWNMKDRLFTITLDNECSSHDIYSANLRDHLSNKNNLMLKGQLFVVRCYAHILNAVALDVIASIHGVVYSIRESIKFIKASSAREEKFAEIALQLEIPSTKTLCLDVTTQWNTTYLMLLAALDYKQTFTTLETCDDNYNEAPSAEDWKKVEAACNYLKLLYDSAHSIMAAANPTANIFFHEAWKLQLELANGTGHEDPTFSSIAKDMHERFDKYWKDCSLVLAIAVVMDPRFKMKLVEFSYSKIYGAGAAKYVKVVDDAVHELYKEYVAQPLPLTPAYVDQGEGNNGPANANSSQGAPASTGDGLLDFDMYLSEIQSSQPSKSELEQYLDESLTPRIQEFDILNWWKLNTVKFPTLSKMARDILAIPVSMVSSGSSIFCAGTGSHMLDDYRSSLRPEIVEALVCAKDWLQYSPPATEAPSSALVKAQGS

SEQ ID NO: 9657 - protein, 736 aa, Setaria italica
MVEETANDTQVAQDNEIAPNDEAIQGDEMVQGDELTQGDELAQGEEFVQGDELAQGDDLVQGNELVVAEETTPRTGTRRRRKKSLVWEHFTIEEVAGGATRACCNLCKQTFAYSSGSKIAGTSHLKRHITLGSCPKIKSQEQRLALPSTGGTDNDGEGSVERRTKRRYRYTGYANAAFDQDRSCSYLAKMIIQHDYPLHIVQQPTFATFIESLQPRFKIVDVDTMEGEVYAVYQKEKDNLLQTFNTMPGRISLTIGLWTTSQTLGYVSLAGQFIDSEWKVHRRMLSFMMVSSPHSENALSEAISMSLSDWNMKDRLFTITLDNECSSHDIYSANLRDHLSNKNNLMLKGQLFVVRCYAHILNAVAQDVIASIHGVVYSIRESIKFIKASSAREERFAEIALQLEIPSTKTLCLDVTTQWNTTYLMLLAALDYKQAFTTLETCDDNYNEAPSAEDWKKVEAACTYLKLLYDSAHSIMAAANPTSNLFFHEAWKLQLELANGTGHEDPIFSSIAKDMHERFDKYWKDCSLVLAIAVVMDPRFKMKLVEFSYSKIYGAEAAKYVKVVNDAVHELYKEYVAQPLPLTPAYVEQGEANNGPANANNSQGAPSTGDGLLDFDMYLSEIQSSQPSKSELEQYLDESLTPRIQEFDILNWWKLNTVKFPTLSKMARDILAIPMSMVSSGSSIFTAGTGSRMLDDYRSSLRPEIVEALVCAKDWLQYSPATTEAPSSALVKAEGS

SEQ ID NO: 9658 - protein, 740 aa, Setaria italica
MAEETANDTQVPQDNEVAPNDEAVQGDELVQGDDELAQGDDELAQGEELAQGDELTQGDDLVQGNELAVAEETTPGTRTRRRRSKKSLVWEHFTIEEVAGGVTRACCNLCKQTFAYSSGSKIAGTSHLKRHITLGSCPKIKRQEQRLLLPSAGGTDNDGEGTAERPTKRRYRYTGYANAAFDQDRSYSYLAKMIIQHDYPLHIVQQPAFATFIESLQPRFKIVDVDTMEGEVYAVYQKEKENLLQAFNTMPGRISLTIGLWTTSQTLGYVSLAGQFIDSEWKVHRRMLNFMMVSSPHSENALSEAISMSLSDWNMKDRLFTITLDNECSSHDIYSANLRDHLSNKNNLMLKGQLFVVRCYAHVLNAVALDVIASIHGVIYSIRESIKFIKASSAREEKFAEIALQLEIPSTKTLCLDVTTQWNTTYLMLLAALDYKQAFTTLETCDDNYNEAPSAEDWKKVEAACNYLKLLYDSAHSIMAAGNPTSNLFFHEAWKLQLELSNGTGHEDPIFSGIAKDMHERFDKYWKDCSLVLAIAVVMDPRFKMKLVEFSYSKIYGAEAAKYVKVVDDAVHDLYKEYVAQPLPLTPAYVEQGEANNGPANANNSQGAPASTGDGLLDFDMYLSEIQSSQPSKSELEQYLDESLTPRIQEFDILNWWKLNTVKFPTLSKMARDILAIPMSMVSSGSSIFSAGTGSHMLDDYRSSLRPEIVEALVCTKDWLQYSPATTEAPTSALVKAEGS

SEQ ID NO: 9659 - protein, 728 aa, Pennisetum glaucum
MVEETFNDTQVAQDNEIAPNDEAVQGDEMVQGHELTQGYELAQGEEFAQGDDLLQGNELVVAEETTPRTGIRRRRKKSLVWEHFTIEEVAGGATRACCNLCKQTFAYSSGSKIAGTSHLKRHITLGSCPKIKSQEQRLGLPSAGGTDNDGEGSVERRTKRRYRYTGYANAAFDQDRSCSYLAKMIIQHDYPLHIVQQPIFATFIESLQPRFKIVDVDTMEGEVYAVYQKEKENLQQAFNTMPGRISLTIGLWTTSQTLGYVSLAGQFIDSEWKLHRRMLSFMMVSSPHSENALSEAISMSLSDWNMKDRLFTITLDNECSSHDIYSANLRDHLSNKNNLMLKGQLFVVRCYAHILNAVAQDVIASIHGVIYSIRESIKFIKASSAREERFAEIALQLEIPSTKTLCLDVTTQWNTTYLMLLAALDYKQAFTTLETCDDNYNEAPSAEDWKKVEAACTYLKLLYDSAHSIMAAANPTSNLFFHEAWKLQLELTNGTGHEDPIFSSVAKDMHERFDKYWKDCSLVLAIAVVMDPRFKMKLIEFSYSKIYGAEAAKYVKVVNDAVHELYKEYVAQPLPLTPAYLEQGEANNGPANASHGAPSTGDGLLDFDMYLSEIQSSQPSKSELEQYLDESLTPRIQDFDILNWWKLNTVKFPTLAKMARDILAIPMSMVSSGSSIFTAGTGSHMLDDYRSSLRPEIVEALVCAKDWLQYSPATTEAPSSAPVKAEGS

SEQ ID NO: 9660 - protein, 736 aa, Echinochloa colona
MAEETANDTQVAQDNEVAHIDEPVQGDELVQGEELAQGDELIQGEELTQGDELTQGDDLVQGNELVVAEATTPRTGIRRRRKKSLVWEHFTIEEVAGGATRACCNLCKQTFAYSSGAKIAGTSHLKRHITLGSCPMIKSQEQRLALPSAGGGTDNDGEGSVERPTKRRYRYTGYANAAFDQDRSCSYLAKMIIQHDYPLHIVQQPAFATFIESMQPRFKIVDVETMEGEVYAVYQKEKENLMQAFNTMPGRISLTIGLWTTSQTLGYVSLAGQFIDSEWKVHRRMLSFMMVSSPHSENALSEAISMSLSDWNMKDKLFTITLDNECSSHDIYSANLRDHLSNKNNLMLKGQLFVVRCYAHILNAVAQDVIASIHGVVYNIRESIKFIKASSAREEKFAEIALQLEIPSTKTLCLDVTTRWNTTYLMLLAALDYKEAFTQLETCDDNYNEAPSAEDWKKVEAACTYLKLLYDSAHSIMAAANPTSNLFFHEAWKLQLELTNGTGHEDPIFSSMAKDMHERFDKYWKDCSLVLAIAVVMDPRFKMKLVEFSYSKIYGAEAAKYVKVVNDAVHELYKEYVAQPLPLTPAYIEQGEGNNGPANENNGQGAPASTGDGLLDFDMYLSEIQSSQPSKSELEQYLDESLTPRMQEFDILNWWKLNTVKFPTLSKMARDILAIPMSMVSSGSSIFSAGTGSRMLDDYRSSLRPEIVEALVCAKDWLQYSPAASEAPSSALVKAE

SEQ ID NO: 9661 - protein, 737 aa, Panicum virgatum
MAEETANDAQVAQENAVAPNDEAVQTDELVQGEDMAQADELIQGEEINQGDELVHGDDFVQGNELVVAEETTPRTGTRRRRKKSLVWEHFTIEEVAGGVTRACCNLCKQTFAYSSGSKIAGTSHLKRHITLGSCPKIKNQEQRLALPSAGGTDNDGEGTVERRTKRRYRYTGYANAAFDQDRSCSYLAKMIIQHDYPLHIVQQQAFGTFIESLQPRFKIVDVDTMEGEVYAVYQKEKENLLQAFNTMPGRISLTIGLWTTSQTLGYVSLAGQFIDSEWKVHRRMLSFMMVSSPHSENALSEAISMTLSDWNMKDKLFTITLDNDCSSHDIYSANLRDYLSNKNNLMLKGQLFVVRCYAHILNVVAQDVIASIHGVIYNIRESIKFIKASSAREEKFAEIALQLEIPSTKTLCLDVTTQWNTTYLMLLAALDYKQAFTTLETCDDNYNEAPSGEDWKKVEAACTYLKLLYDSAHSIMASTNPTSNLFFHEAWKLQLELSNGTGHEDPIFSSIAKDMHERFDKYWKDCSLVLAIAVVMDPRFKMKLVEFSYSKIYGAEAAKYVKVVNDAVHELYKEYVAQPLPLTPAYAEHGEPNNGPANANNSHGAPAATGDGLLDFDMYLSEIQSSQPSKSELEQYLDESLTPRIQEFDILDWWKLNTVKFPTLSKMARDILAIPMSMVSSGASIFSAGTGSRMLDDYRSSLRPEIVEAIVCAKDWLQYSAPATEAPSSALVKAEGS

SEQ ID NO: 9662 - protein, 711 aa, Zea mays
MAVETASDAQVAQDNEISPSNEAIQGDELAHGEELFQGDDLVQGNELVVSEVTTPPTTGIRRRRKKKSLVWEHFTIEAVAGGATRACCNLCKQTFAYSSGSKIAGTSHLKRHITLGSCPKIKDQDQRLALPSTGGTDNYGEATSERPTKRRYRYTGYANAVFDQDRSCSYLARMIIQHDYPLHIVQQQAFSVFIESLQPRFKIVDVDTMEGEVYAVYQKEKENLLRSFNTMPGRISLTIGLWTTSQTLGYVSLAGQFIDSEWKVRRRMLNFMMVSSPHSENALSEAISLSLSDWSMKDKLFTITLDNECSSHDIYSANLRDHLSNKNSLMLKGQLFVVRCYAHILNAVAQDVIASVHGVVYNIRESIKFIKASSAREEKFAEIALQLEIPSTRTLCLDVTTQWNTTYLMLLAALDYKQAFTALETCDDSYNEAPSSEDWRKVEAACNYLKLLYDSAHSIMAAANPTANIFFHEAWKLQLELANGTGHEDPTFRSIAKDMHERFDKYWKDCSLVLAVAVVMDPRFKMKLVEFSYTKIYGAEAAKHVKVVNDAVHELYEEYVAHPLPLTPAYVEQGEGGNNGAANANSSQGPPASAGDGLLDFDMYLSEIQSSQPSKPELEQYLDESLTPRTQEFDILNWWKLNRVKFPTLSRMACDILAIPMSMVSSGSSIFTAGTGSRMLDDYRSSLRPETVEALVCAKDWLQYSTKAEGS

SEQ ID NO: 9663 - protein, 734 aa, Pennisetum glaucum
MAEETANGTQVPQENEVAPNDDAVQGDELVQGDDELAQGEDELAQGEELAHGDELTQDLVQGHELAVAEETTPGTRTRRRRCKKSLVWEHFTIEEVAGGVTRACCNLCKQSFAYSSGSKIAGTSHLKRHITLGSCPMIKRQDQRLMLPSAGGTDNDGDGTVERPTKRRYRYTGYANATFDQDRSYSYLAKMIIQHDYPLHIVQQPAFAIFIESLQPRFKIVDVETMEGEVYAVYQKEKENLLQAFNTMPGRISLTIGLWTTSQTLGYVSLAGQFIDSEWKVHRRMLNFMMVSSPHSENALSEAISSTLSDWNMKDRLFTITLDNECSSHDIYSANLRDHLSNKNNLMLKGQLFVVRCYAHILNAVALDVIASIHGVIYSIRESIKFIKASPAREEKFAEIALQLEIPSTKTLCLDVTTQWNTTYLMLLAALDYKQAFTTLETCDDNYNEAPSADDWKKVEAACNYLKLLYDSAHSIMAAGNPTSNLFFHEAWKLQLELSNGTGHEDPIFSGLAKDMHERFDKYWKDCSLVLAIAVVMDPRFKMKLVEFSYSKIYGAEAAKYVKVVDDAVHDLYKEYVAQPPAYVEQGEANNGPANANNSQGAPASTGDGLLDFDMYLSEIQSSQPSKSELEQYLDESLTPRMQEFDILHWWKLNTVKFPTLSRMARDILAIPMSMVSSGSSIFSAGTASHMLDDYRSSLRPEIVEALVCGKDWLQYSSASTEAPSSALVKPEGS

SEQ ID NO: 9664 - protein, 749 aa, Panicum virgatum
MAEETTNDTQVAQENEVAPNDEAVQADELVQAEDMAQADELIQGEEINQGDELTHGDDFMQGNELVVAEETTPRTGTRRRRKKSLVWEHFTIEEVSGGATRACCNLCKQTFAYSSGSKIAGTSHLKRHITLGSCPKIKNQEQRLALPSAGGTDNDGEGTVERRTKRRYRYTGYANAAFDQDRSCSYLAKMIIQHDYPLHIVQQPAFSTFIESLQPRFKIVDVDTMEGEVYSVYQKEKENLLQAFSTMPGRISLTIGLWTTSQTLGYVSLAGQFIDSEWKVHRRMLSFMMVSSPHSENALSEAISMTLSDWNMKDKLFTITLDNECSSHDIYSANLRDYLSNKNNLMLKGQLFVVRCYAHILNAIAQDVIASIHGVIYNIRESIKFIKASSAREEKFAEIALQLEIPSTKTLCLDVTTQWNTTYLMLLAALDYKQAFTTLETCVDNYNEAPSGEDWKKVEAACTYLKLLYDSAHSIMASTNPTSNLFFHEAWKLQLELSNGTGHEDPIFSSIAKDMHEKFDKYWKDCSLVLAIAVVMDPRFKMKLVEFSYSKIYGAEAAKYVKVVDDAVHELYKEYVAQPLPLTPAYAEQGEANNGPANANNSQGAPASTGDGLLDFDMYLSEIQSSQPSKSELEQYLDESLTPRMQEFDILNWWKLNTVKFPTLSKMARDILAIPMSMVSSGNSIFTAGTGSHMLDDYRSSLRPEIVEALFCAKDWLQYSAAAKDAPSSALVKAEGSEVRCGHFFLVEP

SEQ ID NO: 9665 - protein, 737 aa, Panicum virgatum
MAEETANNTQVAQENDVAPNDEAVQADELVQAEDMAQADELIQGEEINQGDELVHGDDFIQGNELVVAEETTPRTGTRRRRKRSSVWEHFTIEEVAGGATRACCNLCKQTFAYSSGPKIAGTSHLKRHITLGSCPKINNQEQRLALPSAGGTDNDGEGTVERRTKRRYRYTGYANAAFDQDCSCSYLAKMIIQHDYPLHIVQQPAFRTLIESLQPRFKIVDVDTMEGEVHAVYQKEKENLHQAFNTMPGRISLTIGLWTTSQTLGYVSLAGQFIDSEWKVHRRMLSFMMVSSPHSENALSKAISMTLSDWNTKDKLFTITLDNECSSHDIYSANLRDYLSNKNNLMLKGQLFVVRCYAHILNAVAQDVIASIHGVIYNIRESIKFIKASSAREEKFAEIALQLEIPSTKTLCLDVTTQWNTTYLMLLAALDYKQAFTTLETCDDNYNEAPSGKDWKKVEAACSYLRLLYDSAHSIMASTNPTSNLFFHEAWKLQLELSNGTGHEDPIFSSVAKDMHERFDKYWKDCSLVLAIAVVMDPRFKMKLVEFSYSKIYGAEAAKYVKVVNDAMHELYKEYVAQPLPLTPAYAEHGEANNVTANANNSQGAPAATGDGLLDFDMYLSEIQSSQPSKSELEQYLDESLTPRMQKFDILNWWKLNTVKFPTLSKMARDILAIPMSMVSSGNSIFTAGTGNRMLDDYRSSLRPEIVEALFCAKDWLQYSAAAKDAPSSALVKAEGS

SEQ ID NO: 9666 - protein, 722 aa, Oryza sativa
MAEETGNDNQVVQGNEIVPSNEEAQAEEVQGDELVPAEDLTQGDEVQGNELVSAEISTPPTLRRRRKKSLVWEHFTIEAVSGGATRACCKLCKQTFAYSSGSKIAGTSHLKRHITLGSCPKIKNQEHKLALTPAGGTDNDGEGTVERPSKRRYRYTGYANAAFDQDRSCSYLAKMIILHDYPLHIVQQPAFTTFIDSLQPRFRVVDVETMEGEVYAVYQKEKENLTQAFSTMPGRISLTIGLWTTSQTLGYVSLSGQFIDSEWKIHRRMLNFMMVSSPHSENALSEAISASLSDWNMKDKLFTITLDNDCSSHDIYSANLRDYLSNKNNLMLKGQLFVVRCYAHILNAVAQDVIASIHGVIYNIRESIKFIKASPTREEKFAEIALQLEIPSTKTLCLDVTTQWNTTYLMLLAALDYKQAFSTLETSDDNYNEAPSAEDWKKVEAACNYLKLLYDSAHSIMAAANPTSNLFFHEAWKLQLELSNATGHEDPVFSSIAKDMHERFDKYWKDCNLVLAIAVVMDPRFKMKLVEFSYSKIYGVEAAKYVKVVDDAVHELYKEYVAQPLPLTPAYVEQGEGNNAPASENSTQTTAPSTGDGLVDFDMYLSEIATSQPTKSELEQYLDESLTPRIQEFDILNWWKLNTLKFPTLSKMARDILAIPMSMVSSGNSIFSAGTGTRMLDDYRSSLRPEIVEALFCAKDWLQYSPATPEAPSTALVKVDAP

SEQ ID NO: 9667 - protein, 722 aa, Oryza sativa
MTEETGNDFQMVQGYEIVPSNEEAHAEEVQGDELVLAEDLAQGDEVQVNRLVSAEMSTPPTSRRRRKKSLVWEHFTIEAVSGGATRACCKLCKQTFAYSSGSKIAGTSHLKRHITLGSCPKIKNQEHKLALTPAVGTDNDGEGTVERPSKRRYRYTGYANAAFDQDRSCSYLAKMIILHDYPLHIVQQPAFTTFIDSLQPRFRVVDVETMEGEVYAVYQKEKENLMQAFSTMPGRISLTIGLWTTSQTLGYVSLAGQFIDSEWKIHRRMLNFMMVSSPHSENALSEAISTSLSDWNMKDKLFTITLDNDCSSHDIYSANLRDYLSNKNNLMLKGQLFVVRCYAHILNAVAQDVIASIHGVIYNIRESIKFIKASPSREEKFAEIALQLEIPSTKTLCLDVTTQWNTTYLMLLAALDYKQAFSTLETSDDNYNEAPSAEDWKKVEAACNYLKLLYDSAHSIMAAANPTSNLFFHEAWKLQLELSNATGHEDPVFSSIAKDMHERFDKYWKDCNLVLAIAVVMDPRFKMKLVEFSYSKIYGVEAAKYVKVVDDAVHELYKEYVAQPLPLTPAYVEQGDGNNAPASENGTQATAPSTGDGLVDFDMYLSEIATSQPTKSELEQYLDESLTPRIQEFDILNWWKLNTLKFPTLSRMARDILAIPMSMVSSGNSIFSAGTGTRMLDDYRSSLRPEIVEALVCAKDWLQYLPATPEAPSTTLVKVDAP

SEQ ID NO: 9668 - protein, 731 aa, Brachypodium distachyon
MAEETGNETQVVVANEVVDPSNEIVDPSNEVVHDDELVQADELTQGEELTHGEELLEGHEMVVAEVTTPKTARRRRKKSLVWEHFTIEDAPGGATRACCKLCKQTFAYSSGSKIAGTSHLKRHITLGSCPKIKNQEHKLALVSAAGTDNDGEGTVERRAKRRYRYTGYANASFDQDRSCSYLAKMIILHDYPLHIVQQPAFTVFIDSLQPRFRVVDVDAMEGEVYAVYQKEKESLLQALSSMPGRISLTIGLWTTSQTLGYVSLAGQFIDSEWKLHRRMLNFMMVSSPHSENALSEAISTSLTDWSMKEKLFTITLDNDCSSHDIYSANLRDYLSNKNDLMLKGQLFVVRCYAHILNAVAQDVIASIHGVIYNIRESIKFIKASPSREEKFAEIALQLEIPSTKTLCLDVTTQWNTTYLMLLAALDYKQAFTTLETCDDNYNEAPSAEDWKKVEAACNYLKLLYDSAHSIMAAANPTSNIFFHEAWKLQLELANSIGHEDPVFSGIAKDMHERFDKYWKDCNLVLAVAVVMDPRFKMKLVEFSYSKIYGIEAAKYVKVVNDSVHELYKDYVAQPLPLTPAYVEQGETTNNAAANGNNPRATQPSTGDGLLDFDMYLSEIATSQPSKSELEQYLDESLTPRIQEFDILNWWKLNTLKFPTLSKMARDILAIPMSMVTIGSSIFSAGTGSHMLDDYRSSLRPEIVEALVCTKDWLQYTTTASETPSSAIVKAE

SEQ ID NO: 9669 - protein, 722 aa, Oryza sativa
MAEETSNDNLVVQGNEIVPSNGEALAEEVQGDELVLAEDLIQGDEVQGNELVSAEMSIPPTSRRRRKKSLVWEHFTIEAVSGGATRACCKLCKQTFAYSSGSKIAGTSHLKRHITLGSCPKIKNQEHKLLLTPAGGTDNDGEGTVERPSKRRYRYTGYANAAFDQERSCSYLAKMIILHDYPLHIVQQPAFTTFIDSLQPRFRVVDVETMEWEVYAVYQKEKENLMQAFNTMPGRISLAIGLWTTSQTLGYVSLAGQFIDSEWKMHRRMLNFMMVSSPHSENALSEAISTSLSDWNMKDKLFTITLDNDCSSHDIYSANLRDYLSNKNNLMLKGQLFVVRCYAHILNAVAQDVIASIHGVIYNIRESIKFIKASPSCEEKFAEIALQLEIPSTKTLCLDVTTQWNTTYLMLLAALDYKQAFSTLETSDDNYNEAPSAEDWKKVEAACNYLKLLYDSAHSIMAAANPTSNLFFHEAWKLQLELSNATGREDPVFSSIAKDMHERFDKYWKDCNLVLAIAVVMDPRFKMKLVEFSYSKIYGVEAAKYVKVVDDAVHELYNEYVAQPLPLTPAYVEQGGGNNAPASENSTQATAPSTGDGLVDFDMYLSEIATSQPTKSELEQYLDESLTPRIQEFDILNWWKLNTLKYPTLSKMARDILAIPMSMVSSGNSIFSAGTGTRMLDDYRSSSRPEIVEALVCAKDWLQYLPATPEAPSTALVKVDAA

SEQ ID NO: 9670 - protein, 727 aa, Hordeum vulgare
MADETGNDSQMVEGNEIVDPGNEVVHGGELVEVDELAQGDELAQGEDLTQVDELLQGNEMAITEVATPPTTRRRRKKSLVWEHFTIEDAAGGATRACCKLCKQTFAYSSGSKIAGTSHLKRHITLGSCPKIKGQGHKLAITIGTDNDGDGTVERRSKRRYRYTGYANASFNQDRSCSYLAKMIILHDYPLHIVQQPAFTAFIDSLQPRFRVADVDAMEVEVYAVYQKEKENLLQAFSTMPGRISLTIGLWTTSQTLGYVSVSGQFIDSEWKLHRRMLSFMMVSSPHSENALSEAISSSLTDWSMKEKLFTITLDNDCSSHDIYSANLRDYLSSKNNHMLKGQLFVVRCYAHILNAVAEDVIALIHGVIYSIRESIKFIKASPSREEKFAEIALQLEIPSTKTLCLDVTTQWNTTYLMLLAALDYRQAFITLETVDDNYNEAPSAEDWKKIEAACNYLRLLYDSAHSIMAAGNPTSNIFFHEAWKLQLELANASAHEDPIFSSVAKDMYEKFDKYWKDCNLVLAVAVVMDPRFKMKLVEFSYSKIYGVEAAKYVKVVNDSVHDLFKDYVAQPLPLTPAYVEQGKTDNVTANGNNTQATQPSTGDGLQDFDIYLSEIATTQPSKSELEQYLDESLTPRIQEFDILNWWKLNTLKYPTLSKMARDILSIPVSMVTGGSSIFSAGTGGHMLDDYRSSLRPEIVEALVCAKDWLPYSTTAPVALGSELLKMD

SEQ ID NO: 9671 - protein, 730 aa, Festuca arundinacea
MADEAGNDSQVVQGNETVDPSNEAGHEDAMIHGNELVQVDEMTQGDEMGQGEELTQGEELLEGHELAIAEVATPPTTRRRKKKSLVWEHFTIEDAAGGATRACCKLCKQTFAYSSGPKIAGTSHLKRHITLGSCPKIKSQEHKIALASTIGTDNDGDCTVERRSKRRYRYTGYANASFDQDRSCSYLAKMIILHDYPLHIVQQPTFTAFIDSLQPRFRVADVDTMEGEVYAVYQREKEGLLQAFSTMPGRISLTIGLWTTSQTLGYVSLAGQFIDSDWKLHRRMLNFMMVSSPHSENALSEAISASLTDWSMKDKLFTITLDNDCPSHDIYSANLRDHLSSKNDLSLKGQLFVVRCYAHILNAVAQDVIASIHGVIYNIRESIKFIKASPNREEKFAEIALQLEIPSTKTLCLDVTTQWNTTYLMLLAALDYKEAFTQLETCDDNYNEAPSFEDWKKVEAACNYLRLLYDSAHSIMAAGNPTSNIFFHEAWKLQLELANASGHEDPVFSIIAKDMHERFDKYWKDCNLVLSVAVVMDPRFKMKLVEFSYSKIYGVEAAKYVKVVNDSVHELFKDYVAQPLPEQGATNHAAANGNNTHANQPSTGDGLLDFDMYLSEIATSQPSKSELEQYLDESLTPRIQEFDILNWWKLNTLKFPTLSRMARDILAIPMSMATNGSSIFSAGTGTRMLDDYRSSLRPEIVEALVCAKDWLPYSTTAPEAPSSGLLGKME

SEQ ID NO: 9672 - protein, 456 aa, Triticum aestivum
MADETGNDSQMFEGNEIVDPGNEAVQGGELVEVDELAQGDELAQGEDLTQGDELLQGNEMAITEVATPPTTRRRRKKSLVWEHFTIEDAAGGATRACCKLCKQTFAYSSGSKIAGTSHLKRHITLGSCPKIKGQGHKLAITIGTDNDGDGTVERRSKRRYRYTGYANASFDQDRSYSYLAKMIILHDYPLHIVQQPAFTAFIDSLQPRFRVVDVDAMEVEVYAVYQKEKENLLQAFSAMPGRISLTIGLWTTSQTLGYVSVSGQLIDSEWKLHRRMLSFMMVSSPHSDNALSEAISSSLTDWGMKEKLFTITLDNDSLSHDIYSANLRDQLSSKNNLMLKGQLFVVRCYAHILDAAAQDVIALIHGVIYSIRESIKFIKASPSREEKFAEIALQLEIPSTKTLCLDVTTQWNTTYLMLLAALDYRQAFITLETVDENYNEAPSAEDWKKLRLPAIT

SEQ ID NO: 9673 - protein, 462 aa, Secale cereale
MADETGNDSQMFEGNEIVDPGNEAVHGDEAVQGGELVEVDELAQGDELAQGEDLTQGDELLQGNEMAITEVATPPTTRRRRKKSLVWEHFTIEDAAGGATRACCKLCKQTFAYSSGSKIAGTSHLKRHITLGSCPKIKGQGHKLAITIGTDNDGDGTVERRSKRRYRYTGYANASFDQDRSYSYLAKMIILHDYPLHIVQQPAFTAFIDSLQPRFRVVDVDAMEVEVYAVYQKEKENLLQAFSAMPGRISLTIGLWTTSQTLGYVSVSGQFIDSEWKLHRRMLSFMMVSSPHSDNALSEAISSSLTDWGMKEKLFTITLDNDSLSHDIYSANLRDQLSSKNNLMLKGQLFVVRCYAHILDAAAQDVIALIHGVIYSIRESIKFIKASPSREEKFAEIALQLEIPSTKTLCLDVTTQWNTTYLMLLAALDYRQAFITLETVDDNYNEAPSAEDWKKLRLPAIT

SEQ ID NO: 9674 - protein, 733 aa, Secale cereale
MADETGNDSQMFEGNEIVDPGNEAVHGDEAVQGGELVEVDELAQGDELAQGEDLTQGDELLQGNEMAITEVATPPTTRRRRKKSLVWEHFTIEDAAGGATRACCKLCKQTFAYSSGSKIAGTSHLKRHITLGSCPKIKGQGHKLAITIGTDNDGDGTVERRSKRRYRYTGYANASFDQDRSYSYLAKMIILHDYPLHIVQQPAFTAFIDSLQPRFRVVDVDAMEVEVYAVYQKEKENLLQAFSAMPGRISLTIGLWTTSQTLGYVSVSGQFIDSEWKLHRRMLSFMMVSSPHSDNALSEAISSSLTDWGMKEKLFTITLDNDSLSHDIYSANLRDQLSSKNNLMLKGQLFVVRCYAHILDAAAQDVIALIHGVIYSIRESIKFIKASPSREEKFAEIALQLEIPSTKTLCLDVTTQWNTTYLMLLAALDYRQAFITLETVDDNYNEAPSAEDWKKIEAACNYLRLLYDSAHSIMAAGNPTSNIFFHEAWKLQLELGNGSAHEDPIFSSIAKDMYERFDKYWKDCNLVLAVAVVMDPRFKMKLVEFSYSKIYGVEAAKYVKVVNDSVHDLFKDYVAQPLPLTPVYAEQGKSDNATANGNNTQATQPSTGDGLQDFDIYLSEIATTQPSKSELEQYLDESLTPRIQEFDILNWWKLNMQKYPTLSKMARDILAIPVSMVTGGSSIFSAGTGCHVLDDYRSSLRPEIVEALVCAKDWLPNSTAAPEAPGSGLLKMD

SEQ ID NO: 9675 - protein, 733 aa, Secale cereale
MADETGNDSQMFEGNEIVDPGNEAVHGDEAVQGGELVEVDELAQGDELAQGEDLTQGDELLQGNEMAITEVATPPTTRRRRKKSLVWEHFTIEDAAGGATRACCKLCKQTFAYSSGSKIAGTSHLKRHITLGSCPKIKGQGHKLAITIGTDNDGDGTVERRSKRRYRYTGYANASFDQDRSYSYLAKMIILHDYPLHIVQQPAFTAFIDSLQPRFRVVDVDAMEVEVYAVYQKEKENLLQAFSAMPGRISLTIGLWTTSQTLGYVSVSGQFIDSEWKLHRRMLSFMMVSSPHSDNALSEAISSSLTDWGMKEKLFTITLDNDSLSHDIYSANLRDQLSSKNNLMLKGQLFVVRCYAHILDAAAQDVIALIHGVIYSIRESIKFIKASPSREEKFAEIALQLEIPSTKTLCLDVTTQWNTTYLMLLAALDYRQAFITLETVDDNYNEAPSAEDWKKIEAACNYLRLLYDSAHSIMAAGNPTSNIFFHEAWKLQLELGNGSAHEDPIFSSIAKDMYERFDKYWKDCNLVLAVAVVMDPRFKMKLVEFSYSKIYGVEAAKYVKVVNDSVHDLFKDYVAQPLPLTPVYAEQGKTDNATANGNNTQATQPSTGDGLQDFDIYLSEIATTQPSKSELEQYLDESLTPRIQEFDILNWWKLNMQKYPTLSKMARDILAIPVSMVTGGSSIFSAGTGCHVLDDYRSSLRPEIVEALVCAKDWLPNSTAAPEAPGSGLLKMD

SEQ ID NO: 9676 - protein, 733 aa, Triticum aestivum
MADETGNDSQMFEGNEIVDPGNEAVHGDEAVQGGELVEVDELAQGDELAQGEDLTQGDELLQGNEMAITEVATPPTTRRRRKKSLVWEHFTIEDAAGGATRACCKLCKQTFAYSSGSKIAGTSHLKRHITLGSCPKIKGQGHKLAITIGTDNDGDGTVERRSKRRYRYTGYANAAFDQDRSYSYLAKMIILHDYPLHIVQQPAFTAFIDSLQPRFRVVDVDAMEVEVYAVYQKEKENLLQAFSAMPGRISLTIGLWTTSQTLGYVSVSGQFIDSEWKLHRRMLSFMMVSSPHSDNALSEAISSSLTDWGMKEKLFTITLDNDSLSHDIYSANLRDQLSGKNNLMLKGQLFVVRCYAHILDAAAQDVIALIHGVIYSIRESIKFIKASPSREEKFAEIALQLEIPSTKTLCLDVTTQWNTTYLMLLAALDYRQAFITLETVDDNYNEAPSAEDWKKIEAACNYLRLLYDSAHSIMAAGNPTSNIFFHEAWKLQLELGNGSAHEDPIFSSIAKDMYERFDKYWKDCNLVLAVAVVMDPRFKMKLVEFSYSKIYGVEAAKYVKVVNDSVHDLFKDYVAQPLPLTPAYAEQGKTDNATANGNNTQATQPSTGDGLQDFDIYLSEIATTQPSKSELEQYLDESLTPRIQEFDILNWWKLNMQKYPTLSKMARDILAIPVSMVTGGTSIFSAGTGCHVLDDYRSSLRPEIVEALVCAKDWLPNSTAAPEALGSGLLKMD

SEQ ID NO: 9677 - protein, 733 aa, Secale cereale
MADETGNDSQMFEGNEIVDPGNEAVHGDEAVQGGELVEVDELAQGDELAQGEDLTQGDELLQGNEMAITEVATPPTTRRRRKKSLVWEHFTIEDAAGGATRACCKLCKQTFAYSSGSKIAGTSHLKRHITLGSCPKIKGQGHKLAITIGTDNDGDGTVERRSKRRYRYTGYANASFDQDRSYSYSAKMIILHDYPLHIVQQPAFTAFIDSLQPRFRVVDVDAMEVEVYAVYQKEKENLLQAFSAMPGRISLTIGLWTTSQTLGYVSVSGQFIDSEWKLHRRMLSFMMVSSPHSDNALSEAISSSLTDWGMKEKLFTITLDNDSLSHDIYSANLRDQLSSKNNLMLKGQLFVVRCYAHILDAAAQDVIALIHGVIYSIRESIKFIKASPSREEKFAEIALQLEIPSTKTLCLDVTTQWNTTYLMLLAALDYRQAFITLETVDDNYNEAPSAEDWKKIEAACNYLRLLYDSAHSIMAAGNPTSNIFFHEAWKLQLELGNGSAHEDPIFSSIAKDMYERFDKYWKDCNLVLAVAVVMDPRFKMKLVEFSYSKIYGVEAAKYVKVVNDSVHDLFKDYVAQPLPLTPVYAEQGKTDNATANGNNTQATQPSTGDGLQDFDIYLSEIATTQPSKSELEQYLDESLTPRIQEFDILNWWKLNMQKYPTLSKMARDILAIPVSMVTGGSSIFSAGTGCHVLDDYRSSLRPEIVEALVCAKDWLPNSTAAPEAPGSGLLKMD

SEQ ID NO: 9678 - protein, 452 aa, Secale cereale
MADETGNDSQMFEGNEIVDPGNEAVHGDEAVQGGELVEVDELAQGDELAQGEDLTQGDELLQGNEMAITEVATPPTTRRRRKKSLVWEHFTIEDAAGGATRACCKLCKQTFAYSSGSKIAGTSHLKRHITLGSCPKIKGQGHKLAITIGTDNDGDGTVERRSKRRYRYTGYANASFDQDRSYSYLAKMIILHDYPLHIVQQPAFTAFIDSLQPRFRVVDVDAMEVEVYAVYQKEKENLLQAFSAMPGRISLTIGLWTTSQTLGYVSVSGQFIDSEWKLHRRMLSFMMVSSPHSDNALSEAISSSLTDWGMKEKLFTITLDNDSLSHDIYSANLRDQLSSKNNLMLKGQLFVVRCYAHILDAAAQDVIALIHGVIYSIRESIKFIKASPSREEKFAEIALQLEIPSTKTLCLDVTTQWNTTYLMLLAALDYRQAFITLETVDDNYNEAPSAED

SEQ ID NO: 9679 - protein, 768 aa, Panicum virgatum
MGDPNSIDNAMVHHSEMVDGNGVINGNEMVHGSEMIHSNEMVHGDEMIHGDEMIQGTEMIHGNDMVQVNDLIHGNELVQVNDMVNGDEMIHSNELINAEMTPQTTSRRRRKKSLVWEHFTIENMPGGSSRACCNLCKQTFAYSSGSKIAGTSHLKRHITLGSCPVMKDQDRKLALPPPGGPGTDNDGEGAVERPSKRRYRYTGYANATFDQERSFSYLAKMIILHDYPLHIVQQLPFTTFIQSLQPRFRVVDVETMEGEVYAVFQKSKENLLQAFSTMPGRISLTIGLWTTSQTLGYVSLAGQFIDSEWKVHRRMLNFMMVSSPHSENALSEAIIASLSEWNMKDMLFTITLDNDCSSHDIYSANLRDHLSNKNNLMLKGQLFVVRCYAHIMNVVAQDVIASIHGVIYNIRESIKFIKASPSREERFAEIALNLEIPSTKTLCLDVTTQWNTTYLMLLAALDYKQAFATLETRDDNYNEAPSAEDWKKVEAACTYLKLLYDSAHSIMASANPTANIFFHEAWKIQLELANGTEHEDPIFSSIAKDMHERFDKYWKDCSLVLAVAVVMDPRFKMKLVEFSYSKIYGAEAGKYVKVVNDSLHELYKEYVAQPLPLTPAYAEQGEANNVTASANGTQGNPPSTSDGLLDFDMYLSEIQSSQPAKCELEQYLEESLTPRIQEFDILNWWKLNTLKFPTLSKMARDILAIPMSMVSSGSSIFSAGTGNRMLDDYRSSLRPEIVEALVCAKDWLQYSPAPTEVPSSAMVKTEAS

SEQ ID NO: 9680 - protein, 462 aa, Triticum aestivum
MADETGNDSQMFEGNEIVDPGNEAVHGDEAVQGGELVEVDELAQGDELAQGEDLTQGDELLQGNEMAITEVATPPTTRRRRKKSLVWEHFTIEDAAGGATRACCKLCKQTFAYSSGSKIAGTSHLKRHITLGSCPKIKGQGHKLAITIGTDNDGDGTVERRSKRRYRYTGYANAAFDQDRSYSYLAKMIILHDYPLHIVQQPAFTAFIDSLQPRFRVVDVDAMEVEVYAVYQKEKENLLQAFSAMPGRISLTIGLWTTSQTLGYVSVSGQFIDSDWKLHRRMLSFMMVSSPHSDNALSEAISSSLTDWGMKEKLFTITLDNDSLSHDIYSANLRDQLSSKNNLMLKGQLFVVRCYAHILDAAAQDVIALIHGVIYSIRESIKFIKASPSREEKFAEIALQLEIPSTKTLCLDVTTQWNTTYLMLLAALDYRQAFITLETVDDNYNEAPSAEDWKKLRLPAIT

SEQ ID NO: 9681 - protein, 768 aa, Panicum virgatum
MGELNSNDNAMVHNSEMVDGNGVINGNEMVHGSEMIHSNEMVHGDEMIHGDEMIQGTEMIHGNEMVQVNDLIHGNELVQVNDMVNGDEMVHGNELINAEMTPHTTPRRRRKKSLVWEHFTIENMPGGSSRACCNLCKQTFAYSSGSKIAGTSHLKRHITLGSCPVMKDQDRKFALPPPGGPGTDNDGEGAVERPSKRRYRYTGYANATFDQERSFSYLAKMIILHDYPLHIVQQPPFTTFIESLQPRFRVVDVETMEGEVYAVFQKAKENLFQAFSTMPGRISLTIGLWTTSQTLGYVSLAGQFIDSEWKVHRRMLNFMMVSSPHSENALSEAISSSLSEWNMKDRLFTITLDNDCSSHDIYSANLRDHLSNKNNLMLKGQLFVVRCYAHIMNVVAQDVIASIHGVIYNIRESIKFIKASPSREERFAEIALNLEIPSTKTLCLDVTTQWNTTYLMLLAALDYKQAFATLETCDDNYNEAPSAEDWKKVEATCNYLKLLYDSAHSIMAAANPTANIFFHEAWKIQLELANGTEHEDPIFSSIAKDMHERFDKYWKDCSLVLAVAVVMDPRFKMKLVEFSYSKIYGAEAGKYVKVVNDSLHELYKEYVAQPLPLTPAYVEQREANNVAANANATQGNPPSTSDGLLDFDMYLSEIQSSQPAKCELEQYLEESLTPRIQEFDILNWWKLNTLKFPTLSKMARDILAIPMSIVSSGSSIFSAGTGNRMLDDYRSSLRPEIVEALVCAKDWLQYSPAPTEAPSSAVVKAEAS

SEQ ID NO: 9682 - protein, 672 aa, Panicum virgatum
MRGGDAGAAAEAGSPRSPDLYDLSDDSDYAAAASDHTAMRTDLVDRGSDETARIDVVYEKERVTIHPTQYGSGRISGKLRLFLQQGSLFLSWEPNEGADSLSTSSFGVEIEKYRNLYTIKALPLSDVRFIRKHTPTFGLDYIIIVLSSGLAFPPFYFYNGGIRELFATLKQHVFIIRSDDDPNVFLVNDFQDPLQKSLSSLELPGVATVANAMSRQNSLSFTGSVDETRHGADERLGEASSMSQYGSKQKHKSNDPGRDLSIQVLEKFSLVTKFARDTTSSLFRDNSGAHGYGRQQHEYVFDNKASDKYKNQYVAPEKASIPSAPLESDPLPLVWGKQRDCPLSVAEWTAFLDPEGRVMDSKALRKKVFYGGVEHVLRKEVWKFLLGYHEYDSTYAEREYLAAMKRAEYEAIKSQWKSISATQAKRFTKFRERKGLIDKDVVRTDRSVPYYEGDDNQNVVVLRDILLTYSFYNFDLGYCQGMSDFLAPILYVMEDESESFWCFASLMERLGANFNRDQNGMHAQLLALSKLVELLDPPLHNYFRQNDCLNYFFCFRWVLIQFKREFSFDQVMLLWEVLWTHYLSEHFHLYLCVAILKRYRQRIIGEQMDFDTLLKFINELSGQINLDRAIQDAEALCTIAGENGASCIPPGTPPSMPIETDGGLYVQEDEVL

SEQ ID NO: 9683 - protein, 670 aa, Saccharum officinarum
MRGGDVAAAEAGSPRSPDLYDLSDDSDYAAAAAAAAASDHTAMRTDPADRGSEETARVDVVYEKERVTIHPSQYGSGRISGKLRLFLQQGSLFLSWEPNEGADSLSTSSVGVEIEKYRNLYTIKALPLSDVRFIRRHTPTFGLDYIIIVLSSGLAFPPFYFYNGGIRELFATLKQHVFIIRSDDDPNVFLVNDFQDPLQKSLSSLELPGVACVANAMSRQNSLSFTGSNDESRHGATSSMSQYSSKQKHKSNDPGRDLSIQVLEKFSLVTKFARDTTSSLFRDNSGAHAYGRQQHEYILDNKATDKHKNQYMTPEKASTPLATIESDPLPLVWGKQRDHPLSVEEWTAFLDPEGRVMDSKALRKKVFYGGVDHALRKEVWKFLLGYHEYDSTYAEREYLAAMKRAEYEAVKSQWKSISATQAKRFTKFRERKGLIDKDVVRTDRSIPYYEGDDNQNVVVLRDILLTYSFYNFDLGYCQGMSDFLAPILYVMEDESESFWCFASLMERLGANFNRDQNGMHAQLLALSKLVELLDPPLHNYFRQNDCLNYFFCFRWVLIQFKREFSFDQIMLLWEVLWTHYLSEHFHLYLCVAILKKYRQRIIGEQMDFDTLLKFINELSGQLNLDRAIQDAEALCTIAGENGASCIPPGTPPSMPIETDGGLYVQEDEVL

SEQ ID NO: 9684 - protein, 677 aa, Brachypodium distachyon
MRGEAAADAGAGYPRSPEPHDLSDDSDYAAAAAASASIHAAIRSDMADIGSEETARVDVVYEKERVTIHPTQYGSSRISGKLRLYLQLGALFLSWEPNEGVDSFSTSSVTAEIEKYRNLYTIQALPVSDIRFIRRYNPTFGLEYIIIVLSSGLAFPPFYFYNGGTRELFATMKQHVFIIRSDDDPTLFLVNDFEDPLQKSLSSLELPGVATVANAMSRQNSFSFAGSVNEARHGDDAKHGGPSSIYEYGSKQKHKLNDPGRDLSLQVLEKFSLVTKFARDTTSSLFRENHSSGSHAYGRQKQEHVWDNRISDKYKDQQITQDDTSVLSDSTESDELLLVWGKKRGSPLTVDEWRAFLDPEGRIMDSKALRKKVFYGGVDHVLRKEVWKFLLGYHEYDSTQAEREYLAAMKREEYEAIKSQWKSISATQAKRFTKFRERKGLIDKDVVRTDRAVPFYEGDDNRNVVVLRDILLTYSFYNFDLGYCQGMSDFLAPILHVMEDESESFWCFASLMERLGGNFNRDQNGMHAQLLALSKLVELLDPPLHNYFRQNDCLNYFFCFRWVLIQFKREFSFDQIMLLWEVLWTQYLSEHFHLYLCVAILKRYRQRIIGEGMDFDTLLKFINELSGQINIDQAIQDAEALCTIAGDNGAACIPPGTPPSLPVETDGGLYLQEDDVL

SEQ ID NO: 9685 - protein, 682 aa, Triticum aestivum
MRGEAEPAARAGAADAGHPRSPDPHDLSDDPDYADAASVPASIHAAMRTDMADIGSEETARMDVVYEKERVTIHPTQYGSGRISGKLRLYLQLGSLFLSWEPNEGVNSFSTSSVSAEIEKYRNLYTIQALPLSDVRFIRRHTPTFGLEYIIIVLSSGLAFPPFYFYNGGIRELFATLKQHVFIIRSDDDPNVFLVNDFEDPLQKSLSSLELPGVATVANAMSRQNSFSFTGSVSEVRHGDDAKYGGPSTMSEYVSKQRRKSNDPGRDISFQVLEKFSLVTKFARETTSSLFRENHSSGSHAYGRQKQEYVLDNRASDKYTDQLITPNDASLTSDSVESDESLLVWGKKRGKPLSVEEWRAFLDPEGRIMDSKALRKKIFYGGVDHVLRKEVWKFLLGYHEYDSTQAEREYLAAMKQEEYEAIKSQWKSISTTQAKRFTKFRERKGLIDKDVVRTDRSVPYYEGDDNPNVVVLRDILLTYSFYNFDLGYCQGMSDFLAPILYVMEDESEAFWCFASLMERLGGNFNRDQNGMHAQLLGLSKLVELLDPSLHNYFRQNDCLNYFFCFRWVLIQFKREFSFDQIMLLWEVLWTHYFSEHFHLYLCVGILKRYRLRIIGEGMDFDTLLKFINELSGQINIDRAIQDAEALCTIAGEAGADCIPPGTPPSMPIETDGGLYLQEDDVL

SEQ ID NO: 9686 - protein, 682 aa, Triticum aestivum
MRGEAEPAARAGAADAGHPRSPDPHDLSDDPDYADAASVPASIHAAMRTDMADIGSEETARMDVVYEKERVTIHPTQYGSGRISGKLRLYLQLGSLFLSWEPNEGVNSFSTSSVTAEIEKYRSLYTIQALPLSDVRFIRRHTPTFGLEYIIIVLSSGLAFPPFYFYNGGIRELFATLKQHVFIIRSDDDPNVFLVNDFEDPLQKSLSSLELPGVATVANAMSRQNSFSFTGSVSEVRHGDDAKYGGPSTMSEYGSKQRRKSNDPGRDISFQVLEKFSLVTKFARETTSSLFRENHSSGSHAYGRQKQEYVLDNRASDKYTDQLITPNDASLTSDSVESDESLLVWGKKRGKPLSVEEWRAFLDPEGRIMDSKALRKKIFYGGVDHVLRKEVWKFLLGYHEYDSTQAEREYLAAMKQEEYEAIKSQWKSISTTQAKRFTKFRERKGLIDKDVVRTDRSVPYYEGDDNPNVVVLRDILLTYSFYNFDLGYCQGMSDFLAPILYVMEDESEAFWCFASLMERLGGNFNRDQNGMHAQLLGLSKLVELLDPSLHNYFRQNDCLNYFFCFRWVLIQFKREFSFDQVMLLWEVLWTHYFSEHFHLYLCVGILKRYRLRIIGEGMDFDTLLKFINELSGQINIDRAIQDAEALCTIAGEAGADCIPPGTPPSMPIETDGGLYLQEDDVL

SEQ ID NO: 9687 - protein, 317 aa, Triticum aestivum
MRGEAEPAARGAGAADAGHPRSQDPHDLSDDPDYADAASVPASIHAAMRTDMVDIGSEETARMDVVYEKERVTIHPTQYGSGRISGKLRLYLQLGSLFLSWEPNEGVNIFSTSSITAEIEKYRNLYTIQALPLSDVRFIRRHTPTFGLEYIIIVLSSGLAFPPFYFYNGGIRELFATLKQHVFIIRSDDDPNVFLVNDFEDPLQKSLSSLELPGVATVANAMSRQNSFSFTGSVSEVRHGDDAKYGGPSTMSEYVSKQRRKSSDPGRDISFQVLEKFSLVTKFARETTSSLFRENHSSGSHAYGRTKTRICFGQQSK

SEQ ID NO: 9688 - protein, 672 aa, Setaria italica
MRGGDAGAAAAEAGSPRSPDLYDFSDDSDYAAASHHTAMRTDSVDRGSDETARIDVVYEKERVTIHLTQYGSGRISGKLRLFLQRGSLFLSWEPNEGADSLSTSSIGVEIEKYRNLYTIKALPLSDVRFIRRHTPTFRLDYIIIVLSSGLAYPPFYFYNGGIRELFATLKQHVFIIRSDDDPNVFLVNDFQDPLQKSLSSLELPGVASVANAMSRQNSLSFTGANDESRHGTDGRHGEASSISQYGSKQKNKSNDPGRDLSIQVLEKFSLVTKFARDTTSSLFQNNSGAHAYGRQQHEYLLDNEASDKQKNQYITPEKASMPSAPPEPDPLPLVWGKQRDRPLSAEEWAAFLDPEGRVMDSKALRKKVFYGGVDHVLREKVWKFLLGYHEYDSTYAEREYHAAMKRAEYEAIKSQWKSITATQAKRFTKFRERKGLIDKDVVRTDRSVPYYEGDDNRNVVVLRDILLTYSFYNFDLGYCQGMSDFLAPILYVMEDESESFWCFASLMERLGANFNRDQNGMHAQLLALSKLVELLDPPLHNYFRQNDCLNYFFCFRWVLIQFKREFSFDQIMLLWEVLWTHYLSEHFHLYLCVAILKRYRQRIIGEQMDFDTLLKFINELSGQINLDRALQDAEALCTIAGENGASCIPPGTPPSMPIETDGGLYVQQDDVL

SEQ ID NO: 9689 - protein, 613 aa, Secale cereale
MRGEAAAAARAGAGAADAPHPRSPDPHDLSDDPDYADAASVPSSIHAAMRTDMADIGSEETARMDVVYEKERVTIHPTQYGSGRISGKLRLYLQLGSLFLSWEPNEGVNSFSTSSITAEIEKYRNLYTIQALPLSDVRFIRRHTPTFGLEYIIIVLSSGLAFPPFYFYNGGIRELFATLKQHVFIIRSDDDPNVFLVNDFEDPLQKSLSSLELPGVATVANAMSRQNSFSFTGSVSEVRHGDDVKYGGPSTMSEYGSKQRRKSNDPGRDISFQVLEKFSLVTKFARETTSSLFRENQSGSHAYGRQKQEYVLDNRTSDKYTDQLITPDDASLPSDSVESDELLLVWGKKRGNPLSVEEWRAFLDPEGRIMDSKALRKKIFYGGVDHVLRKEVWKFLLGFHEYDSTQAEREYLAAMKREEYEAIKSQWKSISTTQAKRFTKFRERKGLIDKDVVRTDRSVPYYEGDDNPNVVVLRDILLTYSFYNFDLGYCQGMSDFLSPILYVMEDESEAFWCFASLMERLGGNFNRDQNGMHAQLLGLSKLVELLDPSLHNYFRQNDCLNYFFCFRWVLIQFKREFSFDQVMLLWEVLWTHYFSEHFHLYLCVGILKGTACE

SEQ ID NO: 9690 - protein, 678 aa, Avena sativa
MGGEAAADAAEAAWHPRSPEPHDLSDDSDYAAAASVSASVHAAMRTDMGGLGSEESARMDVMYEKERVTIHPTQYGPGRISGKLRLYLQLGSLFLSWEPNEGVDSFSTSSITAEIEKYRNLYTIQALPLSDVRFIRRHTPTFGLEYIIIVLSSGLAFPPFYFYNGGIRELFATLKQHVFIIRSDDDPNVFLVNDFEDPLQKSLSSLELPGVASVANAMSRQNSLSFTGSVSETRHGDGGKHGGPSSMSAYGSKQKYKSNDPGREISFQVLEKFSLVTKFARETTSSLFRENHSSGSPAYGRQKQHVLDNRETEKYKDEQLTPDNASLPSNSAESDELLLVWGKKRGSPLSVEEWRAFLDPEGRIMDSKALRKKIFYGGVDHALRKEVWKFLLGYHEYDSTQAEREYLAAIKREEYEAIKSQWKSISATQAKRFTKFRERKGLIDKDVVRTDRSVPYYEGDDNRNVVVLRDILLTYSFYNFDLGYCQGMSDFLAPILYVMEDESESFWCFATLMERLGGNFNRDQNGMHAQLLGLSKLVELLDPSLHNYFRQNDCLNYFFCFRWVLIQFKREFSFDQIMLLWEVLWTHYMSEHFHLYLCVGILKRYRLRIIGEEMDFDTLLKFINELSGQINIDRAIQDAEALCTIAGDEGAACIPAGTPPSMPIETDGGLYLQEDDVL

SEQ ID NO: 9691 - protein, 678 aa, Avena sativa
MGGEAAADAAEAAWHPRSPEPHDLSDDSDYAAAASVSASVHAAMRTDMGGLGSEESARMDVMYEKERVTIHPTQYGPGRISGKLRLYLQLGSLFLSWEPNEGVDSFSTSSITAEIEKYRNLYTIQALPLSDVRFIRRHTPTFGLEYIIIVLSSGLAFPPFYFYNGGIRELFATLKQHVFIIRSDDDPNVFLVNDFEDPLQKSLSSLELPGVASVANAMSRQNSLSFTGSVSETRHGDGGKYGGPSSMSAYGSKQKYKSNDPGREISFQVLEKFSLVTKFARETTSSLFRENHSSGSPAYGRQKQHVLDNRETEKYKDEQLTPDNASLPSNSVESDELLLVWGKKRGSPLSVEEWRAFLDPEGRIMDSKALRKKIFYGGVDHALRKEVWKFLLGYHEYDSTQAEREYLAAIKREEYEAIKSQWKSISATQAKRFTKFRERKGLIDKDVVRTDRSVPYYEGDDNRNVVVLRDILLTYSFYNFDLGYCQGMSDFLAPILYVMEDESESFWCFATLMERLGGNFNRDQNGMHAQLLGLSKLVELLDPSLHNYFRQNDCLNYFFCFRWVLIQFKREFSFDQIMLLWEVLWTHYMSEHFHLYLCVGILKRYRLRIIGEEMDFDTLLKFINELSGQINIDRAIQDAEALCTIAGDEGAACIPAGTPPSMPIETDGGLYLQEDDVL

SEQ ID NO: 9692 - protein, 685 aa, Hordeum vulgare
MRGEAAAAAARADAAEARSPDPHDLSDDPDYADAASVPASIHAAMRTDMADIGSEEMARMDVVYEKERVTIHPTQYGSGRISGKLRLYLQLGSLFLSWEPNEGVNSFSTSSINAEIEKYRSLYTIQALPLSDVRFIRRHTPTFGLEYIIIVLSSGLAFPPFYFYNGGIRELFATLKQHVFIIRSDDDPSVFLVNDFEDPLQKSLSSLELPGVATVANAMSRQNSFSFTGSVSEVRHGDDAKYGGPSTMSEYGSKQRRKSNDPGRDISLQVLEKFSLVTKFARETTSSLFRENHNSGSNAYGRQKQEYVLDNRASDKYTDQLITPDDASLPSDSVESDELLLVWGKKRGSPLSVEEWRAFLDPEGRIMDSKALRKKIFYGGVDHVLRKEVWKFLLGYHEYDSTQAEREYLAAMKREEYEAIKSQWKSISTTQAKRFTKFRERKGLIDKDVVRTDRSVPYYEGDDNPNVVVLRDILVTYSFYNFDLGYCQGMSDFLAPILYVMEDESEAFWCFASLMERLGGNFNRDQNGMHAQLLGLSKLVELLDPSLHNYFRQNDCLNYFFCFRWVLIQFKREFSFDQIMLLWEVLWTHYFSEHFHLYLCVGILRRYRLRIIGEGMDFDTLLKFINELSGQINIDRAIQDAEALCTIAGERGADCIPPGTPPSMPIETDGGLYLQEDDVLYDFRH

SEQ ID NO: 9693 - protein, 628 aa, Sorghum bicolor
MRTDPADRGSEETARVDVVYEKERVTIHPSQYGSGRISGKLRLFLQQGSLFLSWGPNEGADSLSTSSVGVEIEKYRNLYTIKALPLSDVRFIRRYTPTFGLDYIIIVLSSGLAFPPFYFYNGGIRELFATLKQHVFIIRSDDDPNVFLVNDFQDPLQKSLSSLELPGVASVANAMSRQNSLSFTGSNDESRHGATSSMSQYSSKQKHKSNDPGRDLSIQVLEKFSLVTKFARDTTSSLFRDNSAAHAYGRQQHEYILDNKATDKHKNQYITPEKASTPSATIESDPLPLVWGKQRDRPLSVEEWTAFLDPEGRVMDSKALRKKVFYGGVDHALRKEVWKFLLGYHEYDSTYAEREYLAAMKRAEYEAVKSQWKSISATQAKRFTKFRERKGLIDKDVVRTDRSIPYYEGDDNQNVVVLRDILLTYSFYNFDLGYCQGMSDFLAPILYVMEDESESFWCFASLMERLGANFNRDQNGMHAQLLALSKLVELLDPPLHNYFRQNDCLNYFFCFRWVLIQFKREFSFDQIMLLWEVLWTHYLSEHFHLYLCVAILKKYRQRIIGEQMDFDTLLKFINELSGQINLDRAIQDAEALCTIAGENGASCIPPGTPPSMPIETDGGLYVQEDEVL

SEQ ID NO: 9694 - protein, 351 aa, Echinochloa colona
AMRTDSVGRGSDETARIDVVYEKDRVTIHPTQYGSGRISGKLRLFLQQGSLFLSWEPNEGSDSLSTSSVGLEIEKYRNLYTIKDLALSDVRFIRRHTPTFGYDYIIIVLSSGLAFPPFYFYTGGIRELFATLKQHVFIIRSDDDPNVFLVNDFQDPLQKSLSSLELPGVASVANAMARQNSLSFTGSVDEARLGAEGRHGETSSMSQYGSKQKHKSNDPGRDLSIQVLEKFSLVTKFARDTTSSLFRDNSGGHAYGRQQHEYVFDNEASDKHKNQYITPEKASIPSAPLSQIHYSGMGKQRDRPLSVEEWTAFLDPEGRVMDSKALRKKVFYGGADHVLRKEVWKFLLGVL

SEQ ID NO: 9695 - protein, 635 aa, Echinochloa colona
AMRTDSVARGSDETARIDVVYEKDRVTIHPTQYGSGRISGKLRLFLQQGSLFLSWEPNEGADSLSTSSVGLEIEKYRNLYTIKDLALSDVRFIRRHTPTFGYDYIIIVLSSGLAFPPFYFYTGGIRELFATLKQHVFIIRSDDDPNVFLVNDFQDPLQKSLSSLELPGVASVANAMARQNSLSFTGSVDEARLGAEDRHGEASSKSQYGSKQKHKSNDPGRDLSIQVLEKFSLVTKFARDTTSSLFRDNSGAHAYGQQQHEYVFDSKASDKHKDQYITPEKASIPSAPLESDPLPLVWGKQRDRPLSVEEWTAFLDPEGRVMDSKALRKKVFYGGADHVLRKEVWKFLLGYYEYDSTYAEREYLDAMKRAEYEAIKTQWKSISATQAKRFTKFRERKGLIDKDVVRTDRSVPYYEGDDNRNVVVLRDILLTYSFYNFDLGYCQGMSDFLAPILYVMEDESESFWCFASLMERLGANFNRDQNGMHAQLLALSKLVELLDPPLHNYFRQNDCLNYFFCFRWVLIQFKREFSFDQIMLLWEVLWTHYLSEHFHLYLCVAILKRYRQRIIGEQMDFDTLLKFINELSGQINLDRAIQDAEALCTIAGENGASCIPPGTPPSMPIETDGGLYMQEDEVL

SEQ ID NO: 9696 - protein, 649 aa, Avena sativa
AAAASVSASVHAAMRTDMGGLGSEESARMDVVYEKERVTIHPTQYGPGRISGKLRLYLQLGSLFLSWEPNEGVDSFSTSSITAEIEKYRNLYTIQALPLSDVRFIRRHTPTFGLEYIIIVLSSGLAFPPFYFYNGGIRELFATLKQHVFIIRSDDDPNVFLVNDFEDPLQKSLSSLELPGVASVANAMSRQNSLSFTGSVSETRHGDGGKYGGPSSMSAYGSKQKYKSNDPGREISFQVLEKFSLVTKFARETTSSLFRENHSSGSPAYGRQKQQHVLDNIASEKYKDQQLTPDNASSPSNSVESDELLLVWGKKRGSPLSVEEWRAFLDPEGRILDSKALRKKVFYGGVDHALRKEVWKFLLGYHEYDSTQAEREYLAAIKREEYEAIKSQWKSISATQAKRFTKFRERKGLIDKDVVRTDRSVPYYEGDDNRNVVVLRDILLTYSFYNFDLGYCQGMSDFLAPILYVMEDESESFWCFATLMERLGGNFNRDQNGMHAQLLGLSKLVELLDPSLHNYFRQNDCLNYFFCFRWVLIQFKREFSFDQIMLLWEVLWTHYMSEHFHLYLCVGILKRYRLRIIGEEMDFDTLLKFINELSGQINIDRAIQDAEALCTIAGDEGAACIPAGTPPSMPIETDGGLYLQEDDVL

SEQ ID NO: 9697 - protein, 628 aa, Triticum aestivum
GSEETARMDVVYEKERVTIHPTQYGSGRISGKLRLYLQLGSLFLSWEPNEGVNSFSTSSVSAEIEKYRNLYTIQALPLSDVRFIRRHTPTFGLEYIIIVLSSGLAFPPFYFYNGGIRELFATLKQHVFIIRSDDDPNVFLVNDFEDPLQKSLSSLELPGVATVANAMSRQNSFSFTGSVSEVRHGDDAKYGGPSTMSEYVSKQRRKSNDPGRDISFQVLEKFSLVTKFARETTSSLFRENHSSGSHAYGRQKQEYVLDNKASDKYADQLITPDDASLSSDSVESDELLLVWGKKRGNPLSVEEWRSFLDPEGRIMDSKALRKKIFYGGVDHVLRKEVWKFLLGYHEYDSTQAEREYLAAMKREEYEAIKSQWKSISTTQAKRFTKFRERKGLIDKDVVRTDRSVPYYEGDDNPNVVVLRDILVTYSFYNFDLGYCQGMSDFLAPILYVMEDESEAFWCFASLMERLGGNFNRDQNGMHAQLLGLSKLVELLDPSLHNYFRQNDCLNYFFCFRWVLIQFKREFSFDQIMLLWEVLWTHYFSEHFHLYLCVGILKRYRLRIIGEGMDFDTLLKFINELSGQINIDRAIQDAEALCSIAGEAGADCIPPGTPPSMPIETDGGLYVQENDVL

SEQ ID NO: 9698 - protein, 634 aa, Pennisetum glaucum
MRTDLVDRGSDETVRIDVVYEKERVTIHPTQYGSGRISGKLRLFLQQGSLFLSWEPNEGADSLSTSSFGVEIEKYRNLYTIKALPLSDVRFIRRHTSTFAYDYIIIVLSSGLAFPPFYFYNGGIRELFATLKQHVFIIRSDDDPNVFLVNDFQDPLQKSLSSLELSGVASVANAMSRQNSLSFTGATDEPRHGTDGRHGEASSVSQYGSKQKTKSNDPGRDLSIQVLEKFSLVTKFARDTTSSLFQNNSGAHGYGRQQYEYLLDNKASEKQKNQYITPEKASMPSAPPEPDPLPLVWGKQRDHPLSAEEWTAFLDPEGRVMDSKALRKKVFYGGVDHVLRKKVWKFLLGYHEYDSTYAEREYHAAMKRAEYEAIKSQWKSITATQAKRFTKFRERKGLIDKDVVRTDRSVPYYEGDDNQNVVVLRDILLTYSFYNFDLGYCQGMSDFLAPILYVMGDESESFWCFASLMERLGANFNRDQNGMHAQLLALSKLVELLDPPLHNYFRQNDCLNYFFCFRWVLIQFKREFSFDQIMLLWEVLWTHYLSEHFHLYLCVAILKRYRQRIIGEQMDFDTLLKFINELSGQINLDRAIQDAEALCTIAGENGASCIPPGTPPSMPIETDSGLYVQEDDVL

SEQ ID NO: 9699 - protein, 610 aa, Oryza sativa
MDKGALVVQVMDDSSNGGVGAAAAGGSFSSLRAYGRALAQTPRRLARRACAATSPGEEMSRVRARSGARMARRLRWHDLVGLGLGGMVGAGVFVTTGRATRLYAGPGVVVSYAIAGLCALLSAFCYTEFAVDMPVAGGAFSYLRVTFGELAAFLTGANLIMEYVFSNAAVARSFTAYLGTAVGVDAPSKWRIAVPGLPKGFNEVDLIAVGVILLISVCICYSTKESSVVNMVLTAVHVAFILFIIVMGFWRGDTRNLTRPVDLAHNPGGFFPHGAAGVFNGAAMVYLSYIGYDAVSTMAEEVERPSRDIPVGVSGSVVLVTLLYCLMAASMSMLLPYDAIDTEAPFSGAFKGSSGWGWVSNVIGAGASLGILTSLMVAMLGQARYLCVIGRSGVMPAWLAKVHPCTATPVNASAFLGVFTAALALFTELDVLLNLVSIGTLFVFYMVANAVVYRRYVAADDDDADHRRAWPTLVFLAAFSLVALCFTLLWQFAPAGRARTGLLAACGAAAVATVGAFRALVAEARRPELWGVPAMPWVPAASVFLNVFLLGSLDRPSYVRFGFFTAAAVLVYVLYSVHASYDAEEGGGAGAGAAALDGAKVQDEAADFKV

SEQ ID NO: 9700 - protein, 599 aa, Triticum aestivum
MDKGALMTPDSDQGGPDGGSFSSLRSYGRALSQTPRRLARRACAATAPGEEMSRVRARSGAPMARALRWPDLVGLGLGGMVGAGVFVTTGRATRLHAGPGVVVSYAIAGLCALLSAFCYTEFAVDMPVAGGAFSYLRVTFGEFAAFLTGANLIMEYVFSNAAVARSFTAYMGTAVGVDAPSKWRIAVPGLPNGFNQVDLVAVGVILLISVCICYSTKESSKVNMVLTAVHVAFILFIIVMGFWRGDARNLTHPADPAHPGGFFPNGVGGVFSGAAMVYLSYIGYDAVSTMAEEVERPARDIPIGVSGSVIIVTVLYCLMAASMSMLLPYDAIDTEAPFSGAFRGSDGWGWVSNVIGAGASLGILTSLMVAMLGQARYLCVIGRSGVMPAWLAKVHPKTATPVNASAFLGLLTAALALFTELDILLNLVCIGTLFVFYMVSNAVVYRRYVVGPTGSGTESGDRQPSAWPTLAFLLAFSLIALSFTLVWKLAPEGGRTRVGLLSACGAAAVAMVGAFQALVPQAHTPELWGVPGMPWVPAASVFLNVFLLGSLDRPSYVRFGFFSAAAVLVYVLYSVHASYDAEESATLDGAKVQDEACRV

SEQ ID NO: 9701 - protein, 599 aa, Setaria italica
MDKGALASSASDQGALTAAAGGGSFASLRAYGRALAQTPRRLARRACAATAPGEEMSRVRARSGPRMARALRWWDLVGLGLGGMVGAGVFVTTGRATRLYAGPGVVVSYAIAGLCALLSAFCYTEFAVDMPVAGGAFSYLRVTFGEFAAFLTGANLIMEYVFSNAAVARSFTAYLGTAVGVDAPSKWRIPVPGLPEGFNQVDLVAVGVILLITVCICYSTKESSVVNMVLTAVHVAFILFIIVIGFVHGDARNLTRPADPSRNPGGFFPHGAMGVFNGAAMVYLSYIGYDAVSTMAEEVERPARDIPIGVSGSVVVVTVLYCLMAASMSMLLPYDAIDPEAPFSGPFRGRKGMAWVSNVIGAGASLGILTSLMVAMLGQARYLCVIGRSGVMPAWLARVNPRTATPVNASAFLGLFTAALALFTELDILLNLVCIGTLFVFYMVANAVVYRRYVGDAELGRTRRAWPTLAFLAAFSLLALAFALVWKLAPPERGVRTGLLAACAALAVATVAAFQALVPQAHAPELWGVPGMPWVPAASVFLNVFLLGSLDRPSYVRFGFFSVAALLVYVLYSVHASYDAEESGLDGGGAKVQDEACTV

SEQ ID NO: 9702 - protein, 590 aa, Panicum virgatum
MDKGALPPSGTDHGAGGSFASLRAYGRALAQTPRRVAQRACAATAPGEEMSRVRARSGAHMARALRWWDLVGLGLGGMVGAGVFVTTGRATRLYAGPGVVVSYAIAGLCALLSAFCYTEFAVDMPVAGGAFSYLRVTFGEFAAFLTGANLIMEYVFSNAAVARSFTAYLGTAVGVDAPSKWRIPVPGLPEGFNQVDLVAVGVILLISVCICYSTKESSLVNMVLTAVHVAFILFIIVIGFVHGDARNLTRPADPSQNPGGFFPHGAMGVFNGAAMVYLSYIGYDAVSTMAEEVERPARDIPIGVSGSVVVVTVLYCLMAASMSMLLPYDAIDPEAPFSGAFKGKAGMAWVSNVIGAGASLGILTSLMVAMLGQARYLCVIGRSGVMPAWLARVNPRTATPVNASAFLGLFTAALALFTELDILLNLVCIGTLFVFYMVANAVVYRRYAGALLGRSAWPTLAFLGTFSLVALSFTLVWKLAPPERGVRAGLLAACAAVAVATVAAFQALVPQAHAPELWGVPGMPWVPAASVFLNVFLLGSLDRPSYVRFGFFSAAAVLVYVLYSVHASYDAEESGLDDGGAKVQDEACTV

SEQ ID NO: 9703 - protein, 603 aa, Hordeum vulgare
MDKGALMTPESDQSGRDVGGSFSSLRSYGRALSQTPRRLARRACAATAPEEEMSRVRARSGAPMARALRWPDLVGLGLGGMVGAGVFVTTGRATRLYAGPGVVVSYAIAGLCALLSAFCYTEFAVDMPVAGGAFSYLRVTFGEFAAFLTGANLIMEYVFSNAAVARSFTAYMGTAVGVDAPSKWRIAVPGLPNGFNEVDLVAVGVILLISVCICYSTKESSKVNMVLTAVHVAFILFIIVMGFWRGDVRNLTHPADPAHPGGFFPNGVGGVFSGAAMVYLSYIGYDAVSTMAEEVERPARDIPIGVSGSVVIVTVLYCLMAASMSMLLPYDAIDKEAPFSGAFRGSDGWGWVSNVIGAGASLGILTSLMVAMLGQARYLCVIGRSGVMPAWLAKVHPKTATPVNASAFLGLLTAALALFTELDILLNLVCIGTLFVFYMVSNAVVYRRYVVGPTGSSTATSEARDRQPGAWPTLAFLLAFSLIALSFTLVWKLAPEGGRTRVGLLSACGAAAVATVGAFQALVPQVHTPELWGVPGMPWVPAASVFLNVFLLGSLDRPSYVRFGFFSAAAVLVYVLYSVHASYDAEESSTLDGAKVQDEACRV

SEQ ID NO: 9704 - protein, 592 aa, Setaria italica
MDKAALVADSDGAATAGGSFASLRAYGRALAQTPRRLARRACAASAPGEEMSRVRARSGPRMARALRWWDLVGLGLGGMVGAGVFVTTGRATRLYAGPGVVVSYAIAGLCALLSAFCYTEFAVDMPVAGGAFSYLRVTFGELAAFLTGANLIMEYVFSNAAVARSLTAYLGTAVGVDAPSKWRIAVPGLPEGFNQVDLIAVGVILLISVCICYSTKESSVVNLVLTGVHVAFILFVIVMGFKHGDKRNLTHPADPSRNPGGFFPHGAAGVFNGAAAVYLSYIGYDAVSTMAEEVERPARDIPAGVSGSVVVVTALYCLMAASMSMLLPYDAIDPEAPFSGAFKRMKGKAWVSNVIGAGASLGILTSLMVAMLGQARYLCVIGRSGVMPAWLARVHPRTATPVNASAFLGLFTAALALFTELDVLLNLVSIGTLFVFYMVANAVVYRRYVGDSDNSDSSRRAWPALAFLGAFSLIALSFTLLWQFVPAGGARAGLLAACAAAAVAAVAAFHALVPQARAPELWGVPGMPWVPAASVFLNVFLLGSLDRPSYVRFGFFSAAAVLVYVLYSVHASHDAEEGGGGGAKVLDEGCKV

SEQ ID NO: 9705 - protein, 607 aa, Brachypodium distachyon
MDKGALMSSSPAPATDSSTTGGSFSSLRAYGRALTQTPRRVALRACAATTPGEEMSRVRARSGAPMARALRWPDLVGLGLGGMVGAGVFVTTGRATRLYAGPGVVVSYAIAGLCALLSAFCYTEFAVDMPVAGGAFSYLRVTFGEFAAFLTGANLIMEYVFSNAAVARSFTAYLGTAVGVDAPSKWRIAVPGLPEGFNQVDLVAVGVILLISVCICYSTKDSSMVNMVLTAVHVVFILFIIVMGFWRGDARNLTRPSDPAHPGGFFPNGVGGVFSGAAMVYLSYIGYDAVSTMAEEVEKPARDIPIGVSGSVVIVTVLYCLMAASMSMLLPYDAIDTEAPFSGAFRGSEGWGWVSNVIGAGASLGILTSLMVAMLGQARYMCVIGRSGVMPAWLAKVHPNTATPVNASAFLGLFTAALALFTELDILLNLVCIGTLFVFYMVSNAVVYRRYVLAASSSSSIPNGGSDRRGASAWPTLAFLLAFSLLAIAFTLSWKLAPEGRARIALLACIGIAAVATVGAFQLLVPQAHTPQLWGVPGMPWVPAASVFLNVFLLGSLDRPSYVRFAFFSAATVLVYALYSVHASFDAEETGSGDDGGAKVQDEDCKV

SEQ ID NO: 9706 - protein, 541 aa, Panicum virgatum
MSRVRARSGAHMARALRWWDLVGLGLGGMVGAGVFVTTGRATRLYAGPGVVVSYAIAGLCALLSAFCYTEFAVDMPVAGGAFSYLRVTFGEFAAFLTGANLIMEYVFSNAAVARSFTAYLGTAVGVDAPSKWRIPVPGLPEGFNQVDLVAVGVILLISVCICYSTKESSLVNMVLTAVHVAFILFIIVIGFVHGDARNLTHPADPSQNPGGFFPHGAMGVFNGAAMVYLSYIGYDAVSTMAEEVERPARDIPIGVSGSVVVVTVLYCLMAASMSMLLPYDAIDPEAPFSGAFRGRKGMAWVSNVIGAGASLGILTSLMVAMLGQARYLCVIGRSGVMPAWLARVNPRTATPVNASAFLGLFTAALALFTELDILLNLVCIGTLFVFYMVANAVVYRRYVGAGEFGRAWPTLAFLAALSLVALSFTLVWKLAPAERGVRTGLLAACAALAVATVAAFQALVPQAHAPELWGVPGMPWVPAASVFLNVFLLGSLDRPSYVRFGFFSAAALLVYVLYSVHASYDAEESGLDGAGAKVQDEACTV

SEQ ID NO: 9707 - protein, 599 aa, Zea mays
MDKAALVAENSTDAGGSSSSFSGLRAYGRALAQTPRRLARRACAATAPREEMSRVRARSGADMARALRWWDLVGLGLGGMVGAGVFVTTGRAARLYAGPGVVASYAIAGLCALLSAFCYTEFAVDMPVAGGAFSYLRVTFGELAAFLTGANLIMEYVFSNAAVARSFTAYLGTAVGVDAPSKWRIPVPGLPQGFNQVDLVAVGVILLLSVCICYSTKESSVVNLVLTGVHVVFILFIIVMGFAHGDARNLSRPADPAHSPGGFFPHGAAGVFNGAAAVYLSYIGYDAVSTMAEEVERPDRDIPAGVSGSVVLVTVLYCLMATSMSMLLPYDAIDPEAPFSGAFKGRDGMAWVSNVIGAGASLGILTSLMVAMLGQARYLCVIGRSGVVPAWLARVDPRTATPINASAFLGLLTAALALFTELDVLLNLVSIGTLFVFYMVANAVVYRRYVGDPCPGSGQKRRAWPALAFIAAFSLIAISFTLLWQFAPGGAAKVGLLSGTAAVAVAAVVAFQALVPQAREPELWGVPGMPWVPAASVFLNVFLLGSLDRPSYVRFGFFSAFAVLFYVFYSVHASYDAEEGGAVDGGGGGDKLQDQGCDV

SEQ ID NO: 9708 - protein, 608 aa, Sorghum bicolor
MDKAALVSESTDDVGPAGGGSSSSFSGLRAYGRALAQTPRRLARRACAATAPHEEMSRVRARSGTRMARALRWWDLVGLGLGGMVGAGVFVTTGRAARLYAGPGLVVSYAIAGLCALLSAFCYTEFAVDMPVAGGAFSYLRVTFGEFAAFLTGANLIMEYVFSNAAVARSFTAYLGTAVGVDAPSKWRIPVPGLPEGFNQVDLVAVGVILLLSVCICYSTKESSVVNLVLTGVHVAFILFIIVMGFVHGDARNLSRPADPVHNPGGFFPHGAAGVFNGAAAVYLSYIGYDAVSTMAEEVERPDRDIPAGVSGSVVLVTALYCLMAASMSMLLPYDAIDPEAPFSGAFKGRDGMAWVSNVIGAGASLGILTSLMVAMLGQARYLCVIGRSGVVPAWLARVDRRTATPVNASAFLGLLTAALALFTELDVLLNLVSIGTLFVFYMVANAVVYRRYVGDPCPAGTGTAHETRAWPTLAFIGAFSLIALSFTLLWQFAPGGAAKAVMLSATAAAAVAVVAAFQALVPQAREPEVWGVPGMPWVPAASVFLNVFLLGSLDRPSYARFGFFSAAVVLVYVLYSVHASYDAEEGGAAADGGAGAGDKLQDHGCEV

SEQ ID NO: 9709 - protein, 603 aa, Secale cereale
MDKGALMTPGSDQSGPDGGTGVGSFSSLRSYGRALSQTPRRLARRACAATAPEEEMSRVRARSGAPMSRALRWPDLVGLGLGGMVGAGVFVTTGRATRLHAGPGVVVSYAIAGLCALLSAFCYTEFAVDMPVAGGAFSYLRVTFGEFAAFLTGANLIMEYVFSNAAVARSFTAYMGTAVGVDAPSKWRIAVPGLPNGFNQVDLVAVGVILLISVCICYSTKESSKVNMVLTAVHVAFILFIIVMGFWRGDVGNLTHPADPAHPGGFFPNGVGGVFSGAAMVYLSYIGYDAVSTMAGGGGAAGARHPHRRLGVRHHRHRALLPHGRSMSMLLPYDAIDTEAPFSGAFRGSDGWGWVSNVIGAGASLGILTSLMVAMLGQARYLCVIGRSGVMPAWLAKVHPKTATPVNASAFLGLLTAALALFTELDILLNLVCIGTLFVFYMVSNAVVYRRYVVGPTGSSTESGDRQPSAWPTLAFLLAFSLIALSFTLVWKLAPEGGRTRVGLLSACGAAAVATVGAFQALVPQAHTPELWGVPGMPWVPAASVFLNVFLLGSLDRPSYVRFGFFSAAAVLVYVLYSVHASYDAEESATLDGAKVQDEACRV

SEQ ID NO: 9710 - protein, 615 aa, Sorghum bicolor
MDNKCLALASSDAVHHHPAGVTANAAIGGTGTSSSSSSSFASWRAYGRALAQTPRRLSRRAFAATAAGEEMSRVRARSGADMARALRWWDLVGLGLGGMVGAGVFVTTGRAARLHAGPGVVVSYAIAGLCALLSAFCYTEFAVDLPVAGGAFSYLRVTFGELAAFLTGANLIMEYVFSNAAVARSFTAYLGTAVGVDAPSQWRITVHGLPDGFNQVDLLAVAVILLITVCICYSTKESSVVNMVLTAVHVAFILFIIGMGFRHGDARNLTRPADPSRSPGGFFPHGAVGVFNGAAMVYLSYIGYDAVSTMAEEVQRPARDIPVGVSGSVVVVTVLYCLMAASMSMLLPYDAIDPEAPFSGAFKGRERCAWVSNVIGAGASLGILTSLMVAMLGQARYLCVIGRSGVMPAWLARVNPRTATPVNASAFLGVFTAALALFTELDILLNLVCIGTLFVFYMVANAVVYRRYVGGGGARWPTLAFLLVFSLSALAFTLAWKLAPPERRGVRAGLLAACAALAVTAVAAFQALVPQARVPELWGVPGMPWVPAASVFLNVFLLGSLDRPSYVRFAIFSAAALLVYVLYSVHASYDAEESGRLDVDGGGGGKVQDEACTVV

SEQ ID NO: 9711 - protein, 312 aa, Panicum virgatum
MNNLFSSSWKRVGGGGGDGDIESGGVELSAPPGAAAGASLDKFFEDVESIKDELRDLERIQRSLHDANEGGKSLHDAAAVRELRSRMDADVAAAIKKAKVVKLRLESLDRANAANRSVPGCGPGSSTDRTRTSVVAGLRKKLRDSMEAFSSLRSRIASEYRDTVARRYFTVTGSQPDEATLDALAESGEGERFLQRAIAEQGRGEVLGVVAEIQERHGAVAELERSLRELQQVFNDMAVLVAAQGEQLDDIEGNVGRARSFVDRGREQLQVARKHQRSTRKWTCIGILILLVIILVIVLPIVLKTVNNNKSN

SEQ ID NO: 9712 - protein, 335 aa, Sorghum bicolor
MGRTMTRMMTRRMRMAMQVHLRVLFWCFLATCSCSRPRSTNDLARPTFPSMSSSCSPCAATSTAMSLNTCCSSSRDRSSSATAPCRSWISATTPSTCPLPCSAMARCRNRSPSPDSASASSVASSGCVPVTVKYRRATVSLYSDATRDRSDEKDSIESRSFLRSPATTEVRVRSVEEPGPHPGTERLAALARSSDSRRSFTTFAFLIAAETSASIRARRSRTADASWRDLPASLPSWSERWIRSRSRSSSLIDSTSSKNRSRLAPAAAPGGADISTLPDSMSPSSPPPRFHELENKLFMAAGFAVSPRLGDQLDRWRPLLCITWLIGFLTDQGRF

SEQ ID NO: 9713 - protein, 308 aa, Panicum virgatum
MNNLFSSSWKRGGGGDGDIESGGVELSAPPGAAAGASLDKFFEDVESIKDELRGLERIQRSLHDANEGGKSLHDAAAVRELRSRMDADVAAAIKKAKVVKLRLESLDRANAANRSVPGCGPGSSTDRTRTSVVAGLRKKLRDSMEAFSSLRSRIAAEYRDTVARRYFTVTGAQPDEATLDALAESGEGERILQRAVAEQGRGEVLGVVAEIQERHGAVAELERSLRELQQVFNDMAVLVAAQGEQLDDIEGNVGRARSFVDRGREQLQVARKHQRSTRKWTCIAILILLVIVLVIVLPIVLKNVNKSN

SEQ ID NO: 9714 - protein, 306 aa, Zea mays
MNSLFSSSWKRDGGDIESGGVEMSAPPGAAAGASLDRFFEDVESIKDELRDLERIQRSLHDANEGGKSMHDAAAVRGLRARMDADVAAAIKKAKVVKLRLESLDRANAANRSVPGCGPGSSTDRTRTSVVAGLRKKLRDSMESFSSLRSRVAAEYRDTVARRYFTVTGAQPDEATLDALAESGEGERFLQRAIAEQGQGRGEVLGVVAEIQERHGAVAGLERSLLELQQVFNDMAVLVAAQGEQLDDIEGNVGRARSFVDRGREQLQVARKHQKSTRKWTCIAILILLVIILVIVLPIVLKGVNKN

SEQ ID NO: 9715 - protein, 307 aa, Sorghum bicolor
MNSLFSSSWKRGGGDDGDIESGSVEMSAPPGAAAGASLDRFFEDVESIKDELRDLERIQRSLHDGNEAGKSLHDASAVRDLRARMDADVSAAIKKAKVVKLRLESLDRANAANRSVPGCGPGSSTDRTRTSVVAGLRKKLRDSMESFSSLRSRVASEYRDTVARRYFTVTGTQPDEATLDALAESGEGERFLQRAIAEQGRGQVLGVVAEIQERHGAVAELERSLLELQQVFNDMAVLVAAQGEQLDDIEGNVGRARSFVDRGREQLQVARKHQKSTRKWTCIAILILLVIILVIVLPIVLQNTKKN

SEQ ID NO: 9716 - protein, 320 aa, Secale cereale
MNNLFSSSWKRAGAGGGDGDLESGGGGGVEMTAPPGAAAGASLDRFFEDVESIKDDLRELERIQRSLHDGNESGKSLHDASAVRALRSRMDADVAAAIKKAKVVKLRLESLDRANAANRSVAGCGPGSSTDRTRTSVVAGLRKKLRDAMESFSSLRSRITSEYRDTVARRYFTVTGSQPDEATLDTLAETGEGERFLQRAIAEQQGRGEVQGVVAEIQERHGAVADLERSLLELQQVFNDMAVLVAAQGEQLDDIEGHVGRARSFVDRGREQLQVARKHQKSSRKWTCIGIGILLVVILIIVIPIVLKNTNKSNNNNGQQ

SEQ ID NO: 9717 - protein, 318 aa, Hordeum vulgare
MNNLFSSSWKRAGAGGDGDLESGGGGVEMTAPPGAAAGASLDRFFEDVESIKDDLRELERIQRSLHDGNESGKSLHDASAVRALRSRMDADVAAAIKKAKVVKLRLESLDRANAANRSVAGCGPGSSTDRTRTSVVAGLRKKLRDAMESFSSLRSRITSEYRETVARRYFTVTGSQPDEATLDTLAETGEGERLLQRAIAEQQGRGEVLGVVAEIQERHGAVADLERSLLELQQVFNDMAVLVAAQGEQLDDIEGHVGRARSFVDRGREQLQVARKHQKSSRKWTFIGIGILLVVILIIVIPIVLKNTNKSNNNNSQQ

SEQ ID NO: 9718 - protein, 321 aa, Triticum aestivum
MNNLFSSSWKRAGAGGDGGDLESGGGGGGVEMTAPPGAAAGASLDRFFEDVESIKDDLRELERIQRSLHDGNESGKSLHDASAVRALRSRMDADVAAAIKKAKVVKLRLESLDRANAANRSVAGCGPGSSTDRTRTSVVAGLRKKLRDAMESFSSLRSRITSEYRDTVARRYFTVTGAQPDEATLDTLAETGEGERFLQRAIAEQQGRGEVLGVVAEIQERHGAVADLERSLLELQQVFNDMAVLVAAQGEQLDDIEGHVGRARSFVDRGREQLQVARKHQKSSRKWTCIGIGILLVVILIIVIPIVLKNTNKSNNNNNQQ

SEQ ID NO: 9719 - protein, 318 aa, Brachypodium distachyon
MNNLFSSSWKRAGDGDLESGGVEMSAPPGAAAGASLDKFFEDVESIKDDLRDLDRIQRSLHDGNESGKSLHDASAVRALRARMDADAAAAIKKAKVVKLRLESLDRANAANRSVPGCGPGTSTDRTRTSVVAGLRKKLRDSMESFSALRARVSSEYRDTVARRYFTVTGAQPDEATLDTLAETGEGERFLQRAIAEQGQGRGEVMGVVAEIQERHGAVADLERSLLELHQVFNDMAVLVAAQGEQLDDIEGHVGRARSFVDRGREQLQVARKHQKSSRKWKFIAIGILLVIILVIVIPIVLKNTKNSSSSNNSNQPQQ

SEQ ID NO: 9720 - protein, 309 aa, Setaria italica
MNSLFSSSWKRGGGGDGGDIESGADGVEMSAPPGAAAGASLDKFFEDVESIKDELRDLERIQRSLHEANEGSKSLHDAAAVRELRSRMDGDVASAIKKAKVVKLRLESLDRANAANRSVPGCGPGSSTDRTRTSVVAGLRKKLRDSMEAFSSLRSRIAAEYRDTVARRYFTVTGSQPDEATLDALAESGEGERFLQRAIAEQGRGEVLGVVAEIQERHGAVAELERSLLELQQVFNDMAVLVAAQGEQLDDIEGNVGRARSFVDRGREQLQVARKHQKSTRKWTFIAILIVLVIVLVIVLPIVLNNTKK

SEQ ID NO: 9721 - protein, 403 aa, Avena sativa
MNNLFSSSWKRASEDIESGGGGVEMSAPPGAAAGASLDRFFEDVESIKDELRDLERLQRSLHDGNEAGKSLHDASAVRALRSRMDADASGAIKKAKVVKLRLESLDRANAANRSLPGCGPGTSTDRTRTSVVAGLRKKLRDSMESFSSLRERISSEYRDTVARRYFTVTGAQPDEATLDTLAETGEGERFLQRAIAEQQGRGEVLGVVAEIQERHGAVAQLERSLLELQQVFNDMAVLVEAQGEQLNDIEGNVGRARSFVDRGREQLQVARKHQKSSRKWMCIGIAVLLVVILVIVVPIVVKNSQSNSSSTTAAPPAPSPLRSRPPRREQQSIIVKEATMADEHQELTKAFSGLGGLGVEETALVSALGRWRKQPEKRSQFRQGFPGFFTPAGTMERCSDEYV

SEQ ID NO: 9722 - protein, 302 aa, Setaria italica
MNSLFSSSWKRGGGGDGGDIESGADGVEMSAPPGAAAGASLDKFFEDVESIKDELRDLERIQRSLHEANEGSKSLHDAAAVRELRSRMDGDVASAIKKAKVVKLRLESLDRANAANRSVPGCGPGSSTDRTRTSVVAGLRKKLRDSMEAFSSLRSRIAAEYRDTVARRYFTVTGSQPDEATLDALAESGEGERFLQRAIAEQGRGEVLGVVAEIQERHGAVAELERSLLELQQVFNDMAVLVAAQGEQLDDIEGNVGRARSFVDRGREQLQVARKHQKSTRKWTFIAILIVLVIVLVIVLPI

SEQ ID NO: 9723 - protein, 543 aa, Sorghum bicolor
MGIAAAAATTTTSRLLHYHAAAGTDRHHRHQLRYSASPFPLSLRCGSGRREAAAARALLPDRVTPFSYGVDEDADDHPREECGLVGVVGDPDAASLCYLGLQKLQHRGEEGAGIVAVGGDGKLKSVTGLGLVADVFGDPSRLASLPGPAAIGHVRYSTAGAAASLRNVQPFLAGYRFGQVAVAHNGNLVNYQALRNKLEARGSIFNTSSDTEVILHLIATSLSRPLLARVCDACERLAGAYSLLFLTADKLFAVRDPHGFRPLVMGRRRNGAVVFASETCALDLIDATYEREVQPGEVVVVDRRDMSVASACLVPHRPRRSCVFEHIYFALPNSVVFSHAVHERRTAFGQALAEESPAPGADVVIPVPDSGFYAALGFARASGLEFQQGLIRWHYSGRSFIQPTQAIRDLAVKLKLAPVRGVITGKSVVVVDDSLVRGTTSSKIVRLLRDAGAREVHMRIASPPVVGSCLYGIDTPSEGELISNRMDLDGVRREIGSDSLAFLSLDKLHSIYGEESGDYCDACFSRKYPVLPTLADPAVEPDE

SEQ ID NO: 9724 - protein, 543 aa, Zea mays
MGIVAAAAATTCTSRILYRYAAAGSDRHNRHHLRYYASPYPLSLRCGSGRREAAARALLPDRVTPFSYGVDEDADDHPREECGVIGVVGDPDASSLCYLGLQKLQHRGEEGAGIVAVGGDGKLKSVTGLGLVADVFADPSRLASLPGPAAIGHVRYSTAGAAASLRNVQPFLAGYRFGQVAVAHNGNLVNYQALRNKLEARGSIFNTSSDTEVILHLIATSLSRPLLARVCDACERLAGAYSLLFLTADKLFAVRDPHGFRPLVMGRRRNGAVVFASETCALDLIDATYEREVEPGEVVVVDRRDMSVASACLVPHRPRRACVFEHIYFSLPNSVVFSHAVHERRTAFGQALAEESPAPGADVVIPVPDSGFYAALGFARASGLEFQQGLIRWHYSGRSFIQPTQAIRDLAVKLKLAPVRGVITGKSVVVVDDSLVRGTTSSKIVRLLRDAGAREVHMRIASPPVVGSCLYGIDTPSEGELISNRMDLDGVRREIGSDSLAFLSLDKLHSIYGEESGNYCDACFSRKYPVLPTLADPAAEPED

SEQ ID NO: 9725 - protein, 545 aa, Setaria italica
MGMVAAAAAAASTSRLLLLHHRAAAGSDRHHQHQLRYAAIQYPLSLRCGSGRRGAAAGALLPDRVTPFSYGVDEDADDHPREECGLVGVVGDPDASSLCYLGLQKLQHRGEEGAGIVAVGGDGKLKSVTGLGLVADVFGDPSRLASLPGPAAIGHVRYSTAGAAASLRNVQPFLAGYRFGQVAVAHNGNLVNYQALRNKLEARGSIFNTSSDTEVILHLIATSLSRPLLARVCDACERLAGAYSLLFLTADKMFAVRDPHGFRPLVMGRRRNGAVVFASETCALDLIDATYEREVQPGEVVVVDRRDMSVASACLVPQRPRRACVFEHIYFSLPNSVVFSHAVHERRTAFGRALAEESPAPGADVVIPVPDSGFYAALGFARASGLEFQQGLIRWHYSGRSFIQPTQAIRDLAVKLKLAPVRGVIAGKSVVVVDDSLVRGTTSSKIVRLLRDAGAREVHMRIASPPVVGSCLYGIDTPSEGELISNRMDLEGVRREIGSDSLAFLSLGKLHGIYGEEAGDYCDACFSRKYPVLPTLADPAAELEE

SEQ ID NO: 9726 - protein, 543 aa, Panicum virgatum
MGITAAAAAPSPSRLLLHHHAAVGSDRRHQHQLRYPATQHALPLRCGSGRREAAAGALLPDRVTPFSYGVDEDADDHPREECGLVGVAGDPDASSLCYLGLQKLQHRGEEGAGIVAVGGDGKLKSVTGLGLVADVFGDPSRLASLPGPAAIGHVRYSTAGAAASLRNVQPFLAGYRFGQVAVAHNGNLVNYQALRNKLEARGSIFNTSSDTEVILHLIATSLSRPLLARVCDACERLAGAYSLLFLTADKMFAVRDPHGFRPLVMGRRRNGAVVFASETCALDLIDATYEREVQPGEVVVVDRRDMSVASACLVPHRPRRACVFEHIYFSLPNSVVFSHAVHERRTAFGRALAEESPAPGADVVIPVPDSGFYAALGFARASGLEFQQGLIRWHYSGRSFIQPTQAIRDLAVKLKLAPVRGVIAGKSVVVVDDSLVRGTTSSKIVRLLRDAGAREVHMRIASPPVVGSCLYGIDTPSEGELISNRMDLEGVRREIGSDSLAFLSLGKLHGIYGDEAGDYCDACFSRKYPVLPTLADPATEPEE

SEQ ID NO: 9727 - protein, 543 aa, Setaria italica
MVAAAAAAASTSRLLLLHHRAAAGSDRHHQHQLRYAAIQYPLSLRCGSGRRGAAAGALLPDRVTPFSYGVDEDADDHPREECGLVGVVGDPDASSLCYLGLQKLQHRGEEGAGIVAVGGDGKLKSVTGLGLVADVFGDPSRLASLPGPAAIGHVRYSTAGAAASLRNVQPFLAGYRFGQVAVAHNGNLVNYQALRNKLEARGSIFNTSSDTEVILHLIATSLSRPLLARVCDACERLAGAYSLLFLTADKMFAVRDPHGFRPLVMGRRRNGAVVFASETCALDLIDATYEREVQPGEVVVVDRRDMSVASACLVPQRPRRACVFEHIYFSLPNSVVFSHAVHERRTAFGRALAEESPAPGADVVIPVPDSGFYAALGFARASGLEFQQGLIRWHYSGRSFIQPTQAIRDLAVKLKLAPVRGVIAGKSVVVVDDSLVRGTTSSKIVRLLRDAGAREVHMRIASPPVVGSCLYGIDTPSEGELISNRMDLEGVRREIGSDSLAFLSLGKLHGIYGEEAGDYCDACFSRKYPVLPTLADPAAELEE

SEQ ID NO: 9728 - protein, 518 aa, Panicum virgatum
DRRHQHQLRYSATQYALSLRCGSGRRAAAAGALLPDRVTPFSYGVDEDADDHPHEECGLVGVAGDPDASSLCYLGLQKLQHRGEEGAGIVAVGGDGKLKSVTGLGLVADAFGDPSRLASLPGPAAIGHVRYSTAGAAASLRNVQPFLAGYRLGQVAVAHNGNLVNYQALRNKLEARGSIFNTSSDTEVILHLIATSLSRPLLARVCDACERLAGAYSLLFLTADKMFAVRDPHGFRPLVMGRRRNGAVVFASETCALDLIDATYEREVQPGEVVVVDRRDMSVASACLVPHRPRRACVFEHIYFSLPNSVVFSHAVHERRTAFGRTLAEESPAPGADVVIPVPDSGFYAALGFARASGLEFQQGLIRWHYSGRSFIQPTQAIRDLAVKLKLAPVRGVIAGKSVVVVDDSLVRGTTSSKIVRLLRDAGAREVHMRIASPPVVGSCLYGIDTPSEGELISNRMDLEGVRREIGSDSLAFLSLGKLHGIYGDEAGDYCDACFSRKYPVLPTLADPAAEPEE

SEQ ID NO: 9729 - protein, 541 aa, Oryza sativa
MAAAAAAASTSRLLLLRHHHHAAADGSKQQQQLRYSSKPSSLALPRLRLLPAAGALLPDRVTPFSYEEDDESDDHPREECGLVGVVGDPDASSLCYLGLQKLQHRGEEGAGIVAVGGDGKLKSVTGLGLVADVFGDPARLASLPGPAAIGHVRYSTAGAAASLRNVQPFLAGYRFGQVAVAHNGNLVNYQALRNKLEARGSIFNTSSDTEVILHLIATSLSRPLLSRICDACERLAGAYSLLFLTADKMFAVRDPHGFRPLVLGRRRNGAVAFASETCALDLIEATYEREVEPGEVVVVDRRDMSVSSACLVPHRPRRSCVFEHIYFALPNSVVFSHAVHERRTAFGRALAEESPAAGADVVIPVPDSGFYAALGFARASGLEFQQGLIRWHYSGRSFIQPTQAIRDLAVKLKLAPVHGVIRGKSVVVVDDSLVRGTTSSKIVRLLRDAGAREVHMRIASPPVVGSCLYGIDTPSEGELISNRMDLEGVRREIGSDSLAFLSLGKLHSIYGAEAEGYCDACFSRNYPVLPTLPEPVVELEE

SEQ ID NO: 9730 - protein, 540 aa, Brachypodium distachyon
MAAAAPSTSRLLHHHQTTTGYKRQQQRLRYSANPSHLALRRHSSCRLSPAGALLPDRVTPFSYGGDDESDDHPREECGLVGIVGDPDAASLCYLGLQKLQHRGEEGAGIVAVGGDGKLKSVTGLGLVADVFGDPSRLASLPGPAAIGHVRYSTAGAAASLRNVQPFLAGYRFGQVAVAHNGNLVNYQALRNKLEARGSIFNTTSDTEVILHLIATSLSRPLLARICDACERLAGAYSLLFLTADKLFAVRDPHGFRPLVLGRRPNGAVAFASETCALDLIDATYEREVEPGEVVMVDRRDMSVSSACLVPRLPRRACVFEHIYFSLPNSVVFSHDVHERRTAFGRALAEESPVPDADVVIPVPDSGFYAALGFSRESGLEFQQGLIRWHYSGRSFIQPTQAIRDLAVKLKLAPVHGVIRGKSVVVVDDSLVRGTTSSKIVRLLREAGAREVHMRIASPPVVGSCLYGIDTPSDGELISNRMDLEGVRQEIGSDSLAFLSLDKLHGIYGAEAGDYCDACFSRKYPVLPTLPEPTSEFEEEE

SEQ ID NO: 9731 - protein, 545 aa, Hordeum vulgare
MGMAATAPSTSRLLHHHQTTPVVSKHHHQQQLRQRLRYAPNPSPLALRGRLSPPAGALLPDRVTPFSYGADDESDDHPREECGLVGVVGHPDAASLCYLGLQKLQHRGEEGAGIVAAGGDGKLKSVTGLGLVADVFGDPSRLASLPGPAAIGHVRYSTAGAAASLRNVQPFLAGYRFGQVAVAHNGNLVNYQALRSKLEARGSIFNTTSDTEVILHLISTSLSRPLLARICDACERLAGAYSLLFLTADKLFAVRDPHGFRPLVLGRLANGAVAFASETCALDLIDATYEREVEPGEVVMVDRRDMSVSSACLVPRLPRRACVFEHIYFSLPNSVVFSHDVHERRTAFGRALAEESPAAGADVVIPVPDSGFYAALGFSRESGLEFQQGLIRWHYSGRSFIQPTQAIRDLAVKLKLAPVRGVIRGKSVVVVDDSLVRGTTSSKIVRLLRDAGAREVHMRIASPPVVGSCLYGIDTPSDGELISNRMDLEGVRREIGSDSLAFLSLDKLHGIYGDEAGDYCDACFSRKYPVLPTLPEPAAEFDDED

SEQ ID NO: 9732 - protein, 542 aa, Hordeum vulgare
AATAPSTSRLLHHHQTTPVVSKHHHQQQLRQRLRYAPNPSPLALRGRLSPPAGALLPDRVTPFSYGADDESDDHPREECGLVGVVGHPDAASLCYLGLQKLQHRGEEGAGIVAAGGDGKLKSVTGLGLVADVFGDPSRLASLPGPAAIGHVRYSTAGAAASLRNVQPFLAGYRFGQVAVAHNGNLVNYQALRSKLEARGSIFNTTSDTEVILHLISTSLSRPLLARICDACERLAGAYSLLFLTADKLFAVRDPHGFRPLVLGRLANGAVAFASETCALDLIDATYEREVEPGEVVMVDRRDMSVSSACLVPRLPRRACVFEHIYFSLPNSVVFSHDVHERRTAFGRALAEESPAAGADVVIPVPDSGFYAALGFSRESGLEFQQGLIRWHYSGRSFIQPTQAIRDLAVKLKLAPVRGVIRGKSVVVVDDSLVRGTTSSKIVRLLRDAGAREVHMRIASPPVVGSCLYGIDTPSDGELISNRMDLEGVRREIGSDSLAFLSLDKLHGIYGDEAGDYCDACFSRKYPVLPTLPEPAAEFDDED

SEQ ID NO: 9733 - protein, 542 aa, Setaria italica
MAATAAAAATTPSSPLLRRAAAAPTTGHHYQLRCSAKPSPLELRHYAARLAPARALFPDRVTPFSFDADGDDHPREECGVFGVIGDPDASSLCYLGLQKLQHRGEEGAGIAASDADGKLKSVTGLGLVGDVFGDPTRLAKLPGNAAIGHVRYSTAGASSMRNVQPFLAAYRFGQLAVAHNGNLVNYQALRNKLEAQGSIFNTSSDTEVILHLIATSLSRPLLSRICDACERLAGAYSLLFLTADKLFAVRDPFGFRPLVMGRRPNGAIVFASETCALDLIDAAYEREVAPGEVVVVDRRDMSVSYACLVPHRPRKSCVFEHIYFALPNSVVFGHAVHERRSAYGRALAEESPAPTADVVIPVPDSGFYAALGFAQASGLEFQQGLIRWHYSGRSFIQPSQAIRDLAVKLKLAPVRGVITGKSVVVVDDSLVRGTTSSKIVRLLRDAGAREVHMRIASPPVIGSCLYGIDTPSEGELISNRMDLEGVRRTIGCDSLAFLSLDKLHSIYGDEAHELCDACFSRNYPVLPTVPEPVPELVSAFED

SEQ ID NO: 9734 - protein, 544 aa, Brachypodium distachyon
MAAAAAAATAAPTTTASSRLLLPRTAPVPSPIHYQLRCSAGPSLLARRHRAPAPARASPDRLTPFNYDDDSDDHPREECGVFGVVGDPDASSLCYLGLQKLQHRGEEGAGISASGDDGDIKTVTGLGLVGDVFGDPARLAGLPGRSAIGHVRYSTSGAAASLRNVQPFHAGYRFGQLAVAHNGNLVNYQSLRNKLEAQGSIFNTSSDTEVILHLIATSLSRPLLARICDACERLAGAYSLLFLTADKLFAVRDPFGFRPLVMGRRPNGAVVFASETCALDLIDAVYEREVEPGEVVVVDRRDMSMSSACLVPHRPRKSCVFEHIYFALPNSIVFGHAVHERRTAYGRALAEESPAPTADVVIPVPDSGFYAALGFAQASGLEFQQGLIRWHYSGRSFIQPTQAIRDLAVKLKLAPVRGVIAGKSVVVVDDSIVRGTTSSKIVRLLRDAGAREVHMRISSPPVIGSCLYGIDTPSEGELISNRMDIEGVRRAIGCDSLGFLSLDKLHSIYGDEAGELCDACFSRNYPVLPTVPEPVPELVSAFDD

SEQ ID NO: 9735 - protein, 547 aa, Sorghum bicolor
MAATAAATAAAATTSTPSTPLLRRAAAAPTTSHHYQLRCSTKPSQFVLRHRAARVAPARALLPDRVTPFSFDADGDDHPREECGVFGVIGDPDASSLCYLGLQKLQHRGEEGAGIVASDADGKLNSVTDLGLVGDVFRDPARLAKLPGNAAIGHVRYSTAGASSRRNVQPFLAAYRFGQLAVAHNGNLVNYQALRNKLEAQGSIFNTSSDTEVILHLISTSLSRPLLSRICDACERLAGAYSLLFLTADKLFAVRDPFGFRPLVMGRRPNGAVVFSSETCALDLIDATYEREVEPGEVVVVDRRDMSVSYACLVPHRPRKSCVFEHIYFALPNSVVFGHAVHERRSAYGRALAEESPAPTADVVIPVPDSGFYAALGFAQASGLEFQQGLIRWHYSGRSFIQPSQAIRDLAVKLKLAPVHGVITGKSVVVVDDSLVRGTTSSKIVRLLRDAGAREVHMRISSPPVVGSCLYGIDTPSEGELISNRMDLEGVRRTIGCDSLAFLSLEKLHSIYGNEAHEFCDACFSRNYPVLPTVPELVPELVSAFED

SEQ ID NO: 9736 - protein, 544 aa, Zea mays
MAATAAAAATASTPSSPLRRRASAAPTTRHNSQLKCSIKPSQFELRHRAAGLAPARALLPDRVTPFSFDADGDDHPREECGVFGVIGDPDASSLCYLGLQKLQHRGEEGAGIVASDADGKLNSVTDLGLVGDVFRDPARLAKLPGNAAIGHVRYSTAGASSRRNVQPFLAAYRFGQLAVAHNGNLVNYQALRNKLEAQGSIFNTSSDTEVILHLISTSLSRPLLSRICDACERLAGAYSLLFMTADKLFAVRDPFGFRPLVMGRRPNGAVVFSSETCALDLIDATYEREVEPGEVVVVDRRDMSVSYACLVPHRPRKSCVFEHIYFALPNSVVFGHAVHERRTAYGRALAEESPAPTADVVIPVPDSGFYAALGFAQASGLEFQQGLIRWHYSGRSFIQPSQAIRDLAVKLKLAPVRGVITGKSVVVVDDSLVRGTTSSKIVRLLRDAGAREVHMRISSPPVVGSCLYGIDTPSEGELISNRMDLEGVRRTIGCDSLAFLSLDKLHSIYGNEAHEFCDACFSRNYPVLPTVPEPVPELVSAFED

SEQ ID NO: 9737 - protein, 109 aa, Sorghum bicolor
MAKNPRDAAAPEEEEMPVAAEGQAAPAAATVKVLFFARARDLTGVADSAVEVPPGSTAGECLARVLAQFPKLEEIRGSVVLALNEEYAADSTPVADGDELAVIPPISGG

SEQ ID NO: 9738 - protein, 110 aa, Saccharum officinarum
MAENPKDAAPEEEEEMPTAAAEEQAAAPAATVKVLFFARARDLTGVADSTVEVPPGSTAGECLARVLAQFPKLEEIRGSVVLALNEEYAAESTAVADGDELAVIPPISGG

SEQ ID NO: 9739 - protein, 107 aa, Setaria italica
MATQDPKDAAPTEEEGPAAADPAAPAARLKVLYFARARDLTGVAESSVEVPAGGTAGECLARVLAQFPKLEEIRGSMVLALNEEYAPDSAKVADGDELAVIPPISGG

SEQ ID NO: 9740 - protein, 457 aa, Sorghum bicolor
MGEGEAAEVKGGVLQGRYELGRVLGHGNFGRVHAARDLRTGRGVAVKVLVKDKVLRAGMMEQIKREIAVMKRVSHPNIVELHEVMATRSKIYLALELVRGGELFARIVRAGRVKEDVARRYFRQLISAVDFCHARGVYHRDLKPENLLIDEAGNLKVVDFGLSALADHARSDGLLHTLCGTPGYVAPEVFRNKGYDGAKADIWSCGVILYVLLAGSLPFPEDNIAAMFRKMSRGDYRCPPWLSTEARRLIPKLLDPNPDTRITIAQIVETPWFNKPSIAKPVKASAAAAAEPPAEPVCSVKDGGDKDEPPETLNAFHLISLSAGFDLSPLFDVEGGPARCHNREGGMRFATRESASGVVSRLEEVAARGGGRMRVTKSGARGVRLEGAERGGRKGRLAVAADIFSLSPSVLVVDVKKDGGDTLEYRSFCSEELRPALKDIVWAADPQPAATATAVVV

SEQ ID NO: 9741 - protein, 451 aa, Setaria italica
MGEGDGDVKAGGVLQGRYELGRVLGHGNFGRVHTARDLRTGRSVAVKVLSKDKVVRAGMMEQIKREIAVMKRVSHPNIVELHEVMATRSRIYLALELVRGGELFARIVRAGRVREDVARRYFRQLVSAVDFCHARGVFHRDLKPENLLIDEAGNLKVVDFGLSALADHTRSDGLLHTLCGTPGYVAPEVFRNKGYDGAKADIWSCGVILYVLLAGSLPFPEDNIASMFKKMSRGDYRCPPWLSTEARRLIPRLLDPNPDTRITIAQMVETPWFKKSSSVPRPVNAAAEPPAEPACAGKDGGDKDEPPETLNAFHLISLSAGFDLSPLFDVEGGSARGHREGGMRFATRESASGVVSRLEEVAARGGGRMRVTKSGARGVRFEGAERGGPKGRLAVAADIFSVAPSVLVVDVKKDGGDTLEYRSFCSDELRPALKDIVWAAADPAPAAAAVV

SEQ ID NO: 9742 - protein, 453 aa, Pennisetum glaucum
MAGEGDGDVKVGGVLQGRYELGRVLGNGNFGRVHTARDLRTGRSVAVKVLSKDKVVRAGMMEQIKREIAVMKRVSHPNIVELHEVMATRSRIYLALELVRGGELFTRIVRTGRVKEDVARRYFRQLVSAVDFCHARGVFHRDLKPENLLIDDAGNLKVVDFGLSALADHARSDGLLHTLCGTPGYVAPEVFRNKGYDGAKADIWSCGVILYVLLAGSLPFPEDNIAAMFKKMSRGDYRCPPWLSTEARRLIPKMLDPNPDTRITIAQIVDTPWFKKSSSVPRPINAAIEPPEEPAPAKKDGGDKDEPPETLNAFHLISLSAGFDLSPLFDVEGGSSSRGHREGGMRFATRESASGVVSRLEEVAARGSGRMRVTKSGARGVRFEGAERGGPKGRLAVAADIFSVAPSVLVVDVKKDGGDTLEYRSFCSDELRPALKDIVWAAADPAPAATAVV

SEQ ID NO: 9743 - protein, 468 aa, Zea mays
MVEGEAEAEAEVKKGGVLQGRYELGHVLGHGNFGRVHEARDLRTGRGVAVKVLAKDKLLRTGMMEQIKREIAVMKRVSHPNIVELHEVMATRTKIYLALELVRGGDLLARIARSGRVREDVARRYFRQLVSAVDFCHARGVFHRDLKPENLLVDEAGNLKVVDFGLSALADHARADGLLHTICGTPGYVAPEVFRNRGYDGAKADVWSCGVVLYVLLAGSLPFPKDSIAAMFIKMSRRDYRCPPWLSTEARRLIPKLLDPDPDTRITVAQIVETPWFNKPSVSRAVTAAAAEPPAEAACSAKDSGGGDKDELPETLNAFHLISLSAGLDLSPLFDVEGGPARGHREDGMRFATREPASGVVSRLEEVAARSGGRMRVTKSGARGVRLEGAGRGGRKGRLAVAADIFCLAPSVLVVDIKKDGGDTLEYRSFCSEVLRPALKDIVWAADPHPAAAAVDAVRPPSDHCSGS

SEQ ID NO: 9744 - protein, 442 aa, Hordeum vulgare
MADQAEGKKGGVLQGRYEMGRVLGHGNFGRVHIARDLRTGRAVAVKVVAKDKVVRAGMVEQIKREIAVMKRVSHPNIVELHEVMATRSKIYLALELVRGGELFARIERSGRVTEDVARRYFRQLISAIDFCHARGVYHRDLKPENLLLDEAGNLKVVDFGLSALADHARADGLLHTLCGTPGYAAPEVLRDKGYDGAKADLWSCGVILYVLLAGSLPFPDNNVVTMYKKAQRGDYRCPPWFSTDARRLIPKLLDPDPTTRITVAQLVETPWFKKTSIAKPVSLGPPADSACAKDAADKDEPEAMNAFHLISLSEGFDLSPLFEGHPASRRREGGMRFATREPATGVVSRLEDVAARGGGRMRVTKSSPGGVRLEGAERGGRKGRLTVAAEIFSVAPSVLVVDVKKDGGDTLEYLSFCCEELRPALQDIVWAADPPASVAIAV

SEQ ID NO: 9745 - protein, 439 aa, Triticum aestivum
MAGSAEGKKGGVLQGRYEMGRVLGHGNFGRVHIARDLRTGRAVAVKVVAKDKVVRAGMVEQIKREIAVMKRVSHPNIVELHEVMATRSKIYLALELVRGGELFSRIERSGRVTEDVARRYFRQLISAVDFCHARGVYHRDLKPENLLLDEAGNLKVVDFGLSALADHARADGLLHTLCGTPGYAAPEVLRDKGYDGAKADLWSCGVILYVLLAGSLPFPDDNVVTMYKKAQRGDYRCPPWFSTDARRLIPKLLDPDPATRITVAQLVETSWFKKTSIAKPLSLEPPACVKDAADKDEPEALNAFHLISLSEGFDLSPLFEGHPASRRREGGMRFATREPARGVVSRLEEVAARGGGRMRVTKSSPGGVRLEGAERGGRKGRLAVAAEIFSVAPSVLVVDVKKDGGDTLEYLSFCCDELRPALQDIVWAADPPASVAIAV

SEQ ID NO: 9746 - protein, 659 aa, Brachypodium distachyon
MFGWKKWNRCRFCLVHETDENVERLFFLIATPLLLRRPRPARMLRPGALPLPSPRAALAPLCSAALAQRGCSARPCSAAPHQRRRPLACLCCGSRAAPAPPPCHPVRGPCSPSAPAAPHVPLLRPPRCPCSAALPPRARPLLRLPPLPHAALPPLLRCELPPCRPGPRAARRPCSAAASASVAAVHSPRASRERGSAGTASDGEGDGGRLVGGPDDVLERRPELLAAEGAVLEGVASVLLDVDHEHRRSHAEDLCGHGEPAFGPPAGRALEAHAPGAALGHPHPPAAAGSDLLKAGDDAFRRLPGRKQHAALPSATSRIALEQRREVEPLGEGYQVEGVHRLRFVLVFGLLRGAHYRMVNWRWRWLRSYRPGNGSLLEPRRLDELRDGDAGGRVGVEQLGDEPAGVRGEPRRAPVVSALDLLVHGDNVVVRERQGAGEEHEEDDAAGPDVGLGAVVSLVAEHLGRGVARRAAEGVEQPVCAGVVGERAEAEVDHLEVPLLVEEQVLGLEVAVEDAARVAEVDGGDELAEVVARDVLPDAARAHDPGEELAAADELEGEVDLGARGHHLVELDDVGVGDALHDGDLPLHLLRHAGADHLLLGHHLHRHAPPGPQVPGHVDPPEVAVAQDAAHLVAALQHPAAPLLPLRRRRLRHVPDPLL

SEQ ID NO: 9747 - protein, 451 aa, Oryza sativa
MMAAAAEEGEGKKGGGAVLQGRYEMGRVLGHGNFGRVHVARDLRTGRSVAVKVVAKEKVVRAGMMEQIKREIAVMKRVSHPNIVELHEVMATRSKIYLALELVRGGELFGRIVRLGRVREDAARHYFRQLVSAVDFCHSRGVYHRDLKPENLLLDEAGNLKVVDFGLSALADHARADGLLHTLCGTPGYAAPEVLRDKGYDGAKADLWSCGVILYVLLAGSLPFPDDNIVTLYRKAQRGDYRCPAWLSTDARRLIPRLLDPNPTTRISVAQLVETPWFKKTSISRPVSIELPPAFADPAPAKEEAEKDEPETLNAFHLISLSEGFDLSPLFEGDSAKGRRDGGMLFATREPASGVISRLEGVAARGGGRMRVTKSGARGVRLEGAERGGAKGRLAVAADIFSVAPSVLVVDVKKDGGDTLEYRSFCSEELRPALQDIVWGAAADPTPTAAV

SEQ ID NO: 9748 - protein, 452 aa, Brachypodium distachyon
MAEAAAAEGKKGGGGVLQGRYEMGRVLGHGNFGRVHVARDLRTGRSVAVKVVAKEKVVRAGMAEQMKREIAVMKRVSHPNIVELHEVMATRSKIYLALELVRGGELFARIVRSGRVREDVARHYFRQLISAVDFCHARGVFHRDLKPENLLLDEQGNLKVVDFGLSALADHARADGLLHTLCGTPGYAAPEVLRDKGYDGAKADIWSCGVILFVLLAGSLPFPDDNIVTMYKKVQRGDYRCPPWFSTDARRLVPKLLDPNPATRITIAELVETPWFKKTSIARPVTTEPPPPPIDHPVVCAAKEAEDKDEPETMNAFHLISLSEGFDLSPLFEGNSARGRREGGMLFATREPAKGVVSRLEEVAARGGGRMRVTKSGAGGVRFEGAARGGAKGRLAVAAEIFSVAPSVLVVDVKKDGGDTLEYRSFCSEELRPALQDIVWAADQPASVALAV

SEQ ID NO: 9749 - protein, 1069 aa, Sorghum bicolor
MGDAAVPAGTLQKSYFDVLGICCPSEVPLVEKLLRPLPGVHTVTVIVPSRTVIVLHDAAATSPAQIVKALNQARLEASVRAYGSGSEEKVANKWPSPYVLFCGVFLVVSLFEHFWPPLKWFALVAAAAGLPPIVLRSFAAARRLTLDVNILMLIAVSGAIALKDYSEAGFIVFLFTTAEWLETRASHKATAGMSSLMSMTPQKAVLAETGEVVSAQDVKVNTVIAVKAGEVVPIDGVVVDGRSEVDESTLTGESFPVAKQPDSQVWAGTLNIDGYIAVRTTAMADNSAVAKMARLVEEAQNSRSKTQRLIDTCAKYYTPAVVVMAAGVAVIPVAIRAHHLKHWFQLALVLLVSACPCALVLSTPVATFCALLTAARTGLLIKGGDVLETLARIKIAAFDKTGTITRGEFCVEEFQAVGERIPMQQLLYWVSSIESRSSHPMASVLVDYAQSKSVEPKSDNVTEFQIYPGEGIYGEIDGEGVYIGNKRILSRASCETVPDMKDMKGVTIGYVACKGQLIGVFTLSDSCRTGSAEAIRELRSLGIKSVMLTGDSSAAASYAQNQLGNILDEVHPELLPEDKVRIVDELKAKHGPTLMIGDGMNDAPALAKADVGVSMGVSGSAVAMETSHITLMSNDIRRIPKAIQLARRTHRTIIVNIIFSVITKLAIVGLALSGHPLIWAAVLADVGTCMLVIMYSMLLLRSKGGRKAKKCCASSQHGSHAKKHCVSRHCSDGPCKSTGCSKESSAGKHGCHDHGHAHTHCKEPSSQHPTEKHACHDHGHSHNHCKEPSSHVVTEKHVCHDHGNTHNHCKEAGNQLLLVEGHGCHDRDHGHSHEHTGKQDCHGHEHSHCKEPKTPRADSEGACHGHGHDHGHEHRHCEGDSHSHATGELGCHEHSTVEHACEHQCHAEQQTVHTAETHHCHDHEHGQHKHDHGEIEEPEKDCHDHSHHCCHEPHDKDKTPAEPVEEVTISIAALPKDEGHHHSEEHKGEHCGKAKDCGVPAPTDCAASKNCCSVKGGDTCSSSQAACAKETSPCCRSYVKCPKTTATVTRSSCCGHSHTMLKLPEIVVE

SEQ ID NO: 9750 - protein, 369 aa, Setaria italica
MGTGRASVVGALLVALAVLAPAVTAQTCNDELPSQLVRNYSGLACAPVWNSFVLRYAQDKDNVLRVVLSTMYSTGWVGMGFSKNGLMVGSSAMVGWMGKTGVAHIKQFSLQGKTPSQVVVDKGILVSNDHDHTVLVQQAKIYLAFQLRFNEPLKRQNVLLAFGSAIPVNDRLSEHQDKTSITFDFTTGSSSSASSFPEGLKRTHGALNLFAWGVLLPIGAIVARYCRRWDPLWFYLHAGIQFVGFILGLAGIVAGVSLYSKIQANVPAHRGLGIFVLVLGILQILAIFLRPNKDSKYRKFWNWYHHWVGRLALFFAAINIVLGIKVGGAGNSWKIGYGFNLAVLLITIITMEVLLWTRWRNNSSSTAAY

SEQ ID NO: 9751 - protein, 315 aa, Saccharum officinarum
MKLIIDTDPGIDDSVAIMMAFQLPGVQVLGLTTIFGNCTTEHATRNALILCEKAGHPEVPVAEGSHEPLKGGKPDVADFVHGSEGLGNIGLPDPTIKKVEESAAEFLVDKVSQFPGEVSVLALGPLTNVALAIKKDPSFVKNVKKIVVLGGAFFSAGNATPSAEANIHHDPEAADIVFTSGANIYVVGLNITTQVSFTDKDLLELRNSKGKHAQFLCDVCNFYLDWHIKSYGAPVIFLHDPVSFAALVRPELFTFKKGVVRVETQGICVGHTSMDMLLKKWNSENPWTGYSPISVAWTVDVPKVVAFVKELVIKQ

SEQ ID NO: 9752 - protein, 331 aa, Sorghum bicolor
MEGGNGQIDRSDEREEMKLIIDTDPGIDDSVAIMMAFQLPGVQVLGLTTIFGNCTTEHATRNALILCEKAGHPEVPVAEGSHEPLKGGKPHVADFVHGSDGLGNIVLPDPTIKKVEESAADFLVDKVSQFPGEVSVLALGPLTNIALAIKKDPSFVKNVKKIVVLGGAFFAAGNATPSAEANIHSDPEAADIVFTSGADIYVVGLNITTQVSFTDKDLLELRNSKGKHAQFLCDVCKFYLDWHIKSYGAPVIFLHDPVSFAALVCPEMFTFKKGVVRVETQGICVGHTSMDMLLKKWNSENPWTGYSPISVAWTVDVPKVVAFVKELVIKQ

SEQ ID NO: 9753 - protein, 329 aa, Echinochloa colona
MAAGNGQIHHHNETEKLIIDTDPGIDDSVAIMMAFQSPGVQVLGLTTIFGNCTTEHATHNALILCEKAGHPEVPVAEGSHEPLKGGKPHVADFVHGSDGLGNIELPNPTIKKVEQSAAEFLVDKVSQFPGEVSVLALGPLTNIALAIKKDPSFVKNVKKIVVLGGAFFAAGNATPSAEANIHSDPEAADIVFTSGADIYVVGLNITTQVSFTDKDLLEVRNSKGKHAQFLCDVCKFYLDWHIKSYGAPVIFLHDPVSFAALVRPDLFTFKKGVVRVETQGICKGHTSMDMLLKKWNSENPWTGYSPISVAWTVDVPKMVAFVKELVTKE

SEQ ID NO: 9754 - protein, 309 aa, Panicum virgatum
HALIPDDSIAIMMAFQSPGVQVLGLTTIFGNCTTEHATRNALILCEKAGHPEVPVAEGSHEPLKGGKPRVADFVHGSDGLGEIELPDPTIKKVDQSAAEFLVDKVSQFPGEVSILALGPLTNVALAIKKDPSFVKNVKKIVVLGGAFFAAGNATPSAEANIHSDPEAADIVFTSGAKIYVVGLNITTQVSFTDKDLLELRNSKGKHAQFLCDVCKFYLDWHIKSYGAPVIFLHDPVSFAALVRPDLFTFRKGVVRVETQGICAGHTSMDMLLKKWNSENPWTGYSPISVAWTVDVPKMVAFVKELVTRE

SEQ ID NO: 9755 - protein, 333 aa, Setaria italica
MEASNGQIHHHDEQPRAEQKIIIDTDPGIDDSVAIMMAFQSPGVQVLGLTTIFGNCTTEHATRNALILCEKAGHPEVPVAEGSHEPLKGGKPKVAAFVHGSDGLGNIELPDPTIKKVEQSAAEFLVDKVSQFPGEVSVLALGPLTNLALAIKKDPSFVKNVRKIVVLGGAFFSAGNATPSAEANIHSDPEAADIVFTSGADIYVVGLNITTQVSFTDKDLLELRNSKGKHAQFLCDVCKFYLDWHIESYGAPVIFLHDPVSFAALVRPDLFTFRKGVVRVETQGICAGHTSMDMLLKKWNSENPWTGYSPISVAWTVDVPKMVAFVKELVTGE

SEQ ID NO: 9756 - protein, 304 aa, Panicum virgatum
IPDDSIAIMMAFQSPGVQVLGLTTIFGNCTTEHATRNALILCEKAGHPEVPVAEGSHEPLKGGKPCVADFVHGSDGLGEIELPDPTIKKVDQSAAESLVDKVLQFPGEVSILALGPLTNVALAIKKDPSFVKNVKKIVVLGGAFFAAGNATPSAEANIHSDPEAADIVFTSGAEIYVVGLNITTQVSFTDKDLLELRNSKGKHAQFLCDVCKFYLDWHIKSYGAPVIFLHDPVSFAALVRPDLFTFRKGVVRVETQGICAGHTSMDLLLKKWNSENPWTGHSPISVAWTVDVPKMVAFVKELVT

SEQ ID NO: 9757 - protein, 333 aa, Cenchrus ciliaris
MEASNGQIHHGGEQQRAEEKIIIDTDPGIDDSMAIMMAFQSPGLQVLGLTTIFGNCTTEHATRNALILCEKAGHPEVPVAEGSHEPLKGGKPNVADFVHGSDGLGNIELPDPTIKKVDQSAAEFLVDKVSQFPGEVSVLALGPRTNVALAIKKDPSFVKNVKKIVVLGGAFFSSGNATPSAEANIHNDPEAADIVFTSGADIYVVGLNITTQVSFTDKDLLELRNSKGKHAQFLCNVCKFYLDWHIKSYGAPVIFLHDPVSFAALVRPDLFTFRKGVVRVETQGICAGHTSMDMLLKKWNSENPWTGYSPISVAWTVDVPKMVAFVKELVTRE

SEQ ID NO: 9758 - protein, 333 aa, Pennisetum glaucum
MEASNGQIHNSDEQPRAEEKIIIDTDPGIDDSVAIMMAFQSPGLQVLGLTTIFGNCTTEHATRNALILCEKAGHPEVPVAEGSHEPLKGGKPNVADFVHGSDGLGNIELPEPTIKKVDQSAAEFLVDKVSQFPGEVSVLALGPLTNVALAIKKDPSFVKNIKKIVVLGGAFFSAGNATPSAEANIHSDPDAADIVFTSGADIYVVGLNITTQVSFTDKDLLELRNSKGKHAQFLCDVCKFYLDWHIKSYGAPVVFLHDPVSFAALVRPDLFTFRKGVVRVETQGICAGHTSMDMLLKKWNSENPWTGHSPISVAWTVDVPKMVAFVKELVTRE

SEQ ID NO: 9759 - protein, 337 aa, Secale cereale
MAANGHQIRPSEETMKLIIDTDPGIDDSVAIMMAFQAPGVEVLGLTTIFGNCTTAYATRNALILCEKAGRPDVPVAEGSAEPLKGGKPQVADFVHGSDGLGNVQVPEPTTKKAEQTAAEFLVDKVSQFPGEVSVLALGPLTNIALAIKMDPSFVTKVKKIVVLGGAFFAAGNATPSAEANIHSDPEAADMVFTSGADIAVVGLNITTQVSFTEADLSELRRSGGKQAQFLCDICKFYSDWHLHSYGDPAVFLHDPVSLAALVRPELFTFRKAWCGWRPRASAEATPPWTWGSRSSSRRTRGRVHADLGGVDGGQGQGGRLRQGAPHKLIRSSYLVIK

SEQ ID NO: 9760 - protein, 328 aa, Secale cereale
MAANGHQIRPSEETMKLIIDTDPGIDDSVAIMMAFQAPGVEVLGLTTIFGNCTTAYATRNALILCEKAGRPDVPVAEGSAEPLKGGKPQVADFVHGSDGLGNVSVPEPTTKKAEQTAAGFLVDKVSQFPGEVSVLALGPLTNIALAIKMDPSFVTKVKKIVVLGGAFFAAGNATPSAEANIHSDPEAADMVFTSGADIAVVGLNITTQVSFTEADLSELRSTGGKQAQFLCDICKFYSDWHLHSYGDPAVFLHDPVSLAALVRPELFTFRKGVVRVETQGICRGHTSMDMGLKKFKSENAWSGYTPISVAWTVDKAKVVAFVKELLKN

SEQ ID NO: 9761 - protein, 328 aa, Triticum aestivum
MAANGHQIQPAEEAMKLIIDTDPGIDDSVAIMMAFQAPGVEVLGLTTIFGNCTTAYATRNALILCEKAGRPDVPVAEGSAEPLKGGKPQVADFVHGSDGLGNVSVPEPTTKKAEQTAAEFLVDKVSQFPGEVSVLALGPLTNLALAIKMDPSFVTKVKKIVVLGGAFFAAGNATPSAEANIHSDPEAADMVFTSGADIAVVGLNITTQVSFTEADLSELRRSGGKQAQFLCDICKFYSDWHLHSYGDPAVFLHDPVSLAALVRPELFTFRKGVVRVETQGICRGHTSMDMGLKKFKSENAWSGYTPISVAWTVDKAKVVAFVKELLKN

SEQ ID NO: 9762 - protein, 332 aa, Cynodon dactylon
MAEVNGGQIHQNHPVEKEKVIIDTDPGIDDSVAIMMAFQSPGVQVLGLTTIFGNCTTERATRNALILCEKAGHPEVPVAEGSPEPLKGGKPHVADFVHGSDGLGNIDLSDPTSNKIDQSAAEFLVDKVSEFPGEVSVLALGPLTNVALAIKKDSSFVSKVKKIVVLGGSFFAAGNATPSAEANIHSDPEAADIVFTSGADIYVLGLNITLQVSFTDEDLLELRNSKGKHAQFLSDVCKFYRDWHVKSYGAPVFFLHDPVCFAALVHPEFFTFKKGVVRVETQGICTGHTSMDLGLKKWNSENPWTGYSPISVAWTVDVPKVVAFVKELVTKQ

SEQ ID NO: 9763 - protein, 330 aa, Hordeum vulgare
MAANGRQIRPAEKRETMKLIIDTDPGIDDSVAIMMAFRAPGVEVLGLTTIFGNCTTAYATRNALILCEKAGRPDVPVAEGSAEPLKGGKPQVADFVHGSDGLGNISVPEPTIKKAEQTATEFLVDKVSQFPGEVSVLALGPLTNLALAMKMDPSFVTKVKKIVVLGGAFFAAGNATPSAEANIHSDPEAADIVFTSGADIAVVGLNITTQVSFTEADLSELRSSGGKQAQFLCDICKFYSDWHLHSYGDPAVFLHDPVSFAALVRPELFTFRKGVVRVETQGICRGHTSMDMGLKKFNSENAWSGYTPISVAWTVDTAKVVALVKELLSN

SEQ ID NO: 9764 - protein, 314 aa, Leymus cinereus x Leymus triticoides
MKVIIDTDPGIDDSVAIMMAFQAPGVEVLGLTTIFGNCTTAYATRNALILCEKAGRPDVPVAEGSAEPLKGGKPQVADFVHGSDGLGNISVPEPTTKKAEQTATEFLVDKVSQFPGEISVLALGPLTNLALAIKMDPSFVTKVKKIVVLGGAFFAAGNATPSAEANIHSDPEAADIVFTSGADIDVVGLNITTQVSFTEADLSELRSSGGKQTQFLCDICKFYSDWHLHSYGDPAVFLHDPVSFAALVRPELFTFRKGVVRVETQGICRGHTSMDMGLKKFKSENAWSGYTPISVAWTVDKAKVVAFVKELLTN

SEQ ID NO: 9765 - protein, 329 aa, Lolium multiflorum
MEANGHQIQPTAAEKEKVIIDTDPGIDDSVAIMMAFQAPGVEVIGLTTIFGNCTTAYATRNALILCEKAGRSDVPVAEGSAEPLKGGKPQVADFVHGSDGLGNIPVPDPTTKKAEQTAAEFLVDKVSRFPGEVSVLALGPLTNVALAIKMDPSFVSKVKKIVVLGGAFFAAGNATPSAEANIHSDPEAADIVFTSGADIVVVGLNITTQVSFTVDDLAELRNSKGKHAQFLCDICKFYSDWHFKSYGDPAVFLHDPVSFAALMRPELFTFRKGVVRVETQGICRGHTSMDMGLKKFNTENAWSGYTPISVAWTVDKAKVVSFVKDLLTV

SEQ ID NO: 9766 - protein, 328 aa, Secale cereale
MAANGHQIRPSEETMKLIIDTDPGIDDSVAIMMAFQAPGVEVLGLTTIFGNCTTAYATRNALILCEKAGRPDVPVAEGSAEPLKGGKPQVADFVHGSDGLGNVSVPEPTTKKAEQTAAGFLVDKVSQFPGEVSVLALGPLTNIALAIKMDPSFVTKVKKIVVLGGAFFAEGNATPSAEANIHSDPEAADIVFTSGADIAVVGLNITTQVSFTEADLSKLRSSGGKQAQFLCDICKFYSDWHLHSYGDPAVFLHDPVSLAALVRPELFTFRKGVVRVETQGICRGHTSMDMGLKKFKSENAWSGYTPISVAWTVDKAKVVAFVKELLKN

SEQ ID NO: 9767 - protein, 369 aa, Secale cereale
DRTNRRQCWLAQNTENSLAQPGEEVSINSQEERRQSDRRREGSTTHRAIDRPGGHPFDGGERAPDPAVGGDDEAHHRHDPGIDDSVAIMMAFQAPGVEVLGLTTIFGNCTTAYATRNALILCEKAGRPDVPVAEGSAEPLKGGKPQVADFVHGSDGLGNVSVPEPTTKKAEQTAAEFLVDKVSQFPGEVSVLALGPLTNIALAIKMDPSFVTKVKKIVVLGGAFFAAGNATPSAEANIHSDPEAADMVFTSGADIAVVGLNITTQVSFTEADLSELRSSGGKQAQFLCDICKFYSDWHLHSYGDPAVFLHDPVSLAALVGRSSSPSGRAWCGWRPRASAEATPPWTWGSRSSSRRTRGRDTRRSRWRGR

SEQ ID NO: 9768 - protein, 337 aa, Oryza sativa
MDLQEAAMEARKGHRIPPTEEKVIIDTDPGIDDSVAIMMAFEAPGVKVVGLTTIFGNCTTSHATRNALILCDRAGRPEVPVAEGSAEPLKGGKPHVADFVHGSDGLGNTSFPDSTTTNKVEQSAAEFLVDKVSESPGEISVLALGPLTNIALAMKKDSSFASKVKRIVVLGGAFFAAGNATPSAEANIHSDPEAADIVFTSGADIYVVGLNITTQVYFTDKDMLELRNSKGKHAQFLCDICKFYRDWHVHSYGVDALFLHDPVSFTALVHPEYFTFKKGVVRVETQGICKGHTSMDMGLKKWNSDNPWTGYSPISVAWTVDVPKVLAYAKELLFNAQ

SEQ ID NO: 9769 - protein, 329 aa, Brachypodium distachyon
MEGNGHREIHPAAAKEKVIIDTDPGIDDSVAIMMAFNLPSVEVLGLTTIFGNCTTAYSTRNALILCEKAGRTEVPVAEGSAEPLKGGKPNVADFVHGSDGIGNVPVTDPTTKKAEQTAAQFLVDKVSQSPGEVSVLALGPLTNIALAIKMDPSFVTKVKKIVVLGGAFFSAGNATPSAEANIHSDPEAADIVFTSGADIYVVGLNITTQVSFTDDDLSELRNSKGKHTQFLCDICKFYRDWHLKSYGDPAVFLHDPVSFAAMVRPEFFTFRKGVVRVETQGICRGHTSMDMGLKKFNTENAWSGFSPISVAWTVDVPRVVAFVKELLLN

SEQ ID NO: 9770 - protein, 182 aa, Secale cereale
MAANGHQIRPSEETMKLIIDTDPGIDDSVAIMMAFQAPGVEVLGLTTIFGNCTTAYATRNALILCEKAGRPDVPVAEGSAEPLKGGKPQVADFVHGSDGLGNVQVPEPTTKKAEQTAAEFLVDKVSQFPGEVSVLALGPLTNIALAIKMDPSFVTKVKKIVVLGGAFFAAGNATPFSRSKHP

SEQ ID NO: 9771 - protein, 501 aa, Sorghum bicolor
MDLVLLEKALLGLFAAAVLAVAVAKLTGKRYRLPPGPAGAPVVGNWLQVGDDLNHRNLMSLAKRFGDIFLLRMGVRNLVVVSTPELAKEVLHTQGVEFGSRTRNVVFDIFTGKGQDMVFTVYGDHWRKMRRIMTVPFFTNKVVAQNRVGWEEEARLVVEDVRKDPRAAAEGVVIRRRLQLMMYNDMFRIMFDTRFESEQDPLFNKLKALNAERSRLSQSFEYNYGDFIPVLRPFLRGYLNRCHDLKTRRMKVFEDNFVQERKKVMAQTGEIRCAMDHILEAERKGEINHDNVLYIVENINVAAIETTLWSIEWGIAELVNHPAIQSKLREEMDSVLGAGVPVTEPDLERLPYLQAIVKETLRLRMAIPLLVPHMNLNDGKLAGYDIPAESKILVNAWFLANDPKRWVRPDEFRPERFLEEEKTVEAHGNDFRFVPFGVGRRSCPGIILALPIIGITLGRLVQNFQLLPPPGQDKIDTTEKPGQFSNQIAKHATIVCKPLEA

SEQ ID NO: 9772 - protein, 502 aa, Zea mays
MDLALLEKALLGLFAAAVLAIAVAKLTGRRYRLPPGPRGAPVVGNWLQVGDDLNHRNLMALARRFGDIFLLRMGVRNLVVVSTPELAKEVLHTQGVEFGSRTRNVVFDIFTGEGQDMVFTVYGEHWRKMRRIMTVPFFTGKVVARNRAGWEEEARLVVEDVARDPAAAAAGVVLRRRLQRMMYNDMFRIMFDRRFDSDDDPLFNKLKALNAERSRLSQSFEYNYGDFIPVLRPFLRGYLNRCHDLKTRRMKVFEDSFVQERKKVMAETGEIRCAMDHILEAERKGEINHDNVLYIVENINVAAIETTLWSIEWGIAELVNHPAIQSKLREELGSVLGGAGVPVTEPDLERLPYLQAVVKETLRLRMAIPLLVPHMNLNDGKLAGYDIPAESKILVNAWFLANDPKRWVRPDEFRPERFLEEDKSVEAHGNDFRFVPFGVGRRSCPGIILALPIIGITLASLVQNFQLLPPPGLDKIDTTEKPGQFSNQIAKHATIVCKPLKA

SEQ ID NO: 9773 - protein, 321 aa, Setaria italica
MMYNDMFRIMFDRRFDSEDDELFNKLKALNAERSRLSQSFEYNYGDFIPVLRPFLRGYLNRCHDLKTRRMKVFEDNFVQERKNVMAQTGEIRCAMDHILEAERKGEINHDNVLYIVENINVAAIETTLWSIEWGIAELVNHPEIQSKLREELTSVLGAGVAVTEPDLERLPYLQAVVKETLRLRMAIPLLVPHMNLNDGKLHGYDIPAESKILVNAWFLANDPKRWVKPEEFRPERFLEEEKAVEAHGNDFRFVPFGVGRRSCPGIILALPIIGITLGRLVQNFQLLPPPGQAKVDTTEKPGQFSNQIAKHATIVCKPLEA

SEQ ID NO: 9774 - protein, 501 aa, Cenchrus ciliaris
MDLALLEKALLGLFAAAVLAIAVAKLTGKRLRLPPGPPGAPVVGNWLQVGDDLNHRNLMALAKRFGDIFLLRMGVRNLVVVSTPELAKEVLHTQGVEFGSRTRNVVFDIFTGKGQDMVFTVYGDHWRKMRRIMTVPFFTNKVVAQNRAGWEEEARLVVEDVKRNPKAATEGVVIRRRLQLMMYNDMFRIMFDRRFDSEDDALFNKLKALNAERSRLSQSFEYNYGDFIPILRPFLRGYLKRCHDLKTRRMKVFEDNFVQERKKVMAQTGEIRCAMDHILEAERKGEINHDNVLYIVENINVAAIETTLWSIEWGIAELVNHPEMQSKLREEMTSVLGAGVAVTEPDLERLPYLQAVVKETLRLRMAIPLLVPHMNLNDGKLNGYDIPAESKILVNAWFLANDPKRWVKPEEFRPERFLEEEKAVEAHGNDFRFVPFGVGRRSCPGIILALPIIGITLGRLVQNFQLLPPPGQAKVDTTEKPGQFSNQIAKHATIVCKPLEA

SEQ ID NO: 9775 - protein, 583 aa, Setaria italica
GPSPPTAPKRTNPRSTKHKQARVLKSDPSSLPPCRNAINPRHPPHAVPITSSPRARQARRPNKTNTGHTPHLPPAGETRASQPWTSPSSRRPFWACSAAGAGHHRGEADGQAPPPAPRPPGAPVVGNWLQVGDDLNHRNLMTLAKRFGDIFLLRMGVRNLVVVSTPELAKEVLHTQGVEFGSRTRNVVFDIFTGKGQDMVFTVYGDHWRKMRRIMTVPFFTNKVVAQNRAGWEEEARLVVEDVKKNPKAATEGVVIRRRLQLMMYNDMFRIMFDRRFDSEDDELFNKLKALNAERSRLSQSFEYNYGDFIPVLRPFLRGYLNRCHDLKTRRMKVFEDNFVQERKNVMAQTGEIRCAMDHILEAERKGEINHDNVLYIVENINVAAIETTLWSIEWGIAELVNHPEIQSKLREELTSVLGAGVAVTEPDLERLPYLQAVVKETLRLRMAIPLLVPHMNLNDGKLHGYDIPAESKILVNAWFLANDPKRWVKPEEFRPERFLEEEKAVEAHGNDFRFVPFGVGRRSCPGIILALPIIGITLGRLVQNFQLLPPPGQAKVDTTEKPGQFSNQIAKHATIVCKPLEA

SEQ ID NO: 9776 - protein, 501 aa, Pennisetum glaucum
MDLALLEKALLGLFAAAVLAIAVAKLTGKRLRLPPGPPGAPVVGNWLQVGDDLNHRNLMDLARRFGDIFLLRMGVRNLVVVSTPELAKEVLHTQGVEFGSRTRNVVFDIFTGKGQDMVFTVYGDHWRKMRRIMTVPFFTNKVVAQNRAGWEEEARLVVEDVKKNPKAATEGVVIRRRLQLMMYNDMFRIMFDRRFDSEGDALFNKLKALNAERSRLSQSFEYNYGDFIPVLRPFLRGYLKRCHDLKTQRMKVFEDNFVQERKKVMAQTGEIRCAMDHILEAERKGEINHDNVLYIVENINVAAIETTLWSIEWGIAELVNHPEIQSKLREEINSVLGAGVAVTEPDLERLPYLQAVVKETLRLRMAIPLLVPHMNLKDGKLDGYDIPAESKILVNAWFLANDPKRWVKPEEFRPERFLEEEKAVEAHGNDFRFVPFGVGRRSCPGIILALPIIGITLGRLVQNFRLLPPPGQAKVDTTEKPGQFSNQIAKHATIVCKPLEA

SEQ ID NO: 9777 - protein, 501 aa, Triticum aestivum
MDVLLLEKALLGLFAAAVLAIAVAKLAGKRLRLPPGPSGAPIVGNWLQVGDDLNHRNLMGMARRFGEVFLLRMGVRNLVVVSSPELAKEVLHTQGVEFGSRTRNVVFDIFTGKGQDMVFTVYGDHWRKMRRIMTVPFFTNKVVAQNRAGWEEEARLVVEDLRADPAAAAAGVVVRRRLQLMMYNDMFRIMFDRRFESTADPLFNQLKALNAERSILSQSFDYNYGDFIPVLRPFLRRYLNRCTNLKTKRMKVFEDQFVQPRKEALEKTGEIRCAMDHILEAERKGEINHDNVLYIVENINVAAIETTLWSIEWGIAELVNHPDIQQKLREEIVAVLGAGVAVTEPDLERLPYLQSVVKETLRLRMAIPLLVPHMNLSDAKLAGYDIPAESKILVNAWFLANDPKRWVRADEFRPERFLEEEKAVEAHGNDFRFVPFGVGRRSCPGIILALPIIGITLGRLVQNFQLLPPPGQDKIDTTEKPGQFSNQILKHATIVCKPLEA

SEQ ID NO: 9778 - protein, 500 aa, Oryza sativa
MDALLVEKVLLGLFVAAVLALVVAKLTGKRLRLPPGPAGAPIVGNWLQVGDDLNHRNLMALARRFGDILLLRMGVRNLVVVSSPDLAKEVLHTQGVEFGSRTRNVVFDIFTGKGQDMVFTVYGDHWRKMRRIMTVPFFTNKVVAQNRAGWEEEARLVVEDVRRDPTAATSGVVIRRRLQLMMYNDMFRIMFDRRFDSVDDPLFNKLKAFNAERSRLSQSFEYNYGDFIPVLRPFLRRYLARCHQLKSQRMKLFEDHFVQERKRVMEQTGEIRCAMDHILEAERKGEINHDNVLYIVENINVAAIETTLWSIEWGIAELVNHPSIQSKVREEMASVLGGAAVTEPDLERLPYLQAVVKETLRLRMAIPLLVPHMNLADGKLAGYDIPAESKILVNAWFLANDPKRWVRPDEFRPERFLEEEKAVEAHGNDFRFVPFGVGRRSCPGIILALPIIGITLGRLVQSFDLLPPPGMDKVDTTEKPGQFSNQILKHATVVCKPIDA

SEQ ID NO: 9779 - protein, 501 aa, Triticum aestivum
MDVLLLEKALLGLFAAAVLAIAVAKLTGKRFRLPPGPSGAPIVGNWLQVGDDLNHRNLMGLAKRFGEVFLLRMGVRNLVVVSSPELAKEVLHTQGVEFGSRTRNVVFDIFTGKGQDMVFTVYGDHWRKMRRIMTVPFFTNKVVAQNRVGWEEEARLVVEDLKADPAAATAGVVVRRRLQLMMYNDMFRIMFDRRFESTADPLFNQLKALNAERSILSQSFDYNYGDFIPVLRPFLRRYLNRCTNLKTKRMKVFEDQFVQPRKEALEKTGEIRCAMDHILEAERKGEINHDNVLYIVENINVAAIETTLWSIEWGIAELVNHPEIQQKLREEIVAVLGAGAAVTEPDLERLPYLQSVVKETLRLRMAIPLLVPHMNLSDAKLAGYDIPAESKILVNAWFLANDPKRWVRADEFRPERFLEEEKAVEAHGNDFRFVPFGVGRRSCPGIILALPIIGITLGRLVQNFQLLPPPGQDKIDTTEKPGQFSNQILKHATIVCKPLEA

SEQ ID NO: 9780 - protein, 501 aa, Secale cereale
MDVLLLEKALLGLFAAAVLAIAVAKLTGKRLRLPPGPSGAPIVGNWLQVGDDLNHRNLMDMAKRFGEVFLLRMGVRNLVVVSSPELAKEVLHTQGVEFGSRTRNVVFDIFTGKGQDMVFTVYGDHWRKMRRIMTVPFFTNKVVAQNRVGWEEEARLVVEDLKANPASATEGVVVRRRLQLMMYNDMFRIMFDRRFESVDDPLFNKLKALNAERSILSQSFDYNYGDFIPVLRPFLRRYLNRCTNLKTKRMKVFEDHFVQQRKEALEKTGEIRCAMDHILEAERKGEINHDNVLYIVENINVAAIETTLWSIEWGIAELVNHPEIQQKLREEIVAVLGPGTAVTEPDLERLPYLQSVVKETLRLRMAIPLLVPHMNLSDAKLAGYDIPAESKILVNAWFLANDPKRWVRADEFRPERFLEEEKAVEAHGNDFRFVPFGVGRRSCPGIILALPIIGITLGRLVQNFQLLPPPGQDKIDTTEKPGQFSNQILKHATIVCKPLEA

SEQ ID NO: 9781 - protein, 501 aa, Brachypodium distachyon
MDVLLLEKALLGLFAAAVLAIAVAKLTGKRFRLPPGPSGAPIVGNWLQVGDDLNHRNLMGMAKRFGEVFLLRMGVRNLVVVSSPDLAKEVLHTQGVEFGSRTRNVVFDIFTGKGQDMVFTVYGDHWRKMRRIMTVPFFTNKVVAQNRVGWEEEARLVVEDVRADPASAVGGVVIRRRLQLMMYNDMFRIMFDRRFASVDDPLFNKLKALNAERSILSQSFDYNYGDFIPVLRPFLRRYLNRCHTLKSKRMKVFEDHFVQERKEALEKTGEIRCAMDHILEAERKGEINHDNVLYIVENINVAAIETTLWSIEWGIAELVNHPEIQAKVREEITAVLGPNTAVTEPDLERLPYLQAVVKETLRLRMAIPLLVPHMNLSDAKLAGYDIPAESKILVNAWFLANDPKRWVRPDEFRPERFMEEEKAVEAHGNDFRFVPFGVGRRSCPGIILALPIIGITLGRLVQNFTLLPPPGQAKIDTTEKPGQFSNQILKHATVVCKPLQA

SEQ ID NO: 9782 - protein, 501 aa, Leymus cinereus x Leymus triticoides
MDVLLLEKALLGLFAAAVLAIAVAKLTGKRFRLPPGPSGAPIVGNWLQVGDDLNHRNLMGMAKRFGEVFLLRMGVRNLVVVSSPELAKEVLHTQGVEFGSRTRNVVFDIFTGKGQDMVFTVYGDHWRKMRRIMTVPFFTNKVVAQNRVGWEEEARLVVEDLKANPASATEGVVVRRRLQLMMYNDMFRIMFDRRFESVDDPLFNKLKALNAERSILSQSFDYNYGDFIPVLRPFLRRYLNRCTNLKTKRMKVFEDHFVQQRKEALEKTGEIRCAMDHILEAERKGEINHDNVLYIVENINVAAIETTLWSIEWGIAELVNHPEIQQKLREEIVAVLGPGAAVTEPDLERLPYLQSVVKETLRLRMAIPLLVPHMNLSDAKLAGYDIPAESKILVNAWFLANDPKRWVRADEFRPERFLEEEKAVEAHGNDFRFVPFGVGRRSCPGIILALPIIGITLGRLVQNFQLLPPPGQDKIDTTEKPGQFSNQILKHATIVCKPLQA

SEQ ID NO: 9783 - protein, 501 aa, Hordeum vulgare
MDVLLLEKALLGLFAAAVLAIAVAKLAGKRFRLPPGPSGAPIVGNWLQVGDDLNHRNLMGLAKRFGEVFLLRMGVRNLVVVSSPELAKEVLHTQGVEFGSRTRNVVFDIFTGKGQDMVFTVYGDHWRKMRRIMTVPFFTNKVVAQNRVGWEEEARLVVEDLRADPAAATKGVVVRRRLQLMMYNDMFRIMFDRRFETVADPLFNQLKALNAERSILSQSFDYNYGDFIPVLRPFLRRYLNRCTNLKTKRMKVFEDHFVQQRKEALEKTGEIKCAMDHILEAERKGEINHDNVLYIVENINVAAIETTLWSIEWGLAELVNHPEIQQKLREEIVAVLGPGTPVTEPDLERLPYLQSVVKETLRLRMAIPLLVPHMNLSDAKLAGYDIPAESKILVNAWFLANDPKRWVRADEFRPERFLEEEKSVEAHGNDFRFVPFGVGRRSCPGIILALPIIGITLGRLVQNFELLPPPGQDKIDTTEKPGQFSNQILKHATIVCKPLEA

SEQ ID NO: 9784 - protein, 501 aa, Avena sativa
MDVLLLEKALLGLFAAAVLAIAVAKLTGKRFRLPPGPSGAPIVGNWLQVGDDLNHRNLMGLAKRFGEVFLLRMGIRNLVVVSSPELAKEVLHTQGVEFGSRTRNVVFDIFTGNGQDMVFTVYGDHWRKMRRIMTVPFFTNKVVAQNRVGWEEEARLVVEDVKADPASATAGVVIRRRLQLMMYNDMFRIMFDRRFQSVDDPLFNKLKALNAERSILSQSFDYNYGDFIPILRPFLRRYLNRCTNLKTKRMKLFEDHFVQDRKKALEQTGEIKCAMDHILEAERKGEINHDNVLYIVENINVAAIETTLWSIEWGIAELVNHPDVQSKLRDEMTAVLGANVAVTEPDLERLPYLQSVVKETLRLRMAIPLLVPHMNLSDAKLAGYDIPAESKILVNAWFLANDPKRWVKADEFRPERFLEEEKAVEAHGNDFRFVPFGVGRRSCPGIILALPIIGITLGRLVQNFQLLPPPGQDKIDTTEKPGQFSNQILKHATIVCKPLEV

SEQ ID NO: 9785 - protein, 501 aa, Avena sativa
MDVLLLEKALLGLFAAAVLAIAVAKLTGKRFRLPPGPSGAPIVGNWLQVGDDLNHRNLMGLAKRFGEVFLLRMGIRNLVVVSSPELAKEVLHTQGVEFGSRTRNVVFDIFTGNGQDMVFTVYGDHWRKMRRIMTVPFFTNKVVAQNRVGWEEEARLVVEDVKADPASATDGVVIRRRLQLMMYNDMFRIMFDRRFQSVDDPLFNKLKALNAERSILSQSFDYNYGDFIPILRPFLRRYLNRCTNLKTKRMKLFEDHFVQDRKKALEQTGEIKCAMDHILEAERKGEINHDNVLYIVENINVAAIETTLWSIEWGIAELVNHPDVQSKLRDEMTAVLGANVAVTEPDLERLPYLQSVVKETLRLRMAIPLLVPHMNLSDAKLAGYDIPAESKILVNAWFLANDPKRWVKADEFRPERFLEEEKAVEAHGNDFRFVPFGVGRRSCPGIILALPIIGITLGRLVQNFQLLPPPGQDKIDTTEKPGQFSNQILKHATIVCKPLEV

SEQ ID NO: 9786 - protein, 501 aa, Avena sativa
MDVLLLEKALLGLFAAAVLAIAVAKLTGKRFRLPPGPSGAPIVGNWLQVGDDLNHRNLMGLAKRFGEVFLLRMGIRNLVVVSSPELAKEVLHTQGVEFGSRTRNVVFDIFTGNGQDMVFTVYGDHWRKMRRIMTVPFFTNKVVAQNRVGWEEEARLVVEDVKADPASATDGVVIRRRLQLMMYNDMFRIMFDRRFQSVDDPLFNKLKALNAERSILSQSFDYNYGDFIPILRPFLRRYLNRCTNLKTKRMKLFEDHFVQDRKKALEQTGEIKCAMDHILEAERKGEINHDNVLYIVENINVAAIETTLWSIEWGIAELVNHPDVQSKLRDEMTAVLGPNVAVTEPDLERLPYLQSVVKETLRLRMAIPLLVPHMNLSDAKLAGYDIPAESKILVNAWFLANDPKRWVKADEFRPERFLEEEKAVEAHGNDFRFVPFGVGRRSCPGIILALPIIGITLGRLVQNFQLLPPPGQDKIDTTEKPGQFSNQILKHATIVCKPLEV

SEQ ID NO: 9787 - protein, 501 aa, Lolium multiflorum
MEVLLLEKALLGLFAAAVLAIAVAKLTGKRFRLPPGPSGAPIVGNWLQVGDDLNHRNLMGIAKRFGEVFLLRMGIRNLVVVSSPELAKEVLHTQGVEFGSRTRNVVFDIFTGNGQDMVFTVYGDHWRKMRRIMTVPFFTNKVVAQNRVGWEEEARLVVEDVKADPASATTGTVIRRRLQLMMYNDMFRIMFDRRFESVDDPLFNKLKAMNAERSILSQSFDYNYGDFIPILRPFLRKYLNRCTNLKTKRMKLFEDHFVADRKKALEQNGEIRCAMDHILEAERKGEINHDNVLYIVENINVAAIETTLWSIEWGIAELVNHPDVQSKLRDEMAAVLGADVAVTEPDLERLPYLQSVVKETLRLRMAIPLLVPHMNLSDAKLAGYDIPAESKILVNAWFLANDPKRWVRADEFRPERFLEEEKAVEAHGNDFRFVPFGVGRRSCPGIVLALPIIGITLGRLVQNFQLLPPPGQDKIDTTEKPGQFSNQILKHATVVCKPLEA

SEQ ID NO: 9788 - protein, 132 aa, Secale cereale
MDVNLLEKALLGLFVAAMLAIAVAKLTGKRFRLPPGPPVPRSWATGSRWVMTSITATSWAWPSASARCSSYAWASATSWSSPVLSSPRRCSTPRASSSAPAPATSSSTSSPAKARTWCSPCTVTTGARCAGS

SEQ ID NO: 9789 - protein, 442 aa, Secale cereale
MGMAKRFGEVFLLRMGVRNLVVVSSPELAKEVLHTQGVEFGSRTRNVVFDIFTGKGQDMVFTVYGDHWRRMRRIMTVPFFTNKVVVQNREGWEEEARLVVEDLKADPASATGVVIRRRLQLMMYNDMFRIMFDRRFESLADPLFNKLRALNAERSMLSQSFDYNYGDFIPILRPFLRGYLNRCTNLKAKRMKVFEDHFVQERKKALEKNGEIRCAMDHILEAERKGEINHDNVLYIVENINVAAIETTLWSIEWGVAELVNHPDIQSKLRHEIAAVLGPDAAVTEPDLERLPYLQAVVKETLRLRMAIPLLVPHMNLKDAKLAGYDIPAESKILVNAWFLANDPKRWVRADEFRPERFLEEERSVEANGNDFRFVPFGVGRRSCPGIILAMPIIGITLGRLVQNFQLLPPLGQDKIDTTEKPGQFSNQIRNHATVVCKPLKA

SEQ ID NO: 9790 - protein, 328 aa, Secale cereale
MDVLLLEKALLGLFAAAVLAIAVAKLTGKRLRLPPALRRPHRRQLAPGRRRPQPPQPDGHGQAVRRGVPPPHGCPQPGGRLQPRARQGGPPHPGRRVRLPHPQRRLRHLYRQRPGHGVHSVRRPLAQDAPDHDGALLHQQGGGAEPRGVGGGGPAGGGGPQSRPGVSHWRGDPPQAAAHDVQRHVPHHVRPPVREPRRPALQQAEGAQRGAQHALAELRLQLRRLHPHPPPLPPRLPQPVHQPQGQEDESLRGPLRPRAQEGVGEERGDQMRHGPHPRGRKEGRDQPRQRPVHRREHQRRSNRDDPVVYRMGSRGAGEPPGHPVKAPP

SEQ ID NO: 9791 - protein, 467 aa, Echinochloa colona
PGPFPVPIFGNWLQVGDDLNHRNLMALAKRFGDIFLLRMGVRNLVVVSTPELAKEVLHTQGVEFGSRTRNVVFDIFTGKGQDMVFTVYGDHWRKMRRIMTVPFFTNKVVAQNRAGWEEEARLVVEDVRRNPKAATEGVVIRRRLQLMMYNDMFRIMFDRRFDSEDDPLFNKLKALNAERSRLSQSFEYNYGDFIPVLRPFLRKYLNRCHDLKTRRMKVFEDNFVEERKKVMAQTGEIRCAMDHILEAERKGEINHDNVLYIVENINVAAIETTLWSIEWGIAELTNHPAIQAKLREEMTSVLGAGVAVTEPDLERLPYLQAVVKETLRLRMAIPLLVPHMNLNDGKLNGYDIPAESKILVNAWFLANDPKRWVKPEEFRPERFLEEEKAVEAHGNDFRFVPFGVGRRSCPGIILALPIIGITLGRLVQNFQLLPPPGQAQVDTTEKPGQFSNQIAKHATIVCKPLEA

SEQ ID NO: 9792 - protein, 501 aa, Festuca arundinacea
MDVNLLEKALLGLFAAAVLAIAVAKLTGKRFKLPPGPSGYPIVGNWLQVGDDLNHRNLMGMAKRFGEVFHLRMGVRNLVVVSSPELAKEVLHTQGVEFGSRTRNAVFDIFTGKGQDMVFTVYGDHWRKMRRIMTVPFFTSKVVAQNRVGWEEEARLVVEDVKADPASATTGVVIRRRLQLMMYNDMFRIMFDRRFESLADPLFNKLRALNAERSILSQSFDYNYGDFIPFLRPFLRGYLNRCTNLKTKRMKVFEDDFVTPRKKALEQSGEIKCAMDHILEAERKGEINHDNVLYIVENINVAAIETTLWSIEWGIAELVNHPEVQSKLRNEIAAVLGPNVAVTEPDLERLPYLQSVVKETLRLRMAIPLLVPHMNLNQAKLAGYDIPAESKILVNAWFLANDPKRWVRADEFRPERFLEEEKAVQAHGNDFRFVPFGVGRRNCPGIILALPIIGITLGNMVQNFNLLPPPGQDKIDTTEKPGQFSNQIRTHANVVCKPLKA

SEQ ID NO: 9793 - protein, 477 aa, Avena sativa
MDVLLLEKALLGLFAAAVLAIAVAKLTGKRFRLPPGPSGAPIVGNWLQVGDDLNHRNLMGLAKRFGEVFLLRMGIRNLVVVSSPELAKEVLHTQGVEFGSRTRNVVFDIFTGNGQDMVFTVYGDHWRKMRRIMTVPFFTNKVVAQNRVGWEEEARLVVEDVKADPASATDGVVIRRRLQLMMYNDMFRIMFDRRFQSVDDPLFNKLKALNAERSILSQSFDYNYGDFIPILRPFLRRYLNRCTNLKTKRMKLFEDHFVQDRKKALEQTGEIKCAMDHILEAERKGEINHDNVLYIVENINVAAIETTLWSIEWGIAELVNHPDVQSKLRDEMTAVLGANVAVTEPDLERLPYLQSVVKETLRLRMAIPLLVPHMNLSDAKLAGYDIPAESKILVNAWFLANDPKRWVKADEFRPERFLEEEKAVEAHGNDFRFVPFGVGRRSCPGIILALPIIGITLGRLVQNFQLLPPPGQDKIDT

SEQ ID NO: 9794 - protein, 442 aa, Panicum virgatum
DLAKRFGDIFLLRMGVRNLVVVSTPELAKEVLHTQGVEFGSRTRNVVFDIFTGKGQDMVFTVYGDHWRKMRRIMTVPFFTNKVVVQNRAGWEEEARLVVEDVRRDPRAAAEGVVIRKRLQLMMYNDMFRIMFDRRFESEQDSLFNKLKALNAERSRLSQSFEYNYGDFIPVLRPFLRGYLNRCHDLKTRRMKVFEDNFVQERKKVMAQTGEIRCAMDHILEAERKGEINHDNVLYIVENINVAAIETTLWSIEWGIAELVNHPTIQSKLREEITSVLGAGVAVTEPDLERLPYLQAVVKETLRLRMAIPLLVPHMNLNDGKLHGYDIPAESKILVNAWFLANDPKRWVKPEEFRPERFLEEEKAVEAHGNDFRFVPFGVGRRSCPGIILALPIIGITLGRLVQNFQLLPPPGQDKVDTTEKPGQFSNQIAKHATIVCKPLEA

SEQ ID NO: 9795 - protein, 474 aa, Avena sativa
GKRFRLPPGPSGAPIVGNWLQVGDDLNHRNLMGMAKRFGEVFLLRMGIRNLVVVSSPELAKEVLHTQGVEFGSRTRNVVFDIFTGNGQDMVFTVYGDHWRKMRRIMTVPFFTNKVVAQNRVGWEEEARLVVEDVKADPASATDGVVIRRRLQLMMYNDMFRIMFDRRFQSVDDPLFNKLKALNAERSILSQSFDYNYGDFIPILRPFLRRYLNRCTNLKTKRMKLFEDHFVQDRKKALEQTGEIKCAMDHILEAERKGEINHDNVLYIVENINVAAIETTLWSIEWGIAELVNHPDVQSKLRDEMTAVLGPNVAVTEPDLERLPYLQSVVKETLRLRMAIPLLVPHMNLSDAKLAGYDIPAESKILVNAWFLANDPKRWVKADEFRPERFLEEEKAVEAHGNDFRFVPFGVGRRSCPGIILALPIIGITLGHLVQNFELLPPPGQDKIDTTEKPGQFSNQILKHATIVCKPLEV

SEQ ID NO: 9796 - protein, 475 aa, Festuca arundinacea
ARGRFRLPPGPSGAPIVGNWLQVGDDLNHRNLMGIAKRFGEVFLLRMGIRNLVVVSSPELAKEVLHTQGVEFGSRTRNVVFDIFTGNGQDMVFTVYGDHWRKMRRIMTVPFFTNKVVAQNRVGWEEEARLVVEDVKADPASATAGTVIRRRLQLMMYNDMFRIMFDRRFESVDDPLFNKLKALNAERSILSQSFDYNYGDFIPILRPFLRKYLNRCTNLKTKRMKLFEDHFVADRKKALEQNGEIRCAMDHILEAERKGEINHDNVLYIVENINVAAIETTLWSIEWGIAELVNHPDVQSKLRDEMAAVLGPDVAVTEPDLERLPYLQSVVKETLRLRMAIPLLVPHMNLSDAKLAGYDIPAESKILVNAWFLANDPKRWVRADEFRPERFLEEEKAVEAHGNDFRFVPFGVGRRSCPGIILALPIIGITLGSLVQNFQLLPPPGQDKIDTTEKPGQFSNQILKHATVVCKPLEA

SEQ ID NO: 9797 - protein, 97 aa, Secale cereale
GAPGAPIVGNWLQVGDDLNHRNLMGMAKRFGEVFLLRMGVRNLVVVSSPELAKECSTPRASSSAPAPATSSSTSLPAKARTWCSQCTATTGARCAGS

SEQ ID NO: 9798 - protein, 518 aa, Secale cereale
SPTGSTTGAPHRTYPGRDGRPPPGEGPPGPLRRGGARHRRRQAHRQAPPAPPGPSGAPIVGNWLQVGDDLNHRNLMDMAKRFGEVFLLRMGVRNLVVVSSPELAKEVLHTQGVEFGSRTRNVVFDIFTGKGQDMVFTVYGDHWRKMRRIMTVPFFTNKVVAQNRVGWEEEARLVVEDLKANPASATEGVVVRRRLQLMMYNDMFRIMFDRRFESVDDPLFNKLKALNAERSILSQSFDYNYGDFIPVLRPFLRRYLNRCTNLKTKRMKVFEDHFVQQRKEALEKTGEIRCAMDHILEAERKGEINHDNVLYIVENINVAAIETTLWSIEWGIAELVNHPEIQQKLREEIVAVLGPGTAVTEPDLERLPYLQSVVKETLRLRMAIPLLVPHMNLSDAKLAGYDIPAESKILVNAWFLANDPKRWVRADEFRPERFLEEEKAVEAHGNDFRFVPFGVGRRSCPGIILALPIIGITLGRLVQNFQLLPPPGQDKIDTTEKPGQFSNQILKHATIVCKPLEA

SEQ ID NO: 9799 - protein, 419 aa, Saccharum officinarum
GSELAKEVLHTQGVEFGSRTRNVVFEIFTGKGQDMVFTVYGDHWRKMRRIMTVPFFTNKVVAQNRAGWEEEARLVVEDVRRDPRAAAEGVVIRKRLQLMMYNDMFRIMFDRRFESEEDPLFNKLKALNAERSRLSQSFEYNYGDFIPVLRPFLRGYLNRCHDLKKRRMKVFEDNFVQERKKVMAQTGEIRCAMDHILEAERKGEINHDNVLYIVENINVAAIETTLWSIEWGVAELVNHPAIQSKLREELASVLGAGVPVTEPDLERLPYLQAIVKETLRLRMAIPLLVPHMNLNDGKLVGYDIPAESKILVNAWFLANDPKRWVRPDEFRPERFLEEEKTVEAHGNDFRFVPFGVGRRSCPGIILALPIIGITLGRLVQNFQLLPPPGQDKIDTTEKPGQFSNQIAKHATIVCKPLEA

SEQ ID NO: 9800 - protein, 226 aa, Echinochloa colona
MAASTALSTAANPTQLCRPLGASSLGKPVKGLGLGRERAQRSSITCQAASISADRVPDMEKRKLMNLLLLGAISLPTVGMVVPYGAFFVPAGSGGAGGGTYAKDKLGNDIKVEDWLNTHGPNDRTLAQGLRGDPTYLVVEQDKTLATYGINAVCTHLGCVVPWNSAENKFICPCHGSQYNNQGRVVRGPAPLSLALVHADVDDGKVLFVPWVETDFRTGEDPWWKA

SEQ ID NO: 9801 - protein, 227 aa, Echinochloa colona
MAASTALSTAANPTQLCRPRGASSLAKPVKGLGLGRERAQRSSITCQAASSISADRVPDMEKRKLMNLLLLGAISLPTVGMVVPYGAFFVPAGSGGSGGGTYAKDKLGNDIKVEDWLNTHGPNDRTLAQGLRGDPTYLVVEQDKTLATYGINAVCTHLGCVVPWNSAENKFICPCHGSQYNNQGRVVRGPAPLSLALVHADVDDGKVLFVPWVETDFRTGEDPWWKA

SEQ ID NO: 9802 - protein, 228 aa, Echinochloa colona
MAASTALSTAANPTQLCRPLGASSLGKPVKGLGLGRERAQRSSSITCQAASSIPADRVPDMEKRKLMNLLLLGAISLPTVGMVVPYGAFFVPAGSGGAGGGTYAKDKLGNDIKVEDWLNTHGPNDRTLAQGLRGDPTYLVVEQDKTLATYGINAVCTHLGCVVPWNSAENKFICPCHGSQYNNQGRVVRGPAPLSLALVHADVDDGKVLFVPWVETDFRTGEDPWWKA

SEQ ID NO: 9803 - protein, 224 aa, Setaria italica
MAASTALSTAANPTQLCRPRAASSLGKPVKGLGLGMGRRSITCQAASSIPADRVPDMEKRKLMNLLLLGAISLPTVGMVVPYGAFFIPAGSGSAGGGTYAKDKLGNDIKVDEWLKTHGPNDRTLAQGLKGDPTYLVVEQDKTLATYGINAVCTHLGCVVPWNSAENKFICPCHGSQYNNQGRVVRGPAPLSLALVHADVDDGKVLFVPWVETDFRTGEDPWWKA

SEQ ID NO: 9804 - protein, 335 aa, Pennisetum glaucum
MHMQTFFDSGTLKPYCFIEINGLKLASPENIYKVIYEQLSGHRVGWKKALHYLTEHFSGVSKIGKQANQPIILLIDELDLLLTRNQSVLYNILDWPTKPNSNLVVIGIANTMDLPEKLLPRISSRMGIQRLCFGPYNFRQLQEIITSRLKGIDAFEDQAIEFASRKVAAMSGDARRALEICRRAAEFADYRIKQSQQSGKTCANKGDGVVCMGDIEAAIQEVFQAPHIQVMRNCPKFGKVILVAMVHELYKSGLGEVTFEKLAATVLSWCHVNRELLPGYDTLMKICCKLGESKVILSEEGSKHKLQKLQLNYPSDDITFALKESPDLPWLSKYL

SEQ ID NO: 9805 - protein, 231 aa, Panicum virgatum
MAASTALSTSANPTQLCRPRASPNKPAKGLGLGTGRDRFSQRSSGGGVTCQAASSIPADRVPDMEKRKLMNLLLLGAISLPTAGMLVPYGSFFIPAGSGGAGGGTYAKDKLGNDIKVEEWLQTHGPNDRTLAQGLKGDPTYLVVEQDKTLATYGINAVCTHLGCVVPWNSAENKFICPCHGSQYNNQGKVVRGPAPLSLALVHADVDDGKVLFVPWVETDFRTGEDPWWKA

SEQ ID NO: 9806 - protein, 223 aa, Cynodon dactylon
MAASTALSTAANPTQLCRSRSSLGKPVKGLGFGRERALRTVTCQAGSITADRVPDMEKRKLMNLLLLGAISLPVGGMVLPYGAFFVPGGSGSGGGGVYAKDKLGNDVKIDEWLKTHGPNDRTLTQGLKGDPTYLVVEQDKTLATYGINAVCTHLGCVVPWNAAENKFMCPCHGSQYNNQGKVVRGPAPLSLALVHADVDDGKVLFVPWVETDFRTGEDPWWKA

SEQ ID NO: 9807 - protein, 232 aa, Panicum virgatum
MAASTALSTAANPTQLCRPRASPNKPAVKGLGLGTGRDRFSQRRSSSSVTCQAASSIPADRVPDMEKRKLMNLLLLGAISLPTAGMLVPYGSFFIPAGSGGAGDGTYAKDKLGNDIKLEEWLQTHGPNDRTLAQGLKGDPTYLVVEQDKTLASYGINAVCTHLGCVVPWNGAENKFICPCHGSQYNNQGKVVRGPAPLSLALVHVDVDDGKVLFVPWVETDFRTGEDPWWKA

SEQ ID NO: 9808 - protein, 225 aa, Oryza sativa
MASTALSTASNPTQLCRSRASLGKPVKGLGFGRERVPRTATTITCQAASSIPADRVPDMGKRQLMNLLLLGAISLPTVGMLVPYGAFFIPAGSGNAGGGQVAKDKLGNDVLAEEWLKTHGPNDRTLTQGLKGDPTYLVVEADKTLATYGINAVCTHLGCVVPWNAAENKFICPCHGSQYNNQGRVVRGPAPLSLALVHADVDDGKVLFVPWVETDFRTGDNPWWA

SEQ ID NO: 9809 - protein, 222 aa, Hordeum vulgare
  Sequence also found in Organisms: Pseudoroegneria spicata
MASTALSTASNPTQLCRTRASSLCKPVKGLGFGRERIPRNITCMAGSISADRVPDMSKRELMNLLLLGAISLPTFGMLVPYGSFLVPAGSGSNAGGVAAKDKLGNDILVEDWLKTHGPNDRTLAQGLKGDPTYLVVESDKTLATYGINAVCTHLGCVVPWNAAENKFLCPCHGSQYNNQGKVVRGPAPLSLALVHADVDDGKVVFVPWVETDFRTGENPWWK

SEQ ID NO: 9810 - protein, 222 aa, Leymus cinereus x Leymus triticoides
MASTALSTASNPTQLCRTRASSLCKPVKGLGFGRERVPRNTTCMAGSISADRVPDMSKRELMNLLLLGAISLPTFGMLVPYGSFLVPAGSGSNAGGVAAKDKLGNDILVEDWLKTHGPNDRTLAQGLKGDPTYLVVESDKTLATYGINAVCTHLGCVVPWNAAENKFLCPCHGSQYNNQGKVVRGPAPLSLALVHADVDDGKVVFVPWVETDFRTGENPWWK

SEQ ID NO: 9811 - protein, 222 aa, Secale cereale
MASTALSTASNPTQLCRTRASSLCKPVKGLGFGRERIPRNITCMAGSISADRVPDMSKRELMNLLLLGAISLPTFGMLVPYGSFLVPAGSGSNAGGVAAKDKLGNDILVEDWLKTHGPNDRTLAQGLKGDPTYLVVESDKTLATYGINAVCTHLGCVVPWNAAENKFLCPCHGSQYNNQGKVVRGPAPLSLALVHADIDDGKVVFVPWVETDFRTGENPWWK

SEQ ID NO: 9812 - protein, 222 aa, Triticum aestivum
MASTALSTASNPTQLCRTRASSLCKPVKGLGFGRERVPRNITCMAGSISADRVPDMSKRELMNLLLLGAISLPTFGMLVPYGSFLVPAGSGSNAGGVAAKDKLGNDILVEDWLKTHGPNDRTLAQGLKGDPTYLVVESDKTLATYGINAVCTHLGCVVPWNAAENKFLCPCHGSQYNNQGKVVRGPAPLSLALVHADVDDGKVVFVPWVETDFRTGDNPWWK

SEQ ID NO: 9813 - protein, 222 aa, Triticum aestivum
MASTALSTASNPTQLCRTRASALCKPVKGLGFGRERVPRNITCMAGSISADRVPDMSKRELMNLLLLGAISLPTFGMLVPYGSFLVPAGSGSNAGGVAAKDKLGNDILVEDWLKTHGPNDRTLAQGLKGDPTYLVVESDKTLATYGINAVCTHLGCVVPWNAAENKFLCPCHGSQYNNQGKVVRGPAPLSLALVHADVDDGKVVFVPWVETDFRTGDNPWWK

SEQ ID NO: 9814 - protein, 222 aa, Avena sativa
MASTALSTASNPTQLCRTRASSLCKPVKGLGFGRERVPRNITCMAGSISADRVPDMSKRELMNLLLLGAISPPHLRHARPLRLLPRPGRLREQRRRGRRQGQARQRHPRRGLAQDARPNDRTLAQGLKGDPTYLVVESDKTLATYGINAVCTHLGCVVPWNAAENKFLCPCHGSQYNNQGKVVRGPAPLSLALVHADVDDGKVVFVPWVETDFRTGDNPWWK

SEQ ID NO: 9815 - protein, 221 aa, Festuca arundinacea
  Sequence also found in Organisms: Lolium multiflorum
MASTALSTASNPTQLCRSRASPCKPVKGLGIGRERVPRNITCMAGSISADRVPDMSKRETMNLLLLGAISLPTFGMLVPYGSFLVPAGSGSNAGGVVAKDKLGNDIRVEDWLKTHGPNDRTLAQGLKGDPTYLVVESDKTLATYGVNAVCTHLGCVVPWNAAENKFLCPCHGSQYNNQGKVVRGPAPLSLALVHADVDDGKVVFVPWTETDFRTGENPWWK

SEQ ID NO: 9816 - protein, 221 aa, Brachypodium distachyon
MASTALSTASNPTRLCRPLPSLGKPVRGLGFARERIPRNITCMAGSISADRVPDMSKRELMNLLLLGAISLPTFGMLVPYGSFLVPAGSGSNTGGTVAKDKLGNDILVEEWLKTHGPNDRTLAQGLKGDPTYLVVEADKTLATYGINAVCTHLGCVVPFNTAENKFLCPCHGSQYNNQGKVVRGPAPLSLALVHADVDDGKVVFVPWVETDFRTGENPWWK

SEQ ID NO: 9817 - protein, 268 aa, Gossypium raimondii
MATTEVSPMDQNPTPPKQPSFQQHYPPDFPRKVFAETIATYLLVFVTCGSAAICSVDEHKISRLGASVAGGLIVTVMIYAVGHVSGAHMNPAVTLAFAAVRHFPWKQVPFYGAAQLTGAISASFTLRVLLHPIKHAGTTSPSGSDLQALIMEIVVTFSMMFITSAVATDTKAIGELAGIAVGSAVCITSILAGPISGGSMNPARSIGPAIASGEYKGIWVYVVGPVTGTLMGAWSYNLIRMTDKPHHAISPRSSSFKLRRMNNQDGEV

SEQ ID NO: 9818 - protein, 285 aa, Theobroma cacao
MATTDHRNEIVPVDQTPTPQRPDIVRNSFLQHYPPDFPRKVFAEVIATYLLVFVTCGSAAVSSTDENKISRLGASVAGGLIVTVMIYAVGHVSGAHMNPAVTVAFAAVRHFPWKQVPFYAAAQFTGSISASFTLRVLLHPIKLLGTTSPSGSDVQALVMEMVVTFSMMFVTSAVATDTKAVGELAGMAVGSAVCITSILAGPISGGSMNPARTIGPALASAHYKAIWVYVVGPVTGTLMGAWSYSRIRATDKPGQAISPQSSSFKLRRMRGQDGELPNKDPFDDL

SEQ ID NO: 9819 - protein, 574 aa, Brachypodium distachyon
MLCRRPLAAAAALHLAPLSPPLLLFFASSSSSASCSPAAAAAAATPASGHRGCSAVRMDTGAVEPASTGTIWSTPSVEPRSISIGKQIFCNRSLNMRNITAVGFDMDYTLAQYKPETFESLAYHGTIEKLVKDLNYPQELLTWQFDWKYMVRGLVLDKKRGNILKMDRHKYVKVAYHGFREMSKEEKVAAYGNTLIRDSFDEPDYALIDTLFSLGEAYLFAQLVDFMDNNPGKVPSGIDYALMYKDVRSAVDLCHRDGTLKRMVAMEPGRYINEDLAIVPMLEMLRKSGRSTFLVTNSLWDYTDVVMNYLCGPYISDVSSNHNRKWLEYFDVVITGSSKPSFFHDDNRTGLFEVEPDSGKLLNADLQIGSPRSSQHQSKPIHKVYQGGNVGHLHRLLSVASSSQILYVGDHIYGDILRSKKVLGWRTMLVIPELEQEVKLLSESKSTRKELRHLRMERDSIEDTIHRLEWSLQFEDLTENRKEKLFSEHDILLQKLKGIRCVLRDAQLQHHQKFHKVWGQLMKTGYQNSRFAHQVERFACLYCSQVTNFGLYSPNKYYRPSEDYMPHEFDVLGL

SEQ ID NO: 9820 - protein, 570 aa, Avena sativa
MLSRRPLAAALRLAPLSPPLLLFLASSSSSSSSSCSPAASAPASSPRGCSAVRMDTGAVEPASTGTIWSTPSAELGSISIGKQIFCNRSLNMRNITAVGFDMDYTLAQYKPETFEALAYHGTIEKLVKDLNYPEELLTWQFDWKYMVRGLVLDKKRGNILKMDRHKYVKVAYHGFREMSKEEKVAAYGSTLIRDSFDEPDYALIDTLFSLGEAYLFAQLVDFMDSNPGKVPSGTDYALMYRDVRSAVDLCHRDGTLKRMVAKEPSRYINEDLAIVPMLEMLRKSGRSTFLVTNSLWDYTDVVMNYLCGPYISDLGSNHKQKWLEYFDVVITGSSKPSFFHDDNRAGLFEVEPHSGKLLNADLQVGSPRSSQPLPKPIRKVYQGGNVGHLHRLLSVASSSQILYVGDHIYGDILRSKKVLGWRTMLVIPELEQEVKLLSESKSTRKELRRLRMERDSIEDRIHRLEWSLQFENLAENDKEKLLSEHANLLQKLKGIRCVLRDAQLQHHQKFHKVWGQLMKTGYQNSRFAHQVERFACLYCSQVTNFGLYSPNKYYRPSEDYMPHEFDVLGL

SEQ ID NO: 9821 - protein, 637 aa, Oryza sativa
MLFARRPLATAASHLAPFSPPLLLFFASASSSCSSAASPSSASGPRGCSAVRMETGAVEPASTGAIWSTPSVESRTISVGKEIFCNRSLNMRNITAVGFDMDYTLAQYKPETFEALAYHGTIEKLVKDLGYPEELLTWQFDWKYMVRGLVLDKKRGNILKMDRHKYVKVAYHGFREMSKEEKVSAYGSTLIRDSFDEPDYALIDTLFSLGEAYLFAQLVDFMDNNPGKVPSGTDYPLMYRDVRSAVDLCHRDGTLKRMVAKDPSRYINEDLAIVPMLEMIRKSGRSTFLVTNSLWDYTDVVMNYLCRPYTSDVSSSHNHKWLGYFDVVITGSAKPGFFHDGNRAGLFEVEPDSGKLLNADLHIGSPRSGQQPSRPIHKIYQGGNVGHLHRLLSVASSSQILYVGDHIYGDILRSKKVLGWRTMLVIPELEQEVKLLSESKSTRKELRHLRMERDSIEDKIHRLEWSLKFENLTEDEKEKLFSEHDILLQKKEHVRRLHQEAQRQHHHKFHKVWGQLMKTGYQNSRFAHQVERFACLYSSQVTNFALYSPNKYYRPSEDYMPHEFDVLGLQPVHFIPGSPGLRGQMGQTLVQLPQTGPTNRLRVLSRPHPNAQLGPSATAMQGHIRTYMGAGKPTRFK

SEQ ID NO: 9822 - protein, 524 aa, Festuca arundinacea
GTRSTLRMDTAAVEAASTGAIWSTPSAEPRSISIGKQIFCNRSLNMRNITAVGFDMDYTLAQYKPETFEALAYNGTIEKLVKDLNYPEELLTWQFDWKYMVRGLVLDKKRGNILKMDRHKYVKVAYHGFREMSKEEKVAAYGSTLIRDSFDEPDYALIDTLFSLGEAYLFAQLVDFMDINPGKVPSGTDYALMYRDVRSAVDLCHRDGTLKRMVAKEPGRYINEDLAIVPMLEMLRKSGRSTFLVTNSLWDYTDVVMNYLCGPYISDLGSSHKQKWLEYFDVVITGSSKPSFFHDDNRTGLFEVEPHSGKLLNADLQIGSPRSSQHQPKPIHKVYQGGNVGHLHRLLSIASSSQILYVGDHIYGDILRSKKVLGWRTMLVIPELEQEVKLLSESKSTRKELRQLRMERDSVEDRIHRLEWSLQFENLAENEKEKLLTEHANLLQKLKGIRCLLRDAQLQHHQKFHKVWGQLMKTGYQNSRFAHQVERFACLYCSQVTNFGLYSPNKYYRPSEDYMPHEFDVLGL

SEQ ID NO: 9823 - protein, 567 aa, Sorghum bicolor
MLFSRRPLAAALHLAPLSPPLLLLFASASSSCSPAAAASASGSRGCTAVRMDSGAVETASTGAVWSTPSAEPRSISVGKEVFCNRSLNMRNITAVGFDMDYTLAQYKPETFEALAYYGTIEKLVKDLRYPEELLTWEFDWKYMVRGLVLDKKRGNILKMDRHKYVKVAYHGFKELSKEEKVAAYGSTLIRDSFDEPDYALIDTLFSLGEAYLFAQLVDFMDKNPGKVPAGTDYPLMYRDVRSAVDLCHRDGTLKRMVAKDPARYINEDLAIVPMLEMIRKSGRSTFLVTNSLWDYTDVVMNYLCGPYTSDVGSGLNHKWLQYFDIVITGSSKPSFFHDDNRAGLFEVEPDSGKLLNADIQIGSPRSSHQHSTPVQKVYQGGNVGHLHRLLSVASSSQILYVGDHIYGDILRSKKVLGWRTMLVIPELEQEVKLLSESKSTRKELRHLRMKRDSIEDRIHHLEWSLKLDDVTENQKEKLFSEHDNLLKQREHVRRLHQEAQRQHHQKFHKVWGQLMKTGYQNSRFAHQVERFACLYSSQVTNFGLYSPNKYYRPSEDYMPHEFDVLGL

SEQ ID NO: 9824 - protein, 567 aa, Setaria italica
MLFARRPLSAALHLAPLSPPLLLFFASASSSCSPAAASASGGTRGCSAVRMDSGAVETTSTGAVWSTPSAEPRSVSIGKAIFCNRSLNMRNITAVGFDMDYTLAQYKPETFEALAYYGTIEKLVKDLHYPEELLTWEFDWKYMVRGLVLDKKRGNILKMDRHKYVKVAYHGFRELSKEEKVAAYGSTLIRDSFDEPDYALIDTLFSLGEAYLFAQLVDFMDNNPGKVPAGTDYPLMYKDVRSAVDLCHRDGTLKRMVAKEPGRYINEDLAIVPMLEMIKKSGRSTFLVTNSLWDYTDVVMNYLCGAYTSDAGSGLNHKWLQYFDIVITGSSKPSFFHDDNRAGLFEVEPDSGKLLNADIQIGSPRSSHQHATPVHKVYQGGNVGHLHRLLSIASSSQILYVGDHIYGDILRSKKVLGWRTMLVIPELEHEVKLLSESKSTRKELRHLRMERDSIEDRIHHLEWSLKFDDITENQKEKLFSEHVDLLQQREHVRRLHQEAQRQHHQKFHKVWGQLMKTGYQNSRFAHQVERFACLYSSQVTNFGLYSPNKYYRPSEDYMPHEFDVLGL

SEQ ID NO: 9825 - protein, 570 aa, Zea mays
MLFSRRPLAAAFHLAPLSPPLLLFFASASSSCSPAASAAAASVSGSRGCTAARMDSGAVETASTGAVWSSPSAEPRSISVGKEVFCNRSLNMRNITAVGFDMDYTLAQYKPETFESLAYYGTIEKLVKDLRYPEELLTWEFDWKYMVRGLVLDKKRGNILKMDRHKYVKVAYHGFKELSKEEKVAAYGSTLIRDSFDEPDYALIDTLFSLGEAYLFAQLVDFIDKNPGKVPAGTDYPLMYRDVRSAVDLCHRDGTLKRMVAKDPARYINEDLAIVPMLEMIRKSGRSTFLVTNSLWDYTDVVMNYLCGPYTSGVGSGLNHKWLQYFDIVITGSSKPSFFHDDNRAGLFEVEPDSGKLLNADIQIGSPRSSHQHSTPVQKVYQGGNVGHLHRLLSVASSSQILYVGDHIYGDILRSKKVLGWRTMLVIPELEQELKLLSESKSTRKELRHLRMERDSIEDKIHHLEWSLKLDDISENQKEKLFSEHDNLLKQRGHVRGLHQEAQRQHHQKFHKVWGQLMKTGYQNSRFAHQVERFACLYSSQVTNFGLYSPDKYYRPSEDYMPHEFDVLGL

SEQ ID NO: 9826 - protein, 479 aa, Triticum aestivum
MRNITAVGFDMDYTLAQYKPETFEALAYHGTIEKLVKDLNYPEELLTWQFDWKYMVRGLVLDKKRGNILKMDRHKYVKVAYHGFREMSKEEKVAAYGSTLIRDSFDEPDYALIDTLFSLGEAYLFAQLVDFMDSNPAKVPSGTDYAHMYRDVRSAVDLCHRDGTLKRMVAKEPSRYINEDLAIVPMLQMLRKSGRSTFLVTNSLWDYTDVVMNYLCGPYMSDVSSSHNHKWLEYFDVVITGSSKPSFFHDDNRTGLFEVEPDSGKLLNADLQIGSPRSSQHQPKPIHKVYQGGNVGHLHRLLSVASSSQILYVGDHIYGDILRSKKVLGWRTMLVIPELEQEVKLQSESKSTRKELRHLRMERDSVEDTIHRLEWSLQFEDLTENEKGKLLSEHDNLLQKLKGIRCLLRDAQMQHHQKFHKVWGQLMKTGYQNSRFAHQVERFACLYCSQVTDFGLYSPNKYYRPSEDYMPHEFDVLGL

SEQ ID NO: 9827 - protein, 216 aa, Brassica oleracea
MAGYKVEDDYDYLFKVVLIGDSGVGKSNLLSRFTKNEFNLESKSTIGVEFATRTLKVDDKVVKAQIWDTAGQERYRAITSAYYRGAVGALLVYDTTRRATFENVDRWLKELKNHTDPNIVVMLVGNKSDLRHLLAVPTEDGKSYAEQESLCFMETSALEATNVEDAFAEVLTQIYRITSKKQVEAGEDANGSVPKGEKIEVKNDVSALKKLGCCSN

SEQ ID NO: 9828 - protein, 569 aa, Brassica oleracea
MDLTTTRQRRPLLTGSSSSSPKPYSKTDKPGRSDGGDAEDRGLGWFLPFIALCYLRYMSATSNIVHDCDEVFNYWEPLHYLLYKSGFQTWEYSSNFALRSYLYILFHELAGRPAAWWFGDDKVRVFYAVRLFLGLVSAVSDTVLVVAISRKYGKRLGTYAVAMLCLTSGCFFASTSFLPSSFSMYAMSLSSGLLLFEKYAMAVAVSVVGVILGWPFSILAFLPVVIYSLVKRFKQAFISGAVTSILLLGGSVLVDYYYYKRWTSSVLNLLVYNVLGGGESHLYGTEGPLFYIRNGFNNFNLCFVLAILFIALYPVIRRKYDRCLLVVISPMYIWLAFMSLQPHKEERFLYPIYPLICVSASAVIENIPELFREKYSTRENLLVTITKYLRPVILGIILCASHARTFSIINGYSAPLEVYKLLEHHDDAGPGSVLCVGSEWHRYPSSFFVPDYISEVRWIDDGFRGLLPFPFNNTLGGTAASPPYFNNKNQASDEQFLKNIESCTFLIELQLSRPYPYRGSDLSTWETIVVLPYLDRELSPAKYRSFFIPYKWQEKNVFGKYVILRRVPK

SEQ ID NO: 9829 - protein, 224 aa, Setaria italica
MWPNTSFATTSKAQKYWHYGGAETEDLIKASVRPLVCRCPFALSFDPSSRPPLQAPPPPRPRGRNPARLGAMANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSDNIAKHWKSNEAEAVETAKEWTRLYASGA

SEQ ID NO: 9830 - protein, 153 aa, Brachypodium distachyon
  Sequence also found in Organisms: Cenchrus ciliaris, Echinochloa colona, Festuca arundinacea, Setaria italica, Lolium multiflorum
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSDNIAKHWKSNEAEAVETAKEWTRLYASGA

SEQ ID NO: 9831 - protein, 153 aa, Arabidopsis thaliana
  Sequence also found in Organisms: Solanum lycopersicum, Arabidopsis lyrata, Vitis vinifera, Capsicum annuum, Raphanus sativus
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 9832 - protein, 153 aa, Brassica oleracea
MANSNLPRRIIKETQRLLSEPAPGISASPSEENMRYFNVMVLGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 9833 - protein, 153 aa, Brassica oleracea
MANSNLPRRIIKETQRLLSEPAPGISASPSEENMRYFNVMVLGPSQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 9834 - protein, 153 aa, Castanea mollissima
MANSNLPRRIIKETQRLLSEPAPGISASPSEDNMRYFNVMILGPAQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYASGA

SEQ ID NO: 9835 - protein, 153 aa, Glycine max
  Sequence also found in Organisms: Arabidopsis lyrata, Chrysanthemum coronarium, Cichorium intybus, Trifolium pratense, Cynara scolymus, Gossypium raimondii, Medicago truncatula, Arachis hypogaea, Euphorbia esula, Vicia sativa
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 9836 - protein, 153 aa, Cichorium intybus
MANSNLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 9837 - protein, 153 aa, Oryza sativa
  Sequence also found in Organisms: Setaria italica
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSDNIAKHWKANEAEAVETAKEWTRLYASGA

SEQ ID NO: 9838 - protein, 153 aa, Brachypodium distachyon
MANSNLPRRIIKETQRLLSEPAPGISASPSEENMRYFNVMVLGPAQSPYEGGVFKLELFLPEEYPMAAPKVRFLTKIYHPNIDKLGRICLDILKDKWSPALQIRTVLLSIQALLSAPNPDDPLSENVAKHWKSNEAEAVETAKEWTRLYASGA

SEQ ID NO: 9839 - protein, 153 aa, Cenchrus ciliaris
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSDNIAKHWKSNEAEAVETAKEWTRMYASGA

SEQ ID NO: 9840 - protein, 153 aa, Lolium multiflorum
MANSNLPRRIIKETQRLLSEPAPGISASPSEENMRYFNVMVLGPAQSPYEGGVFKLELFLPEEYPMAAPKVRFLTKIYHPNIDKLGRICLDILKDKWSPALQIRTVLLSIQALLSAPNPDDPLSDNIAKHWKSNEAEAVETAKEWTRLYASGA

SEQ ID NO: 9841 - protein, 153 aa, Lupinus angustifolius
MANANLPRRIIKETQRLLSEPAPGISASPSEENMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 9842 - protein, 153 aa, Glycine max
  Sequence also found in Organisms: Lupinus angustifolius
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTQLYASGA

SEQ ID NO: 9843 - protein, 153 aa, Eutrema halophilum
  Sequence also found in Organisms: Eutrema parvulum
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVDTAKEWTRLYASGA

SEQ ID NO: 9844 - protein, 153 aa, Triphysaria pusilla
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNETEAVETAKEWTRLYASGA

SEQ ID NO: 9845 - protein, 153 aa, Mesembryanthemum crystallinum
MANSNLPRRIIKETQRLLSEPAPGISASPSEENMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKANEAEAVETAKEWTRLYASGA

SEQ ID NO: 9846 - protein, 153 aa, Zea mays
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSDNIAKHWKSNEVEAVETAKEWTRLYASGA

SEQ ID NO: 9847 - protein, 153 aa, Zea mays
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSDNIAKHWKSNEAEAVETAKEWTRLYTSGA

SEQ ID NO: 9848 - protein, 153 aa, Glycine max
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGV

SEQ ID NO: 9849 - protein, 153 aa, Allium cepa
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKANEAEAVETAKEWTRLYASGA

SEQ ID NO: 9850 - protein, 154 aa, Zea mays
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSDNIAKHWKSNEAEAFETAKEWTRLYASGAL

SEQ ID NO: 9851 - protein, 153 aa, Musa acuminata
  Sequence also found in Organisms: Theobroma cacao, Ricinus communis, Castanea mollissima, Panax ginseng, Gossypium raimondii, Vitis vinifera, Petroselinum crispum, Juglans hindsii x Juglans regia
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYASGA

SEQ ID NO: 9852 - protein, 153 aa, Daucus carota
MANSNLPRRIIKETQRLLSEPAPGISASPSEENMRYFNVMILGPSQSPYEGGVYKLELFLPEEYPMAAPKVRFLTKIYHPNIDKLGRICLDILKDKWSPALQIRTVLLSIQALLSAPNPDDPLSENIAKHWKSNETEAVETAKEWTRLYASGA

SEQ ID NO: 9853 - protein, 153 aa, Cyclamen graecum
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYATGA

SEQ ID NO: 9854 - protein, 153 aa, Echinochloa colona
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSDNIAKHWKANEAEAVETAKEWTRVYASGA

SEQ ID NO: 9855 - protein, 153 aa, Festuca arundinacea
  Sequence also found in Organisms: Avena sativa
MANSNLPRRIIKETQRLLSEPAPGISASPSEENMRYFNVMVLGPAQSPYEGGVFKLELFLPEEYPMAAPKVRFLTKIYHPNIDKLGRICLDILKDKWSPALQIRTVLLSIQALLSAPNPDDPLSENVAKHWKSNEAEAVETAKEWTRVYASGA

SEQ ID NO: 9856 - protein, 153 aa, Petroselinum crispum
MANSNLPRRIIKETQRLLSEPAPGISASPSEENMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKTNETEAVETAKEWTRLYASGA

SEQ ID NO: 9857 - protein, 153 aa, Capsicum annuum
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKANEAEAVETAKEWTRLYASGA

SEQ ID NO: 9858 - protein, 153 aa, Echinacea purpurea
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLFSIQALLSAPNPDDPLSENIAKHWKSNEAEAVETAKEWTRLYASGA

SEQ ID NO: 9859 - protein, 153 aa, Lupinus angustifolius
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENVAKHWKSNEAEAVETAKEWTRLYASGA

SEQ ID NO: 9860 - protein, 153 aa, Solanum lycopersicum
  Sequence also found in Organisms: Lupinus angustifolius
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEVEAVETAKEWTRLYASGA

SEQ ID NO: 9861 - protein, 153 aa, Zea mays
  Sequence also found in Organisms: Sorghum bicolor
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSDNIAKHWKANEVEAVETAKEWTRLYASGA

SEQ ID NO: 9862 - protein, 153 aa, Triphysaria pusilla
MANSNLPRRIIKETQRLLSEPAPGISASPSEENMRYFNVMILGPSQSPYEGGVFKLELFLPEEYPMAAPKVRFLTKIYHPNIDKLGRICLDILKDKWSPALQIRTVLLSIQALLSAPNPDDPLSENVAKHWKSNESEAVETAKEWTRLYASGA

SEQ ID NO: 9863 - protein, 153 aa, Brassica oleracea
MANSNLPRRIIKETQRLLSEPAPGISASPSEENMRYFNVMVLGPSQSPYEGGVFKLELFLPEEYPMSAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 9864 - protein, 153 aa, Antirrhinum majus
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKANEVEAVETAKEWTRLYASGA

SEQ ID NO: 9865 - protein, 153 aa, Arabidopsis thaliana
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVDTAKEWTRLYASGA

SEQ ID NO: 9866 - protein, 153 aa, Actinidia deliciosa
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTLLYASGA

SEQ ID NO: 9867 - protein, 153 aa, Allium cepa
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPISENIAKHWKANEAEAVETAKEWTRLYASGA

SEQ ID NO: 9868 - protein, 153 aa, Glycine max
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALGIRTVLLSIQALLSAPNPDDPLSENIAKHWKSNEAEAVETAKEWTRLYASGA

SEQ ID NO: 9869 - protein, 153 aa, Musa acuminata
MANSNLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSDNIAKHWKTNEAEAVETAKEWTRLYASGA

SEQ ID NO: 9870 - protein, 154 aa, Daucus carota
MANSSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYASGA

SEQ ID NO: 9871 - protein, 151 aa, Chrysanthemum coronarium
NSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 9872 - protein, 153 aa, Cichorium intybus
MANSNLPRRIIKETQRLLSEPAPGISAAPSEDNMRYFNVMILGTTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 9873 - protein, 153 aa, Panax ginseng
MANSNLPRRIIKETQRLLSEPAPGISASPSEENMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWSRLYATGA

SEQ ID NO: 9874 - protein, 153 aa, Lupinus angustifolius
MANTNLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRVYASGA

SEQ ID NO: 9875 - protein, 153 aa, Chenopodium quinoa
MANSNLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKTDEAEAVETAKEWTRLYASGA

SEQ ID NO: 9876 - protein, 153 aa, Triphysaria pusilla
MANSNLPRRIIKETQRLLSEPAPGISASPSEENMRYFNVMILGPTQSPFEGGVFKLELFLPEEYPMAAPKVRFLTKIYHPNIDKLGRICLDILKDKWSPALQIRTVLLSIQALLSAPNPDDPLSENVAKHWKSNEAEAVNTAKEWTRLYASGA

SEQ ID NO: 9877 - protein, 153 aa, Raphanus sativus
MANSNLPRRIIKETQRLLSEPAPGISASPSEENMRYFNVMVLGPSQSPYEGGVFKLELFLPEEYPMSAPKVRFLTKIYHPNIDKLGRICLDILKDKWSPALQIRTVLLSIQALLSAPNPDDPLSENIAKHWKSNEAEAVETAKEWTRLYASGE

SEQ ID NO: 9878 - protein, 153 aa, Antirrhinum majus
MANSNLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKSNETEAVETAKEWTRLYASGE

SEQ ID NO: 9879 - protein, 152 aa, Ocimum basilicum
ANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYATGA

SEQ ID NO: 9880 - protein, 153 aa, Actinidia deliciosa
MANSNLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYATGA

SEQ ID NO: 9881 - protein, 153 aa, Cichorium intybus
MANSNLPRRIIKETQRLLSEPAPGISASPSEENMRYFNVMVLGPTQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTHLYASGA

SEQ ID NO: 9882 - protein, 153 aa, Phaseolus vulgaris
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYAIGA

SEQ ID NO: 9883 - protein, 92 aa, Panax ginseng
MANSNLPRRIIKETQRLLSEPAPGISASPSEDNMRYFNVMILGPTQSPYEGGVFKLELFYLKNTQWLLQRFGSSPKFTILTLTSLEGYASIS

SEQ ID NO: 9884 - protein, 73 aa, Amaranthus tuberculatus
MANSNLPRRIIKETQRLLSEPAPGISASPSEENMRYFNVMILGPTQSPYEGGSSSWSCFFQKSIQWHLQRSAS

SEQ ID NO: 9885 - protein, 153 aa, Brassica oleracea
MANSSLPRRIIKETQRLLSEPAPGISASPSEDNMRYFNVMVLGPSQSPYEGGVFKLELFLPEEYPMSAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 9886 - protein, 153 aa, Musa acuminata
MASSNLPPRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAREWTRLYATGA

SEQ ID NO: 9887 - protein, 153 aa, Cyclamen graecum
MANSNLPRRIIKETQRLLSEPAPGISASPSEDNMRYFNVMILGPSQSPYEGGVFKLELFLPEEYPMAAPKVRFLSKIYHPNIDKLGRICLDILKDKWSPALQIRTVLLSIQALLSAPNPDDPLSENVAKHWKSNEAEAVETAKEWTRLYATGA

SEQ ID NO: 9888 - protein, 153 aa, Allium cepa
MANSNLPRRIIKETQRLLSEPAPGISASPSEENMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTHLHASGT

SEQ ID NO: 9889 - protein, 153 aa, Gossypium raimondii
MANTNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYATGA

SEQ ID NO: 9890 - protein, 153 aa, Gossypium raimondii
MANTNLPRRIIKETQRLLSEPAPGISASPSEDNMRYFNVMILGPTQSPYEGGVFKLELFLPEEYPMTAPKVRFLTKIYHPNIDKLGRICLDILKDKWSPALQIRTVLLSIQALLSAPNPDDPLSENIAKHWKTNEAEAVETAKEWTRLYASGA

SEQ ID NO: 9891 - protein, 153 aa, Raphanus sativus
MANSNLPRRIIKETQRLLSEPAPGISASPSEDNMRYFNVMVLGPSQSPYEGGVFKLELFLPEEYPMSAPKVRFLTKIYHPNIDKLGRICLDILKDKWSPALQIRTVLLSIQALLSAPNPDDPLSENIAKHWKSNEAEAVETAKEWTRLYASGE

SEQ ID NO: 9892 - protein, 153 aa, Cycas rumphii
MASSNLPRRIIKETQRLLSEPAPGISASPSEENLRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKANEAEAVETAKEWTRLYASGT

SEQ ID NO: 9893 - protein, 153 aa, Zingiber officinale
MANSNLPRRIIKATQRLLSEPAPGTRASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 9894 - protein, 153 aa, Liriodendron tulipifera
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSDNIAKHWKTNEAEAVETAKEWTRLYASGV

SEQ ID NO: 9895 - protein, 153 aa, Phaseolus vulgaris
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSSEVEAVETAKEWTRLYASDA

SEQ ID NO: 9896 - protein, 153 aa, Amaranthus tuberculatus
MANSNLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTHLYACEA

SEQ ID NO: 9897 - protein, 153 aa, Musa acuminata
MANSNLPRRIIKETQRLLSEPAPGISASPSEDNMRYFNVMILGPSQSPYEGGVFKLELFLPEEYPMAAPKVRFLTKIYHPNIDKLGRICLDILKDKWSPALQIRTVLLSIQALLSAPNPDDPLSDNIARHWKTNEAEAVETAKEWTRLYATGA

SEQ ID NO: 9898 - protein, 154 aa, Chrysanthemum coronarium
MATNSNLPRRIIKETQRLLSEPAPGISASPSEENMRYFNVMILGPSQSPYEGGVFKLELFLPEEYPMAAPKVRFLTKIYHPNIDKLGRICLDILKDKWSPALQIRTVLLSIQALLSAPNPDDPLSENVAKHWKANEAEAVETAKEWTHLYASGT

SEQ ID NO: 9899 - protein, 154 aa, Chrysanthemum coronarium
MATNSNLPRRIIKETQRLLSEPAPGISASPSEENMRYFNVMILGPSQSPYEGGVFKLELFLPEEYPMAAPKVRFLTKIYHPNIDKLGRICLDILKDKWSPALQIRTVLLSIQALLSAPNPDDPLSENVAKHWKANEAEAVETAKEWTNLYASGT

SEQ ID NO: 9900 - protein, 153 aa, Gossypium raimondii
MANSNLPRRIIKETQRLLSEPAPGINASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNEAEAVETAKEWTRLYANSA

SEQ ID NO: 9901 - protein, 153 aa, Chenopodium quinoa
MANSNLPRRIIKETQRLLSEPAPGISASPSEENMRYFNVMVLGPSQSPYEGGVFKLELFLPEEYPMAPPKVRFLTKIYHPNIDKLGRICLDILKDKWSPALQIRTVLLSIQALLSAPNPDDPLSENVAKHWKSNEVEAVETAKEWTRLYATGA

SEQ ID NO: 9902 - protein, 88 aa, Panax ginseng
MAAPKVRFLTKIFHPNIDKLGRICLDILKDKWSPALQIRTVLLSIQALLSAPNPDDPLSENIAKHWKTNEAEAVETAKEWTRLYASGA

SEQ ID NO: 9903 - protein, 154 aa, Raphanus sativus
MANSSNLPKRIIKETQRLLSEPAPGISASPSEDNMRYFNVMVLGPSQSPYEGGVFKLELFLPEDYPMSAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 9904 - protein, 153 aa, Daucus carota
MANSNLPRRIIKETQRLLSEPAPGISASPSEENMRYFNVMILGPSQSPYEGGVFKLELFLPEEYPMAAPKVRFLTKIYHPNIDKLGRICLDILKDKWSPALQIRTVLLSIQALLSAPNPDDPLSENVAKHWKTNEVEAVETAKEWSRLYATGE

SEQ ID NO: 9905 - protein, 153 aa, Sorghum bicolor
MANSNLPRRIIKETQRLLSEPAPGISASPSEENMRYFNVMILGPSQSPYEGGVFKLELFLPEEYPMAPPKVRFLTKIYHPNIDKLGRICLDILKDKWSPALQIRTVLLSIQALLSAPNPDDPLADNVAKHWKANEAEAVETAKEWTRVYASGA

SEQ ID NO: 9906 - protein, 153 aa, Echinochloa colona
MANSNLPRRIIKETQRLLSEPAPGISASPSEENMRYFNVMILGPSQSPYEGGVFKLELFLPEEYPMAPPKVRFLTKIYHPNIDKLGRICLDILKDKWSPALQIRTVLLSIQALLSAPNPDDPLADNVAKHWKANETEAVETAKEWTRAYASGA

SEQ ID NO: 9907 - protein, 153 aa, Petroselinum crispum
MANTNLPRRIIKETQRLLSEPAPGISASPSEENMRYFNVMILGPSQSPYEGGVFKLELFLPEEYPMAAPKVRFLTKIYHPNIDKLGRICLDILKDKWSPALQIRTVLLSIQALLSAPNPDDPLSENVAKHWKTNEVEAVETAKEWSRLYATGE

SEQ ID NO: 9908 - protein, 123 aa, Panax ginseng
MANSNLPRRIIKETQRLLSEPAPGISASPSEDNMRYFNVMILGPTQSPYEGGVFKLELFLPEEYPMAAPKVRFLTKIYHPNIDKNECLDAAWKDMPRYPEGQMESCSSDSYCTIKYSSPIECS

SEQ ID NO: 9909 - protein, 153 aa, Setaria italica
MAHSNLPRRIIKETQRLLSEPAPGISASPTEENMRYFNVMILGPSQSPYEGGVFKLELFLPEEYPMAPPKVRFLTKIYHPNIDKLGRICLDILKDKWSPALQIRTVLLSIQALLSAPNPDDPLADNVAKHWKSNETEAVETAKEWTRLYASGE

SEQ ID NO: 9910 - protein, 146 aa, Lolium multiflorum
RRIIKETQRLLSEPAPGISASPSEENMRYFNVMVLGPAQSPYEGGVFKLELFLPEEYPMAAPKVRFLTKIYHPNIDKLGRICLDILKDKWSPALQIRTVLLSIQALLSAPNPDDPLSENVAKHWKSNEAEAVETAKEWTRVYASGA

SEQ ID NO: 9911 - protein, 154 aa, Setaria italica
MAHSNLPRRIIKETQRLLSEPAPGISASPTEENMRYFNVMILGPSQSPYEGRGVFKLELFLPEEYPMAPPKVRFLTKIYHPNIDKLGRICLDILKDKWSPALQIRTVLLSIQALLSAPNPDDPLADNVAKHWKSNETEAVETAKEWTRLYASGE

SEQ ID NO: 9912 - protein, 153 aa, Pseudoroegneria spicata
MANSNLPRRIIKETQRLLSEPAPGISASPSEENMRYFNVMILGPTQSPYEGGVFKLELFLPEEYPMAPPKVRFLTKIYHPNIDKLGRICLDILKDKWSPALQIRTVLLSIQALLSAPNPDDPLADNVAKHWKANETEAVETAKEWTRVYANDA

SEQ ID NO: 9913 - protein, 153 aa, Festuca arundinacea
  Sequence also found in Organisms: Avena sativa
MANSNLPRRIIKETQRLLSEPAPGISASPSEENMRYFNVMILGPSQSPYEGGVFKLELFLPEEYPMAPPKVRFLTKIYHPNIDKLGRICLDILKDKWSPALQIRTVLLSIQALLSAPNPDDPLADNVAKHWKANETEAVETAKEWTRVYANDG

SEQ ID NO: 9914 - protein, 157 aa, Physcomitrella patens
MSAATANTNLPRRIIKETQRLLSEPAPGISASPSEENLRYFNVMILGPSQSPYEGGVFKLELFLPEEYPMAAPKVRFLTKIYHPNIDKLGRICLDILKDKWSPALQIRTVLLSIQALLSAPNPDDPLAENIAKHWKTNEQEAVETAREWTRLYASGA

SEQ ID NO: 9915 - protein, 153 aa, Avena sativa
MANSNLPRRIIKETQRLLSEPAPGISASPSEENMRYFNVMILGPSQSPYEGGIFKLELFLPEEYPMAPPKVRFLTKIYHPNIDKLGRICLDILKDKWSPALQIRTVLLSIQALLSAPNPDDPLADNVAKHWKANETEAVETAKEWTRVYANDG

SEQ ID NO: 9916 - protein, 157 aa, Physcomitrella patens
MSAAAANANLPRRIIKETQRLLSEPAPGISASPSEENLRYFNVMILGPSQSPYEGGVFKLELFLPEEYPMAAPKVRFLTKIYHPNIDKLGRICLDILKDKWSPALQIRTVLLSIQALLSAPNPDDPLAENIAKHWKSNEQEAVETAREWTRSYASGV

SEQ ID NO: 9917 - protein, 153 aa, Avena sativa
MANSNLPRRIIKETQRLLSEPAPGISASPSEENMRYFNVMILGPSQSPYEGGIFKLELFLPEEYPMAPPKVRFLTKIYHPNIDKLGRICLDILKDKWSPALQIRTVLLSIQALLSAPNPDDPLADNVAKHWKANETEAVETAKDWTRVYANDG

SEQ ID NO: 9918 - protein, 157 aa, Marchantia polymorpha
MSGTTANSNLPRRIIKETQRLLSEPAPGISASPSEENLRYFNVMILGPTQSPYEGGVFKLELFLPEEYPMAAPKVRFLTKIYHPNIDKLGRICLDILKDKWSPALQIRTVLLSIQALLSAPNPDDPLAENIAKHWKTDEAQAVATAREWTRLYATGA

SEQ ID NO: 9919 - protein, 88 aa, Cichorium intybus
MAAPKVRFLTKIYHPNIDKLGRICLDILKDKWSPALQIRTVLLSIQALLSAPNPDDPLSENIAKHWKSNEAEAVETAQEWTRLYASGA

SEQ ID NO: 9920 - protein, 120 aa, Panax ginseng
MRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKTNESEAVETAKEWTRLYASGA

SEQ ID NO: 9921 - protein, 146 aa, Ananas comosus
MANSNLPRRIIKETQRLLSEPAPGISAYPSEENMRYFNVMILGPSQSPYEGGVFKLELFLPEEYPMAAPKVRFLTKIYHPNIDKLGRICLDILKDKWSPALQIRTVLLSIQALLSAPNPDDPLSDNIAKHWKANEAEAVETGKAVT

SEQ ID NO: 9922 - protein, 82 aa, Arachis hypogaea
MANSNLPRRIIKETQRLLSEPAPGISASPSEDNMRYFNVMILGPTQSPYEGGVFKLELFLPEEYPMAAPKVRFLNKNISSKH

SEQ ID NO: 9923 - protein, 141 aa, Eutrema parvulum
ETQRLLSEPAPGISASPSEDNMRYFNVMVLGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 9924 - protein, 153 aa, Musa acuminata
MANRNLPGRIIKETQRLLSEPEPGISALPSEDNMRSFSVKILGPNQSPYEGGVFKLELFLPDEYPMVAPKVRFLTKIYHPNIDKLGRICLDILKDKWTPALQIRTVLLSIQALLSAPNPDDPLSENIAKHWKANEAEALETAKEWTHVYASGA

SEQ ID NO: 9925 - protein, 140 aa, Raphanus sativus
SNLPRRIIKETQRLLSEPAPGISASPSEENMRYFNVMILGPTQSPYEGGVFKLELFLPEEYPMAAPKVRFLTKIYHPNIDKLGSICLDILKDKWSPALQIRTVLLSIQALLSAPNPDDPLSENIAKHWKSNEAEAAETAK

SEQ ID NO: 9926 - protein, 148 aa, Cyamopsis tetragonoloba
RNHVCDATKLELRSEPAPGTSASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYATGA

SEQ ID NO: 9927 - protein, 120 aa, Brassica oleracea
MRYFNVMVLGPSQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGE

SEQ ID NO: 9928 - protein, 132 aa, Pteridium aquilinum
MANSNLPRRIIKETQRLLSEPAPGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWK

SEQ ID NO: 9929 - protein, 134 aa, Bruguiera gymnorhiza
MANSNLPRRIIKDTQRLLSEPAPGISASPPEDNMRYFNVMILGPTQSPYEGGVFKLELFLPEEYPMAPPKVRFLTKIYHPNIDKLGRICLDILNDKWSPALQIRTVLLSIQALLSAPNPDDPLSENIAKHWKVK

SEQ ID NO: 9930 - protein, 88 aa, Festuca arundinacea
MAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 9931 - protein, 128 aa, Cynodon dactylon
SASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSDNIAKHWKANEVEAVETAKEWTRLYASGA

SEQ ID NO: 9932 - protein, 158 aa, Chlamydomonas reinhardtii
MNPDQAAQAAQLPRRIIKETQKLLSEPAPGISASPSEENLRYFNVMILGPQQSPYEGGVFKLELFLPEDYPMAPPKVRFLTKIYHPNIDKLGRICLDILKDKWSPALQIRTVLLSIQALLSAPNPDDPLAEHVAKHWKENEKEAIATARQWTAMHAQG

SEQ ID NO: 9933 - protein, 129 aa, Pseudotsuga menziesii
ISASPSEDNLRYFNVMILGPSQSPYEGGVFKLELFLPEEYPMAAPKVRFLTKIYHPNIDKLGRICLDILKDKWSPALQIRTVLLSIQALLSAPNPDDPLSENIAKHWKTNEVEAVETAKEWTRLYASGA

SEQ ID NO: 9934 - protein, 128 aa, Curcuma longa
HHSGISASPSEDNMRYFNVMILGPTQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRL

SEQ ID NO: 9935 - protein, 341 aa, Secale cereale
MEAVEGNGGGSGLVVTELSHIKELVKQLDVHLGGSPDLCKLLAQQIFAVTERSIGMIRSAHFKRSAAGAGLDSPPLSATPSPVSGVSNTPFKPNKKRKTSEKGRRQIRVSSAGGGADGPADDGHSWRKYGQKDILGAQHPRAYYRCTYQKTQGCAATKQVQRADEDPALFDVIYHGEHTCVHKAAAAMVQQAGQNPGAQSLLQSLSSSLTVKTEGLAAAATQGWSATTPFSFSSPAVSGMTPPEHHPFSTPSTPENCFMSMPTSLEPSPATSGSNHMGMNPFQAQSELQTMVFALAEATSMPAADAEEAAFSYWSFGDPAALDVNNIDDDLNNFDISAFFA

SEQ ID NO: 9936 - protein, 383 aa, Pseudoroegneria spicata
MARPGHSTAWLPLLVLLFAAGATAQSCLSATFTSGRTFLKCNQLPALGASLHWTYHAQNGTADIAFRATSGTDGWVAWGINPTGSRMAGSNVFVASQSGGAVSVLTTVLRSTSPALDNATLQFDVPVPASAEYAGGAYTIYATVALPNNSTSQNTVWQAGPASGGSISPHPVSGQNLQSVQNLDFLSGTSTGGSNSRLHRRNLHGVLNAVGWGILIPLGAIIARYLRVFEAADPAWFYLHIACQISGYVLGVAGWGLGLKLGSESKGLTYSTHRNIGIAIFCLATLQVFALFLRPDKKNKYRVYWNAYHHSVGYSVIVLAAVNIFKGLNILKPVTGWKTSYIVILATLAGVALVLEAITWAIVLRRRKRNKAHGGANGTGVQL

SEQ ID NO: 9937 - protein, 383 aa, Secale cereale
MARPGHSTAWLPLLVLLFAAGAAAQSCLSATFTGGRAFLKCNQLPVLGASLHWTYHAGNGTADIAFRAPSGADGWVAWGINPTGGGMAGSNVFVASQSGGAVSVLTTILRTTNPTLDNTALSFAVPVPASAEYAGGAYTIYATVALPGNTTSQNTVWQAGPASGGGISPHPVSGQNLQSVQNLDFLSGTSTGGSNSRLHRRNLHGVLNGVGWGVLIPLGAMIARYLRVFEAADPAWFYLHIACQISGYVLGVAGWGLGLKLGSESKGLTYSAHRNIGIAIFCLATLQVFALFLRPDKKNKYRVYWNAYHHSVGYSVIVLAAVNIFKGLNILKPVTGWKTSYIVILATLAGVALLLEAITWAIVLRRRKRNKAYGGANGTGVQL

SEQ ID NO: 9938 - protein, 383 aa, Secale cereale
MARPGHSTAWLPLLVLLFATGAAAQSCLSATFTGGRAFLKCNQLPVLGASLHWTYHAGNGTADIAFRAPSGADGWVAWGINPTGGGMAGSNVFVASQSGGAVSVLTTILRTTNPTLDNTALSFAVPVPASAEYAAGAYTIYATVALPGNTTSQNTVWQAGPASGGGISPHPVSGQNLQSVQNLDFLSGTSTGGSNSRLHRRNLHGVLNGVGWGVLIPLGAMIARYLRVFEAADPAWFYLHIACQISGYVLGVAGWGLGLKLGSESKGLTYSAHRNIGIAIFCLATLQVFALFLRPDKKNKYRVYWNAYHHSVGYSVIVLAAVNIFKGLNILKPVTGWKTSYIVILATLAGVALLLEAITWAIVLRRRKRNKAYGGANGTGVQL

SEQ ID NO: 9939 - protein, 383 aa, Secale cereale
MARPGHSTAWLPLLVLLFAAGAAAQSCLSATFTGGRAFLKCNQLPVLGASLHWTYHAGNGTADIAFRAPSGADGWVAWGINPTGGGMAGSNVFVASQSGGAVSVLTTILRTTNPTLDNTALSFAVPVPASAEYAGGAYTIYATVALPGNTTSQNTVWQAGPASGGGISPHPVSGQNLQSVQNLDFLSGTSTGGSNSRLHRRNLHGVLNGVGWGVLIPLGAMIARYLRVFEAADPAWFYLHIACQISGYVLGVAGWGLGLKLGSESKGLTYSAHRNIGIAIFCLATLQVFALFLRPDKKNKYRVYWNAYHHSVGYSVIVLAAVNIFKGLNILKPVTGWKTSYIVILATLAGVALLLEAITWVVVLRRRKRNKAYGGANGTGVQL

SEQ ID NO: 9940 - protein, 383 aa, Triticum aestivum
MARPGHSTAWLPLLVLLFAAGATAQSCLSATFTGGRTFLKCNQLPVLGASLHWTYHAVNGTADIAFRAPSGADGWVGWGINPSGGGMAGSNVFIASQTSGAVSVLTTILRNTTPTLDNTALSFDVPVPASAEYAGGAYTIYATVALPGNTTSQNTVWQAGPVSGGRVSQHSISGPNVQSVQRLDFLSGTSTGGSNSRLHRRNLHGVLNAVGWGILIPLGAMIARYLRVFEAADPAWFYLHITCQISGYVLGVAGWGLGLKLGSESKGLTYTTHRNIGIAIFCLATLQVFALFLRPDKKNKYRVYWNAYHHSVGYSVIVLAAVNIFKGLNILKPVTGWKTSYIVILATLAGVALVLEAITWAIVLRRRKRNQAYGGANGTGVQL

SEQ ID NO: 9941 - protein, 384 aa, Triticum aestivum
MARPGHSTAWLPLLVLLFAAGAAAQSGCLSATFTGGRTFLKCNQLPVLGANLHWTYHAGNGTADIAFRAPSGADGWVGWGINPSGSGMAGSNVFVASQSGGAVSVLTTILRTTAPTLDNTALSFDVPVPASAEYAGGAYTIYATVALPGNTTSQNTVWQAGPISGGRISPHPVSGQNLQSAQNLDFLSGTSTGGSNSRLHRRNLHGVLNGVGWGVLIPLGAMIARYLRVFESADPAWFYLHIACQISGYALGVAGWGLGLKLGSESKGLTYSTHRNIGIAIFCLATLQVFALFLRPDKKNKYRVYWNAYHHSVGYSVIVLAAVNIFKGLNILKPVTGWKTSYIVILATLAGVALVLEAITWAIVLRRRKRNQAHGGANGTGVQL

SEQ ID NO: 9942 - protein, 206 aa, Avena sativa
MARPGHSTAWLPVLVLLFAAGAAAQSCLSATFTSGRTFLKCNQLPLLGASLHWTYHAQNGTADIAFRATSGADGWVAWGINPTSGGMPGSNVFVASQSGGAVSVLTTVLRTLTPALDNATLQFDVPVPASAEYAGGAYTIYATIALPNNSTSQNTVWQRGRSAAGPYCRTRRPGRTCRASRDSISSPAPAPAAPTPGCTAVTSTEC

SEQ ID NO: 9943 - protein, 384 aa, Triticum aestivum
MARPGHSTAWLPLLVLLFAAGAAAQSGCLSATFTGGRTFLKCNQLPVLGASLHWTYHAGNGTADIAFRAPSGADGWVGWGINPGSSGMAGSNVFIASQSAGAVSVLTTILRNTAPTLDNTALSFDVPVPASAEYAGGAYTIYATVALPGNATSHNTVWQAGPISGGRVSQHSISGPNVQSLQRLDFLSGTSTGASNSRLHRRNLHGVLNGVGWGVLIPLGAMIARYLRVFEAADPAWFYLHIACQISGYALGVAGWGLGLKLGSESKGLTYTTHRSIGIAIFCLATLQVFALFLRPDKKNKYRVYWNAYHHSVGYSVIVLAAVNIFKGLNILKPVTGWKTSYIVILATLAGVVLLLEAITWAVVLRRRKRNQAYGGANGTGVQL

SEQ ID NO: 9944 - protein, 365 aa, Secale cereale
WPLREPSTGGAGVPQVQPAARARRQPPLDVPRRERHGRNNTTLPGTGPAPTGWVAVGAKSETPDRAAAVAGSNVFAPRQSGGAVSVLTTILRTTNPTLDNTALSFAVPVPASAEYAAGAYTIYATVALPGNTTSQNTVWQAGPASGGGISPHPVSGQNLQSVQNLDFLSGTSTGGSNSRLHRRNLHGVLNGVGWGVLIPLGAMIARYLRVFEAADPAWFYLHIACQISGYVLGVAGWGLGLKLGSESKGLTYSAHRNIGIAIFCLATLQVFALFLRPDKKNKYRVYWNAYHHSVGYSVIVLAAVNIFKGLNILKPVTGWKTSYIVILATLAGVALLLEAITWAIVLRRRKRNKAYGGANGTGVQL

SEQ ID NO: 9945 - protein, 412 aa, Triticum aestivum
MGKVVVAEATARQVASFVLGAAAALTVVMLVQYRAPAAGLSRARTPGHFSGLKLSSDEQHHRRNGTAAARAVVHHRAPPVAGSAARDDDRRRPANATTVTKPNSTSTSHLPSTHRHEEKGGKEESAEFRGLAAAVARAAMDDRTVIITCVNQAWAAPGSLLDLFLESFRIGDGTARLLPHVLVVAMDPGAHARCLAVHRHCYHYTIPGLNIDFAAHKYFLSKDYLELVWSKLKLQRRILELGYGFLFTDVDIVWLRDPFKHVTAYADMTVSSDVYFGDPDNLGNFPNTGFFHVKPNARTIAMTKLWHGGRDKYPGANEQPVFNMMKKQMVAELGLRVQYLNPAYVGGFCSYGKDLGKIVTMHANCCVGIGNKIRDLKGVLGDWRNYTRMPPWERHRAKWTVPGACIRAEKQV

SEQ ID NO: 9946 - protein, 412 aa, Triticum aestivum
MGKVVVAEATARQVASFVLGAAAALTVVMLVQYRAPAAGLSRARTPAHFSGLRLSSDDQHHRRNATTTARPVVHHQAPPVAGSAARDDDRRRPANATTITKPNSTTTSHLPSTRRHEEKGGKEESAEFRGLAAAVARAATDDRTVIITCVNQAWAAQGSLLDLFLESFRIGDGTARLLPHVLVVAMDPGAHARCLAVHQHCYHYTIPGLNIDFAAHKYFLSKDYLELVWSKLKLQRRILELGYGFLFTDVDIVWLRDPFKHVTAYADMTVSSDVYFGDPDNLGNFPNTGFFHVKPNARTIAMTKLWHGGRGKYPGANEQPVFNMMKKQMVAELGLRVQYLNPAYVGGFCSYGKDLGKIVTMHANCCVGIDNKIRDLKGVLDDWKNYTRLPHWEKHRAKWTVPGACIRAEKQA

SEQ ID NO: 9947 - protein, 449 aa, Triticum aestivum
MEDLQDCNSKSLVAVPGSLVLHLFRLLGQQDNSWQKYALAYFLLVRNEYFPREPRKSSAVNGQLVPCCDSSDLGSNELEVEKQNAVVKSQSGGDSSSNGSNDCFLPGLHDDLAQDCLAWTSRSDYPSLSCLNKKFNTLVNGGYLYKLRRKYGIVEHWVYLACSAMPWEAFDPSRNRWMRLPRMPCDDCFSCADKESLAVGTQLLVFGREYTGLAIWMYNLLTRHWSRCTPMNFPRCLFASGSSGEIAIVAGGCDRNGQVLRSVELYNSEAGQWETLPDMNLPRRLSSGFFMDGKFYVIGGVTSERHSLTCGEEFDLDTRTWRRIHDMYPGGTSASQSPPLIAVVNNQLYAADQSTNVVKKYDKASNTWNIVKPLPVRADSSNGWGLAFKGCGDRLLVIGGHRGPRGEVILLHSWCPEDGNGAASDSDWEVLSVKERAGVFVYNCAIMGC

SEQ ID NO: 9948 - protein, 449 aa, Secale cereale
MGDLQDCNSKGLVAVPGSLVLHLFRLLGQQQQDNSWQKYALAYFLLVRNEYFPREPRKHSAVNGQLVHCCDSSDLGSNELEVEKQNAVVKSQSGGDSSSNGSNDCFLPGLHDDLAQDCLAWTSRSDYPSLSCLNKKFNTLVNGGYLYKLRRKYGIVEHWVYLACSAMPWEAFDPSRNRWMRLPRMPCDDCFSCADKESLAVGTQLLVFGREYTGLAIWMYNLLTHRWSRSTPMNLPRCLFASGSSGEIAIVAGGCDRDGQVLRSVELYNSEAGQWETLPDMNLPRRLSSGFFMDGKFYVIGGVTSERHSLTCGEEYDLDTRTWRRIHNMYPGGTSASQSPPLIAVVNNQLYAADQSTNVVKKYDKASNTWNIVKPLPVRADSSNGWGLAFKGCGDRLLVIGGHRGPRGEVILLHSWCPEDGNGAASDWEVLSVKERAGVFVYNCAIMGC

SEQ ID NO: 9949 - protein, 447 aa, Festuca arundinacea
MEDLQDCNSKSLVAVPGSLVLHLFRLFSQQDNSWQKYALAYFLLVRNEYFSREPRKHSAGNVQPVRCCDSSVLGSKELELKEQTAAVKTQSGGGSSANGSNDCLLPGLHDDLAQDCLAWTSRSDYPSLSGLNKKFNMLINSGYLYKLRRQYGIVEHWVYLACSLMPWEAFDPSRNRWMKLPRLPCDECFSCADKESLAVGTQLLVFGREYAGLAIWMYNLVTRRWSRNTPMNLPRCLFASGSSGEIAIVAGGCDRNGQVLRSAELYNSEAGHWETLPDMHLARRLSSGFFMDGKFYVIGGVTSERVSLTCGEEYDLGTRTWRRIHDMYPGGTSASQSPPLIAIVNNQLYAADQSTNVVKKYDKANNTWNIVKPLPVRADSSNGWGLAFRACGDRLLVIGGHRGPRGEVIMLHSWCPEDGNGGGADWEVLSVKERAGVFVHNCAIMGC

SEQ ID NO: 9950 - protein, 447 aa, Avena sativa
MEDLQDCNSKSLVAVPGSLALHLFRLLGQQDNSWHKYALAYFLLVRNEYFSREPRKHSSGNVQQVLCCDSSVLGSKEVELKEQNAVVKTQSGGGSSSNGSNDCLLPGLHDDLAQDCLAWTSRSDYPSLSGLNKKFNMLINSGYLYKLRRQYGIVEHWVYLACSLMPWEAFDPSRKRWMKLPRLPCDECFSCADKESLAVGTQLLVFGREYAGLAIWMFNLVTRRWSGCTPMNFPRCLFGSGSSGEIAIVAGGCDRNGQVLRSAELYNSEAGHWETLPEMNLPRRLSSGFFMDGKFYVIGGVTSDRVSLTCGEEYDLGTRTWRRIHDMYPGGTSASQSPPLIAVVNNQLYAADQSTNVVKKYDKTNNTWNVVKALPVRADSSNGWGLAFRACGDRLLVIGGHRGPRGEVILLHSWCPEDGNGGAADWEVLSVKERAGVFVHNCAIMGC

SEQ ID NO: 9951 - protein, 455 aa, Oryza sativa
MEDLQDCDCKSLVAVPGSVVLHLFRLFNQQDNSWQKYTLAYFLLVRNEYFSRDSRKHSDGKNQLLDCCDDSELDLDVLYADLDSKELELKLQKPVVKTQSKGDSSASGSNDCFFPGLHDDLAQDCLAWASRSDYPSLSCLNKKFNLLINSGYLYRLRRKYGIVEHWVYLACSLMPWEAFDPSRKRWMRLPRMPCDECFSCADKESLAVGTQLLVFGREYTGLAIWMYNLLARGWSRCTPMNLPRCLFASGSFGEIAIVAGGCDKNGQVLKSAELYNSETGHWETLPDMNLPRRLSSGFFMDGKFYVIGGVSSQRDSLTCGEEYNLETRTWRRIHDMYPGGTSASQSPPLVAVVNNQLYAADQATNVVKKYDKGNNTWNIVKPLPVRADSSNGWGLAFKACGDRLLVIGGHRVPRGEVILLHSWCPEDGNGGADWEVLSVKERAGVFVYNCAIMGC

SEQ ID NO: 9952 - protein, 477 aa, Brachypodium distachyon
MVCGENREGWSLNLQTFVSSVFCVKSEKTMEDLQDCNSKSLVAVPGSLVLHLFRQFGQQDNSWHKYTLAYFLLVRNEYFSREPRKHSTVSGQHVDCCDSSKLDLASKALPLKEQNAVVKTQSGGDSSSNGSNDGFLPGLHDDMAQDCLAWTSRSDYPSLSCLNKKFNMLINGGYLYKLRRKYGIVEHWVYLACSLMPWEAFDPSRNRWMRLPRMPCDDCFSCADKESLAVGTQLLVFGREYTGLAIWMYNLLTRHWSRCTPMNLPRCLFASGSSGEIAIVAGGCDSTGQVLISAELYNSEAGHWETLPDMNLPRRLSSGFFMDGMFYVIGGVSSERNSLTCGEEYNLQTRTWRRIPDMYPGGTSASQSPPLIAVVNNQLYAADQSTNVVKKYDKENNIWNIVKPLPVRADSSNGWGLAFRACGDRLLVIGGHRVPRGEVILLHSWCPEGGNGGADWEVLSMKERAGVFVYNCAIMGC

SEQ ID NO: 9953 - protein, 450 aa, Echinochloa colona
MEDIQDCNSKSLVALPGSLVLHLFRLFGQQDQSSWQKYILAYFLLVRNEYFSGESKRHSDVFCDISELDVFPYATDLDSEELELNEQEPVVKAQSGGDSSGSRSNDCYFPGLHDDLSQDCLAWSSRSDYPSLSCLNKRFNLLINSGYLYKLRRKYGIVEHWVYLACSLMPWEAFDPSRKRWMRLPRMPCDECFSCADKESLAVGTQLLVFGREYTGLAIWMYNLLTRSWSRCTPMNLPRCLFASGSSGEIAIVAGGCDKNGQVLRSAELYNSEIGHWETIPDMNLARRLSSGFFMDGKFYVIGGVSSQRDSLTCGEEYNLETRTWRRILDMYPGGTSASQSPPLVAVVNNQLYAADQSTNVVKKYDKANNTWNILKPLPVRADSSNGWGLAFKACGDRLLVIGGHRGPRGEVILLHSWCPEGGEDGADWEVLSVKERAGVFVYNCAIMGC

SEQ ID NO: 9954 - protein, 450 aa, Setaria italica
MEDLQDCNSKSLVALPGSLVLHLFRLFGQQDQSSWQKYILAYFLLVRNEYFSGESKGHSDEFCDISELDVFPYATDLGSEELELKKQKPILKVQSGGDSSSSRSNDCYFPGLHDDLSQDCLAWSSRSDYPSLSCLNKRFNLLINSGYLYKLRRKYGIVEHWVYLACSLMPWEAFDPSRKRWMRLPRMPCDECFSCADKESLAVGTQLLVFGREYTGLAIWMYNLLTRSWSRCTPMNLPRCLFASGSSGEIAIVAGGCDKNGQVLRSAELYNSEIGHWETIPDMNLARRLSSGFFMDGKFYVIGGVSSQRDSLTCGEEYNLETRTWRRILDMYPGGTSASQSPPLVAVVNNQLYAADQSTNVVKKYDKANNTWNILKPLPVRADSSNGWGLAFKACGDRLLVIGGHRGPRGEVILLHSWCPEGGEDGADWEVLSVKERAGVFVYNCAIMGC

SEQ ID NO: 9955 - protein, 450 aa, Saccharum officinarum
MEELQDCNSKSLVALPGSLVLHLFRLFGQQDQSSWQKYILAYFLLVRNDYFSGESKKHSDVFCDISELDFFPYATDLDSEELELKEQKPISKAQSGGDSSSNRSNDCYFPGLHDDLSQDCLAWASRSDYPSLSCLNKRFNLLINSGYLYKLRRKYGIVEHWVYLACSLMPWEAFDPSRKRWMRLPRMPCDECFSCADKESLAVGTQLLVFGREYTGLAIWMYNLLTRSWSPCTPMNLPRCLFASGSSGEIAIVAGGCDKNGQVLRSVELYNSEIGHWETIPDMNLPRRLSSGFFMDGKFYVIGGVSSQRDSLTCGEEYNLETRTWRRILDMYPGGTSASQSPPLVAVVNNQLYAADQSTNVVKKYDKVNNAWNIVKPLPVRADSSNGWGLAFKACGDRLLVIGGHRGPRGEVILLHSWCPEGGEDGADWEVLSVKERAGVFVYNCAIMGC

SEQ ID NO: 9956 - protein, 450 aa, Pennisetum glaucum
MEDLQDCNSKSLVALPGSLVLHLFRLFGQQDQSSWQKYILAYFLLVRNEYFSGESKGHSDEFCDISELDVFPYATDLDREELEPKEQKPILKVQSGGDSSGSSSNDCYFPGLHDDLSQDCLAWSSRSDYPSLSCLNKRFNLLINSGYLYTLRRKYGIVEHWVYLACSLMPWEAFDPSRKRWMRLPRMPCDECFSCADKESLAVGTQLLVFGREYTGLAIWMYNLLTRSWSPCTPMNLPRCLFASGSSGEIAIVAGGCDKNGQVLRSAELYNSEIGHWETLPDMNLPRRLSSGFFMDGKFYVIGGVSSQRDSLTCGEEYNLETRTWRRIIDMYPGGTSASQSPPLVAVVNNQLYAADQSTNVVKKYDKANNTWNILKPLPVRADSSNGWGLAFKACGDRLLVIGGHRGPRGEVILLHSWCPEGGEDGADWEVLSVKERAGVFVYNCAIMGC

SEQ ID NO: 9957 - protein, 450 aa, Panicum virgatum
MEELQDCNSKSLVALPGSLVLHLFRLFGQQDQSSWQKYILAYFLLVRNEYFSGESKRHSDVFCDISELDVFPYATDLGSEELELNEQKPILKAQSGGNSSGNRSNDCYFPGLHDDLSQDCLAWSSRSDYPSLSCLNKRFNLLINSGYLYKLRRKYGIVEHWVYLACSLMPWEAFDPNRKRWMRLPRMPCDECFSCADKESLAVGTQLLVFGREYTGLAIWMYNLLTRSWSRCTPMNLPRCLFASGSSGEIAIVAGGCDKNGQVLRSAELYNSEIGRWETIPDMNLARRLSSGFFMDGKFYVIGGVSSQRDSLTCGEEYNLETRTWRRILDMYPCGTSASQSPPLVAVVNNQLYAADQSTNVVKKYDKANNTWNILKPLPVRADSSNGWGLAFKACGDRLLVIGGHRGPRGEVILLHSWCPEGGEDGADWEVLSVKERAGVFVYNCAIMGC

SEQ ID NO: 9958 - protein, 450 aa, Panicum virgatum
MEELQDSNSKSLVALPGSLVLHLFRLFGQQDQSSWQKYILAYFLLVRNEYFSGESKRHSDVFCDISELDVFPYAIDLDSEELELNEQKPILKAQSGGDSSGNRSNDCYFPGLHDDLSQDCLAWSSRSDYPSLSCLNKRFNLLINSGYLYKLRRKYGIVEHWVYLACSLMPWEAFDPNRKRWMRLPRMPCDECFSCADKESLAVGTQLLVFGREYTGLAIWMYNLLARSWSRCTPMNLPRCLFASGSSGEIAIVAGGCDKNGQVLRSAELYNSENGCWETIPDMNLARRLSSGFFMDGKFYVIGGVSSQRDSLTCGEEYNLETRTWRRILDMYPGGTSASQSPPLVAVVNNQLYAADQSTNVVKKYDKANNTWNILKPLPVRADSSNGWGLAFKACGDRLLVIGGHRGPRGEVILLHSWCPEGGEDGADWEVLSVKERAGVFVYNCAIMGC

SEQ ID NO: 9959 - protein, 450 aa, Zea mays
MEELQDCNSRSLVALPGSLVLRLFRLFGQQDQSSWQKYILAYFLLVRNDYFSGESKKHSDVFCDISELDFFPYATDLDSEELELKEQKPITKAQSGGDSSGNRSNDCYFPGLHDDLSQDCLAWASRSDYPSLSCLNKRFNLLINSGYLYRLRRKYGIVEHWVYLACSLMPWEAFDPSRKRWMRLPRMPCDECFSCADKESLAVGTQLLVFGREYTGLAIWMYNLLTRSWSPCTPMNLPRCLFASGSSGEIAIVAGGCDKNGQVLRSAELYNSEIGHWETIPDMNLPRRLSSGFFMDGKFYVIGGVSSQRDSLTCGEEYNLETRTWRRILDMYPGGTSASQSPPFVAVVNNQLYAADQSTNVVKKYDKANNAWNILKPLSVRADSSNGWGLAFKACGDRLLVIGGHRGPRGEVILLHSWCPEGGEDGADWEVLSVKERAGVFVYNCAIMGC

SEQ ID NO: 9960 - protein, 472 aa, Sorghum bicolor
MQAAGASRWPGSRRRRVSARQIMEELQDCNSKCLVALPGSLVLHLFRLFGQQDQSSWQKYILAYFLLVRNDYFSGESKKHSDVFCDISELDFFPYATDLDSEELELKEQKPISKAQSGGDSSSNRSNDCYFPGLHDDLSQDCLAWASRSDYPSLSCLNKRFNLLINSGYLYKLRRKYGIVEHWVYLACSLMPWEAFDPLRKRWMRLPRMPCDECFSCADKESLAVGTQLLVFGREYTGLAIWMYNLLTRSWSPCTPMNLPRCLFASGSSGEIAIVAGGCDKDGQVLRSVELYNSEIGHWETIPDMNLPRRLSSGFFMDGKFYVIGGVSSQRDSLTCGEEYNLETRTWRRILDMYPGGTSASQSPPLVAVVNNQLYAADQSTNVVKKYDKVNNAWNIVKPLPVRADSSNGWGLAFKACGDRLLVIGGHRGPRGEVILLHSWCPEGGEDGADWEVLSVKERAGVFVYNCAIMGC

SEQ ID NO: 9961 - protein, 472 aa, Zea mays
MQAAGASRWPGSRWRRVSARQIMEELQDCNSRSLVALPGSLVLRLFRLFGQQDQSSWQKYILAYFLLVRNEYFSGESKKHSDVFCDISELDFFLYATDLDSEELELKEQKPITKAQSGGDSSGNRSNDCYFPGLHDDLSQDCLAWASRSDYPSLSCLNKRFNLLINSGYLYRLRRKYDIVEHWVYLACSLMPWEAFDPSRKRWMRLPRMPCDECFSCADKESLAVGTQLLVFGREYTGLAIWMYNLLTRSWSPCTPMNLPRCLFASGSSGEIAIVAGGCDKNGQVLRSAELYNSEIGHWETIPDMNLPRRLSSGFFMDGKFYVIGGVSSQRDSLTCGEEYNLETRTWRRILDMYPGGTSASQSPPLVAVVNNQLYAADQSTNVVKKYDKANNAWNILKPLPVRADSSNGWGLAFKACGDRLLVIGGHRGPRGEVILLHSWCPEGGEDGADWEVLSVKERAGVFVYNCAIMGC

SEQ ID NO: 9962 - protein, 298 aa, Zea mays
MPWEAFDPSRKRWMRLPRMPCDECFSCADKESLAVGTQLLVFGREYTGLAIWMYNLLTRSWSPCTPMNLPRCLFASGSSGEIAIVAGGCDKNGQMLRSAELYNSEIGHLDTIPDMNLPRRLSSGFFMDGKFYVIGGVSSQRDSLTCGEEYTLETRTWRRIFDMYPGGTSASQSPPLVAVVNNQLYAADQSTNVVKKYDKANNAWNILRPLPVRADPSNGWGLAFKACGDRLLVIGGHRGPRGEVILLHSWCPEGGEDGADWEVLLVKERAGVFVYNCAIMGCWCATGCHHVHDAHGCF

SEQ ID NO: 9963 - protein, 527 aa, Sorghum bicolor
MATRSTHRRPLLLILLFLLLFAAVNGSARPSTSPIKNVVVLALENRSFDHMLGWMRRLLGLPVDGLTGAECNPNSTNSTTSSICVSADADLVVPDDPGHSFEDVLEQVFGNGNISAAQPSMSGFVRSALSVNALLSSAVMRAFRPSLLPAFSALAPAFAVFDRWFSSIPGPTQPNRLFLYSATSRGAVAHDKLDLLLGYPQRTIFESLAADGHDFAVYFKTIPTVLFYRRLRALRYAARSFHRYDAAFKDHARRGVLPALSVIEPRYFDLTGTPADDDHPAHDVANGQRLVKDVYEALRASPQWNQTLLIVTYDEHGGFYDHVATPTAGVPSPDGIRGPPPFFFKFDRLGVRVPTIMVSPWIKKGTVVGRAVGPTDTSEFEHSSIPATIKKIFNLSSDFLTKRDAWAGTFEHIFTELDQPRTDCPETLPEVPFVRPTPPKEHGWLSDFQRELVELASFLNGDYMLTSLAQESRKKKMTVKQADAYVRRAITSFLQASKQAVRLGANESAIVTMRSSLTSKSSSSSNP

SEQ ID NO: 9964 - protein, 525 aa, Panicum virgatum
MATGSRRQPLPLLLLLPLILLAGRGEAGAARPSPIKNVVVLALENRSFDHILGWTRRLLGLPVDGLTGAECNPNSSPNSSAICVSADADLVVPDDPGHSFEDVLEQVFGNVSAAAAQPSMSGFVRSALSVNALLSSAVMRAFRPALLPAFSALAPAFAVFDRWFSSIPGPTQPNRLFLYSATSRGAVAHNKLDLLLGYPQRTIFDSLAADGRGFAVYFKTIPTVLFYRRLRALRHAARSFHRYDAAFKDHARRGVLPALSVIEPRYFDLTGTPADDDHPAHDVANGQRLVKDVYEALRAGPQWNQTLLVVTYDEHGGFYDHVATPTAGVPSPDGIRGPPPFFFKFDRLGVRVPTIMVSPWIKKGTVVGRPAGPTDTSEFEHSSIPATLKKIFNLSSDFLTKRDAWAGTFEHIFTELDEPRTDCPETLPEVPFERPTPPNEHGWLSDFQRELVELASFLNGDYMLTSLAQEARTKKMTVKQADAYVRRAITGFLRASKQALRLGANESAIVTMRSSLTSKSTGSSP

SEQ ID NO: 9965 - protein, 523 aa, Panicum virgatum
MATGSPRRQPLLLLLLLILLADSGEASAARPSPIKNVVVLALENRSFDHMLGWTRRLLGLPVDGLTGAECNPNSSSPSAANSSSSICVSADADLVVPDDPGHSFEDVLEQVFGNISGAAAQPSMSGFVRSALSVNALLSSAVMRAFRPALLPAFSALAPAFAVFDRWFSSIPGPTQPNRLFLYSATSRGAVAHDKLDLLLGYPQRTIFDSLAADGRGFAVYFKTIPTVLFYRRLRALRHAARSFHRYDAAFKDHARRGVLPALSVIEPRYFDLTGTPADDDHPAHDVANGQRLVKDVYEALRASPQWNQTLLIVTYDEHGGFYDHVATPTAGVPSPDGIRGPPPFFFKFDRLGVRVPTIMVSPWIKKGTVVSRPVGPTDTSEFEHSSIPATLKKIFNLSSDFLTKRDAWAGTFEHIFTELDEPRTDCPETLPEVPFERPTPPKEHGWLSDFQRELVELASFLNGDYMLTSLAQEARTKTMTVKQADAYVRRAITGFLQASKQAVRLGANESAIVTMRPSLTSN

SEQ ID NO: 9966 - protein, 548 aa, Setaria italica
MAMGSPRRRAPRPMPLPLLLLLFFLVAGSGEANAAVRGADDGARPSPIKNVVVLALENRSFDHMLGWTRRLLGLPVDGLTGAECNPNSANSTTTSSSSSICVSADADLVVPDDPGHSFEDVLEQVFGNISSGAGAAAAQPSMSGFVRSALSVNALLSSAVMRAFRPSLLPTFSALAPAFAVFDRWFSSIPGPTQPNRLFLYSATSRGAVAHDKLDLLLGYPQRTIFDSLAADGRGFGVYFKTIPTVLFYRRLRALRYAARSFHRYDAAFRDHARRGVLPALSVIEPRYFDLTGTPADDDHPAHDVANGQRLVKDVYEALRASPQWNQTLLIVTYDEHGGFYDHVSTPTAGVPSPDGIRGPPPFFFKFDRLGVRVPTIMVSPWIKKGTVVGRPAGPTDTSEFEHSSIPATLKKIFNLSSDFLTKRDAWAGTFEHIFTELDQPRTDCPETLPEVPFERPTPPNEHGWLSDFQRELVELASFLNGDYMLTSLAQETRRKKMTVKQADAYVRRAITGFLQASKQAVRLGANESAIVTMRSSLTSKTTTSSSP

SEQ ID NO: 9967 - protein, 528 aa, Hordeum vulgare
MGMRALLLLLLLPLAFAAAGNASAGPREASPIKNVVVLALENRSFDHMLGWMRRLLGLPIDGLTGAECNVGPTNSTLPPVCVSADATLVVPDDPGHSFEDVLDQVFGFRPNSTAADQPAPPTMSGFVRSALSVNSLLSSAVMRGFTPSLLPAFSALAADFAVFDRWFSSLPGPTQPNRLFLYSATSHGAVAHDKWNLLRGYPQRTIFDSLAADGRRFNVYFKTIPTTLFYRNLRTVRAAAQSFHFYDSAFRDHARRGRLPALSVIEPRYFDLTGTPADDDHPAHDVANGQRLVKDVYETLRASPQWNDTLLIVTYDEHGGFYDHVATPVAGVPSPDGLRGPVPFFFKFDRLGVRVPTMMVSPWIKKGMVVGRPPNGPTATSEYEHSSIPATIKKIFNLRSDFLTKRDEWAGTFEHIFTQLDQPRTDCPETLPEVPFERTTPAKEHGILSDFQRELVELASFLNGDYMLTSFAQETQKKMTVKQADTYVRRAIKGFLHASRQARRLGANESAIVTMRSSLTSKSTTSRP

SEQ ID NO: 9968 - protein, 412 aa, Setaria italica
MQLFQGEKPAHDFLSLHTGGGSSSPVQHSTQGYDLGVQSSLKPLKMGKRRGGGGGGGDGAIGMAPLGLEADSEKHALPGGVGTFSIRQVPSTTQPRGQGVVRDAFAPVLHGSRTEGTPGAESGARAHSGPATMWQDSGTDQRSRATRGEGRSSGSSGDQGPSTPRSKHSATEQRRRTKINDRLEILRELLPHGDQKRDKASFLLEVIEYIRFLQEKVQKYESGHPQKNHEDSSMPWAKVYYRSCWKNTENISQVQGGGLSAPTQDLNNEQYCSEKSTVAPTAHFSTQSAGETSIDDISSQKATSTPKNWADDSTPSKQPPWLSMSTSDSGDRTLSKNENNTLHEDTRSLSNAYSQGLLNRLTQALKRSGVDPSQASISVEINMDKREPSNMHDNLKDNECEETIHVHKKLRC

SEQ ID NO: 9969 - protein, 215 aa, Panicum virgatum
MASAVSLLLLSSPRPLHRTGLLRVPRRGGLLPLPGPAQAPRRLLAAAPPPRASNNNDNSGAVGAPDRLVAAVAYLYPFLDGAHHGRFLLAQFPFFSALLRPLAPAARLFHSSPLTPFLLFLTLYFAVVRNQQAFSRFVRFNAMQAVALDVLLIFPDLLAQSFAPSGGVGFEIFQSMESTVFLFLLVCFVYGGGACLLGKTPRLPIVADAAERQVM

SEQ ID NO: 9970 - protein, 204 aa, Echinochloa colona
MASAVSLLLLSSPRPLHRTGLLCSPRRGAVLPVPGPAQSPRRLLAAAPRASNNNDNSEAVEAPDRLVAAVAYLYPFLDGAHHGRFLLAQFPVFSALLRPLGPAARLFHSSPLTPFLLFLTLYFAVVRNQQAFSRFVRFNAMQAVALDVLLISPTCSRSPSRPRRGRVRGLPEPGEHGLPLPARLLGVRRGRLPSREDAAAAHRR

SEQ ID NO: 9971 - protein, 432 aa, Sorghum bicolor
MQLFQGEKPAHDFLSLHTGGGSSSPSPVQHSTQGYELGVHNSLKPLKLGKRRGGGGGEGGAIGVAPSSGLEADSEERVLPGGVGTFSIRQVASAATQSRGGEAASHGVVVVRGAAAFPPAVHVSRTEGPPHGTESGARAHSGPATMWQDSGMDQRSRGARGGEGRSRSSGSSADQGPSTPRSKHSATEQRRRTKINDRLEILRELLPHGDQKRDKASFLLEVIEYIRFLQEKVQKYESAHPQKNHEDSSMPWAKVYYRSCWKNTENINQGGGLAASTQDTNKEQYGSKQTTVASSALFDTQSAREASANDISSQKPTSTAQSRADNNIASKQLPWLSMSTSDSDNNRTLSKNEKQTLHEDTQSLSDAYSQGLLNRLTQALKRSGVDPSQASISVEISMDRRGTEPNNIRDDLKDNECEDTIHVTKKLRCERS

SEQ ID NO: 9972 - protein, 208 aa, Panicum virgatum
MASAVSLLLLSSPRPLRGAGLLRVPRRGALLPLPGPAQAAPPPRASNNNDNSGAVEAPDRLVAAVAYLYPFLDGAHHGRFLLAQFPVFSALLRPLAPAARLFHSSPLTPFLLFLTLYFAVVRNQQAFSRFVRFNAMQAVALDVLLIFPDLLAQSFAPSGGVGFEIFQSMESTVFLFLLVCLLYGGGACLLGKTPRLPIVADAAERQVM

SEQ ID NO: 9973 - protein, 216 aa, Sorghum bicolor
MASAVSLLLLSPPRHLHRDVTSRLLSTPHRRVLLAAPTSATPRRLLAAPPPRASNNNDNSGAVEAPDRLVAAVAYLYPFLDGAHHGRFLLAQFPFFNALLRPLGPAARLFHSSPLTPFLLFLTLYFAVVRNQQAFSRFVRFNAMQAVVLDVLLIFPDLLAQSFAPSGGVGFEVFQSMESTVFLFLLVSLVYGSGACLLGKTPRLPIVADAAERQVM

SEQ ID NO: 9974 - protein, 214 aa, Zea mays
MASAVSLLLSPPRLLHRDGTSRLLSIPHRRVLLAAPNNATPRRLLAPAPRASNKNDNSGAVEAPDRLVAAVAYLYPFLDGAHHGRFLLTQFPFFGALLRPLAPAARLFHSSPLTPFLLFLTLYFAVVRNQQAFSRFVRFNAMQAVVLDVLLIFPDLLAQSFAPSGGVGFEIFQSMESTVFLFLLVSLVYGGGACLLGKTPRLPIVADAAERQVM

SEQ ID NO: 9975 - protein, 417 aa, Brachypodium distachyon
MCNSAGEEPAHDFLSLRAGGGSSPFQHRLQSAQQAGYGLGPHSLVKPAEPVKQSSSHGGDGAVSAAADLGEQVLPGGVGTFSIRQVPDARPREEAGMGRDASVAAVHQGSRMEIAHEARSGAMVRSAPPSTMWQDSGIDKRSRDTDCYEHSAARSSGSSADQEPSSPRSKHSATEQRRRTKINDRLDILRELLPNCDQKRDKASFLLEVIEYIRLLQEKCQKYESAIPEKDPTDSKSMAWDKVYCRSRWRNTQNISQGQGGGLSAATEDMNNEQHCSPKGITVAPTSLFTTQSVKETSTTASSSQNIIENNMPNNQLSWLSMSTMNQNSNASNSKLSKQETQSLRNDTQSLSSAYSQGLLHKLKEALQKSGVDPSQANISVEINMDKRARANAHIHDNSKANEGKEPMHITKRLRCD

SEQ ID NO: 9976 - protein, 408 aa, Brachypodium distachyon
MELFQGEEPAHDFLSLRAGGGSSPFQHRLQSAQQGYGLGPHSLVKPAEPVKQSSSHGGDGAVSAAADLGEQVLPGGVGTFSIRQVPDARPREEAGMGRDASVAAVHQGSRMEIAHEARSGAMVRSAPPSTMWQDSGIDKRSRAARSSGSSADQEPSSPRSKHSATEQRRRTKINDRLDILRELLPNCDQKRDKASFLLEVIEYIRLLQEKCQKYESAIPEKDPTDSKSMAWDKVYCRSRWRNTQNISQGQGGGLSAATEDMNNEQHCSPKGITVAPTSLFTTQSVKETSTTASSSQNIIENNMPNNQLSWLSMSTMNQNSNASNSKLSKQETQSLRNDTQSLSSAYSQGLLHKLKEALQKSGVDPSQANISVEINMDKRARANAHIHDNSKANEGKEPMHITKRLRCD

SEQ ID NO: 9977 - protein, 224 aa, Brachypodium distachyon
MASTVSLLLSSPRPLHRAAPSLLKSPAPRFPLLGATPTAGVGVTALRPRPRSLRLLAPPPRANNDNSDAVGAPDRLVAAVAYLYPFLDGAHHGRFLVAQFPFFNALLGPLAPAARLFHSSPLTPFLLFLTLYFAVVRNQQAFSRFVRFNAMQAVALDVLLIVPDLLAQSFAPSGAGIGLDIFQSLENTVFLFLLVCLVYGGGACMLGMTPRLPIVADAAERQVM

SEQ ID NO: 9978 - protein, 220 aa, Leymus cinereus x Leymus triticoides
MASAVSLLLSSPRPLHRAAPSLLRSPAPRGRLPFLGPSSATALLPRRPHGLLAPPPRANNDNSDAVGAPDRLVAAVAYLYPFLDGAHHGRFLVAQYPVFNALLSPLGPAARLFHSSPLTPFLLFITLYFAVVRNQQAFSRFVRFNAMQAVALDVLLIVPDLLAQSFAPSGGGIGLDIFTSLENTVFLFLLVSLVYGGGACLLGMTPRLPIVADAAERQVM

SEQ ID NO: 9979 - protein, 279 aa, Saccharum officinarum
MAACRGFFECLLRLLNFILTVAGLAMVGYGIYLLVEWMKISEDGSGGGLTAEVLVSGRPLLGAVALGDSFLDELPKAWFIYLFIGVGAIVFLVSLFGCIGAGTRNTCCLCFYAFLVILLILAEAGAAAFIFFDQSWKDVIPVDKTHNFDVMYDFLKENWEIARWVALGVVVFEAVLFLLALVVRAMNKPAEYDSDDEIIAIGRSPTMRQPLIHAQNVPATGVPVPTLDQRASRNDAWSQRMREKYGLDTSQFTYNPSDPSRYQQNGTPQAEERSRCTVM

SEQ ID NO: 9980 - protein, 279 aa, Zea mays
MAACRGFFECLLRLLNFILTVAGLAMVGYGIYLLVEWMKISEDGSSGGLTAEVLVSGRPLLGAVALGDSFLDMLPKAWFIYLFIGVGATVFLVSLFGCIGAGTRNTCCLCFYAFLVILLILAEAGAAAFIFFDHSWKDVIPVDKTHNFDVMYGFLKKNWEIARWVALGVVVFEAVLFLLALVVRAMNKPAEYDSDDEIIAIGRSPTMRQPLIHAQNVPATGVPVPTLDQRSSRNDAWSQRMREKYGLDTSQFTYNPSDPSRYQQNGAPQAEERSRCTIM

SEQ ID NO: 9981 - protein, 279 aa, Zea mays
MAACRGFFECLLRLLNFILTVAGLAMVGYGIYLLVEWMKISEDGIGGASTAEVLVSGRPLLGAVILGDSFLDNLPKAWFIYLFIGVGTIVILVSLFGCIGAGTRNTCCLCFYAFLVILLILAEAAAAAFIFFDHGWKDVIPVDKTHNFDVMYDFLKENWEIARWVALGVVVFEAVLLLLALAVRAMNKPAEYDSDDEIIAIGRSPTIRQPLIHTQNVPATGVPVPTLDQRASRNDAWSQRMREKYGLDTSQFTYNPSDPSRYQQNGTPRAEERSRCTIM

SEQ ID NO: 9982 - protein, 278 aa, Echinochloa colona
MAACRGFFECLLRLLNFVLTVAGLAMVGYGIYLLVEWMKISEGGGGGSSAEVLVLGRPLLGAVALGDSFLDKLPKAWFIYLFIGIGAIVFLVSLFGCIGAGTRNTCCLCFYAFLVLLLILAEGGAAAFIFFDHSWKDVIPVDKTHNFDVMYDFLKENWEIARWVPLGVVVFEALLFLLALVVRAMNKPAEYDSDDEIIAIGRSPTMRQPLIHSQNVPATGVPVPTLDQRASRNDAWSQRMREKYGLDTSQFTYNPSDASRYQQNGAPQAEERSRCTIM

SEQ ID NO: 9983 - protein, 279 aa, Panicum virgatum
MAACRGFFECLLRLLNFFLTVAGLAMVGYGIYLLVEWMKISGGGGGGGSPAHVLVLGRPLLGAVALGDSFLDKLPKAWFIYLFIGVGAVVFLVSLFGCIGAGTRNTCCLCFYAFLVLLLILAEAGAAAFIFFDHSWKDVIPKDKTHNFDVMYGFLKDNWEIARWVALGVVVFEAVLFLLALVVRAMNKPAEYDSDDEIIAIGRSPTMRQPLIHAQNVPATGVPVPTLDQRASRNDAWSQRMREKYGLDTSQFTYNPSDPSRYQQNGAPQAEERSRCTIM

SEQ ID NO: 9984 - protein, 278 aa, Setaria italica
MAACRGFFECLLRLLNFVLTVAGLAMVGYGIYLLVEWMKISKGGGGGTPAEVLVLGRPLLGAVALGDSFLDKLPKAWFIYLFIGVGAIVFLVSLFGCIGAGTRNTCCLCFYAFLVLLLILAEGGAAAFIFFDNSWKDVIPKDKTHNFDVMYDFLKDNWEIARWVALGVVVFEAVLFLLALVVRAMNKPAEYDSDDEIIAIGRSPTLRQPLIHGQNVPATGVPVPTLDQRASRNDAWSQRMREKYGLDTSQFTYNPSDPSRYQQNGAPQAEERSRCTIL

SEQ ID NO: 9985 - protein, 276 aa, Panicum virgatum
MAACRGFFECLLRLLNFFLTVAGLAMVGYGIYLLVEWMKISGGGGSPAHVLVLGRPLLGAVALGDSFLDHLPKAWFIYLFIGVGAIVFLVSLFGCIGAGTRNTCCLCFYAFLVLLLILAEAGAAAFIFFDHSWIDVIPKDKTRNFDVMYDFLKDNWEIARWVALGVVVFEAVLFLLALTVRAMNKPAEYDSDDEIIAIGRSPTMRQPLIHAQNVPATGVPVPTLDQRASRNDAWSQRMREKYGLDTSQFTYNPSDPSRYQQNGAPQAEERSRCTIM

SEQ ID NO: 9986 - protein, 279 aa, Pennisetum glaucum
MAACRGFFECLLRLLNFVLTVAGLAMVGYGIYLLVEWMKISKGGGGGGSPAEVLVLGRPLLGAVALGDSFLDKLPKAWFIYLFIGVGAIVFLVSLFGCIGAGTRNTCCLCFYAFLVLLLILAEAGAAAFIFFDNSWKDVIPKDKTHNFDVMYDFLKGNWEIARWVALGVVVFEAVLFLLALVVRAMNKPAEYDSDDEIIAIGRSPTLRQPLVHGQNAPATGVPVPTLDQRTSRHDAWSQRMREKYGLDTSQFTYNPSDPSRYQQNGAPQAEERGRCTIM

SEQ ID NO: 9987 - protein, 284 aa, Cynodon dactylon
MAACRGFFECLLKLLNFFLTAAGLAMVGYGIYLLVEWMKISGGGGDSPADVLVFGRPLLTTVPLGDAGDFFDNLPKAWFIYLFIGVGAIVFLVSLFGCIGAGTRNTCCLCFYAFLVILLILAEAGAAAFIFFDHSWKDVIPVDKTHNFDVMYNFMKENWEIARWVALGVVVFEALLFLLALVVRAMNKPAEYDSDDEIIIGYGRNPGRSTSIRQPLVHSQNVPATGVPVPQLDQRTSRHDAWSQRMREKYGLDTSQFTYNPSDSSRYQQNGATASEERSRCTIM

SEQ ID NO: 9988 - protein, 286 aa, Festuca arundinacea
MAACRGFFECLLRLLNFVLTVAGLAMVGYGVYLLVEWMKISGGGGGGAPPSPAPPVELLLFGRPMLTAVALGDGASIFDKLPRAWFIYLFIGVGAVVFLVSLFGCIGTGTRNTCCLCFYSFLVLLLILVEAGAAAFIFFDHSWKDVIPVDKTQNFDEMYDFLKDNWEIARWVALGVVVFEVLLFLLALIVRAMNKPAEYDSDDEIIGNARNSGIRQPLIHSQNAPATGVPVPTLDQRASRNDAWSQRMREKYGLDTSQFTYNPSDGNRYQQNGAPQAEERSRCTIM

SEQ ID NO: 9989 - protein, 284 aa, Oryza sativa
MACRGFFECLLKLLNFVLTVAGLAMVGYGIYLLVEWMRISGGGGGAPPSPAPPAELLMFGRPMLTAVALGDGGSFFDKLPKAWFIYLFIGVGAIIFVISLFGCIGAATRNTCCLCCYAFLVILLILVEAGAAAFIFFDESWKDVIPVDKTENFDVMYDFLKENWEIARWVALGSVIFEVLLFLLALVVRAMNKPAEYDSDDEIIATSRSTSIRQPLIHSQNVPATGVPVATLEQRASRNDAWSQRMREKYGLDTSQFTYNPSDPSRYQQNGAPPAEERNRCVIL

SEQ ID NO: 9990 - protein, 285 aa, Triticum aestivum
MAACRGFFECLLRLLNFFLTVAGLAMVGYGIYLLVEWMRISGGGEGAPPSPAPPAELLTFGRPMLTVVALGEGGSFFDKLPKAWFIYLFIGVGAVIFIVSLFGCIGAGTRNTCCLCCYSFLVILLILAEAGGAAFIFFDHSWKDVIPVDKTQNFDAMYDFLNENWKIARWVALGVVVFEVLLFLLALAVRAMNKPAEYDSDDEIIGTARSTSIRQPLIHSQNAPATGVPVPTLDQRASRNDAWSQRMREKYGLDTSQFTYNPSDATRYQQNGAPPAEERSRCTVM

SEQ ID NO: 9991 - protein, 285 aa, Secale cereale
MAACRGFFECLLRLLNFFLTVAGLAMVGYGIYLLVEWMRISGGGGGPPPSPAPPVELLTFGRPMLTVVALGEGGSFFDKLPKAWFIYLFIGVGAVIFIVSLFGCIGAGTRNTCCLCCYSFLVILLILAEAGGAAFIFFDHSWKDVIPVDKTQNFDAMYDFLKENWKIARWVALGVVVFEVLLFLLALAVRAMNKPAEYDSDDEIIGTSRSTSIRQPLIHSQNAAATGVPVPTLDQRASRNDAWSQRMREKYGLDTSQFTYNPSDATRYQQNGAPPAEERSRCTLM

SEQ ID NO: 9992 - protein, 285 aa, Secale cereale
MAACRGFFECLLRLLNFFLTVAGLAMVGYGIYLLVEWMRISGGGGGPSPSPAPPVELLTFGRPMLTVVALGEGGSFFDKLPKAWFIYLFIGVGAVIFIVSLFGCIGAGTRNTCCLCCYSFLVILLILAEAGGAAFIFFDHSWKDVIPVDKTQNFDAMYDFLKENWKIARWVALGVVVFEVLLFLLALAVRAMNKPAEYDSDDEIIGTSRSTSIRQPLIHSQNAAATGVPVPTLDQRASRNDAWSQRMREKYGLDTSQFTYNPSDATRYQQNGAPPAEERSRCTLM

SEQ ID NO: 9993 - protein, 285 aa, Triticum aestivum
MAACRGFFECLLRLLNFFLTVAGLAVVGYGIYLLVEWMRISGGGGGAPPSPAPPAELLTFGRPMLTVVALGEGGSFFDKLPKAWFIYLFIGVGAVIFVVSLFGCIGAGTRNTCCLCCYSFLVILLILAEAGGAAFIFFDHSWKDVIPVDKTQNFDAMYDFLNENWKIARWVALGVVVFEVLLFLLALAVRAMNKPAEYDSDDEIIGTARSTSIRQPLIHSQNAPATGVPVPTLDQRASRNDAWSQRMREKYGLDTSQFTYNPSDATRYQQNGAPPAEERSRCTVM

SEQ ID NO: 9994 - protein, 286 aa, Lolium multiflorum
MAACRGFFECLLRLLNFVLTVAGLAMVGYGVYLLVEWMKISGGGGGGAPPSPAPPAELLLFGRPMLTAVALGDGGSIFDKLPRAWFIYLFIGVGAVVFLVSLFGCIGTGTRNTCCLCFYSFLVLLLILVESGAAAFIFFDHSWKDVIPVDKTQNFDEMYDFLKDNWEIARWVALGVVVFEVLLFLLALIVRAMNKPAEYDSDDEIIGNARNSSIRQPLVHSQNPPANGVPVPTLDQRASRNDAWSQRMREKYGLDTNQFTYNPSDGTRYQQNGAPAAEERSRCTIM

SEQ ID NO: 9995 - protein, 285 aa, Pseudoroegneria spicata
MAACRGFFECLLRLLNFFLTVAGLAMVGYGIYLLVEWMRISGGGGGAPPSPAPPAELLTFGRPMLTVVVPGEGGSFFDKLPKAWFIYLFIGVGAVIFIVSLFGCIGAGTRNTCCLCCYSFLVILLILAEAGGAAFIFFDHSWKDVIPVDKTQNFDAMYDFLKENWKIARWVALGVVVFEVLLFLLALAVRAMNKPAEYDSDDEIIGTTRSTSIRQPLIHSQNAPATGVPVPTIDQRASRNDAWSQRMREKYGLDTSQFTYNPSDATRYQQNGAPPAEERSRCTVM

SEQ ID NO: 9996 - protein, 285 aa, Avena sativa
MAACRGFFECLLRLLNFVLTVLGLAMVGYGVYLLLEWMKISGGGSGAPPSPAPPAELLLFGRPMLTAVALSDGGSFFDKLPRAWFIYLFIGVGVVVFLVSLFGCIGAGTRNTCCLCCYSFLVLLLILVEAGAAAFIFFDRSWKDVIPVDKTQNFDEMYDFLKHNWEITRWVALGVVVFEVLLFLLALIVRAMNKPAEYDSDDEIIGTARNNSIRQPLVHSQNAPATGVPVPTLDQRASRNDAWSQRMREKYGLDTSQFTYNPSDGTRYQQNGAPPAEERSRCTIM

SEQ ID NO: 9997 - protein, 285 aa, Leymus cinereus x Leymus triticoides
MAACRGFFECLLRLLNFFLTVAGLAMVGYGIYLLLEWMRISGGGGGAPPSPAPPAELLMFGRPMLTVVALGEGGSFFDKLPKAWFIYLFIGVGAVIFIVSLFGCIGAGTRNTCCLCCYSFLVILLILAEAGGAAFIFFDDSWKDVIPVDKTQNFDAMYNFLKKNWKIARWVALGVVVFEVLLFLLALAVRAMNKPAEYDSDDEIIGTARSTSIRQPLVHSQNAPATGVPVPTLDQRASRNDAWSQRMREKYGLDTSQFTYNPSDATRYQQNGAPLAEERSRCTVM

SEQ ID NO: 9998 - protein, 285 aa, Avena sativa
MAACRGFFECLLRLLNFVLTVLGLAMVGYGVYLLLEWMKISGGGGGAPPSPAPPAELLLFGRPMLTAVALSDGGSFFDKLPRAWFIYLFIGVGVVVFLVSLFGCIGAGTRNTCCLCCYSFLVLLLILVEAGAAAFIFFDRSWKDVIPVDKTQNFDEMYDFLKHNWEITRWVALGVVVFEVLLFLLALIVRAMNKPAEYDSDDEIIGTARNNSIRQPLVHSQNAPATGVPVPTLDQRASRNDAWSQRMREKYGLDTSQFTYNPSDGTRYQQNGAPPAEERSRCTIM

SEQ ID NO: 9999 - protein, 285 aa, Avena sativa
MAACRGFLECLLRLLNFVLTVLGLAMVGYGVYLLLEWMKISGGSGGAPPSPAPPSELLLFGRPMLTAVALGDGGSFFDKLPRAWFIYLFIGVGVVVFLVSLFGCIGAGTRNTCCLCCYSFLVLLLILVEAGAAAFIFFDRSWKDVIPVDKTQNFDEMYDFLKHNWEITRWVALGVVVFEVLLFLLALIVRAMNKPAEYDSDDEIIGTARNNSIRQPLVHSQNAPATGVPVPTLDQRASRNDAWSQRMREKYGLDTSQFTYNPSDGTRYQQNGAPPAEERSRCTIM

SEQ ID NO: 10000 - protein, 486 aa, Zea mays
MSRDAHLGVGVEGDAAEEKNAAADGGEGVGFRSGGGGGHKLSLVPLIFLIFFEVAGGPYGAEPAVQAAGPLYALLGFLIFPFIWAIPEALVTAELSTAMPGNGGFVLWADRAFGPFSGSLMGTWKYVSSAINGAAFPALCADYLARVAPAVSGGGARVATIVAFNVALTFVNYTGLTVVGWSAVGLGVASLSPFLVMSGAALPKIRPRRWRVVAAERDWKLFFNTLFWNLNYWDSVSTMAGEVERPGKTLPKALVSAVSMTSLGYLLPLMAATGAIDVAPESWGNGFFADAAGMIGGRWLKYWIEVGAVLSSIGLYSATLSSAAFQLLGMADLGLLPRAFAARAPVFRTPWVSILATSAIILGMSFLSFNSIVAAANFLYSLGMLLEFAAFVWLRVKRPAMARPYRVPARLPAAVALCLVPSAFLVFVMAIAGWKVYAISAAFTAAGVAVYYLMRFCKARGCLRFSDGGDQGTTAVYQDGSNAGDV

SEQ ID NO: 10001 - protein, 794 aa, Panicum virgatum
MDGHHLPPSHQSPPAQPERRGSFNYDIESTDAAWRGAHTASEALMRYDDDGTREPLLRKRTTNTTSQIAIVGANVCPIESLDYEIVENDLIKQDWRSRKKKQIFQYIVLKWSLVLLIGLCTGLVGFFNNLAVENIAGFKLLLTGDLMLQKRYFTAFLAYGGCNLVLAASAAAICAYIAPAAAGSGIPEVKAYLNGIDAYAILAPSTLFVKIFGSILGVSAGFVLGKEGPMVHTGACIANLLGQGGSRKYHLTCNWLRYFKNDRDRRDLITCGSAAGVAAAFRAPVGGVLFALEEAASWWRSALLWRTFFTTAVVAVVLRGLIGFCRSGKCGLFGQGGLIMFDLSATIPTYSTQDIVAIIVLGIIGGVFGGLFNFLLDRILRAYSFINEKGAPYKILLTITISIITSACSYGLPWLAPCTPCPADAVEQCPTIGRSGNYKNFQCPPGHYNGLASLFFNTNDDAIRNLFSSGTEKEFHMSTLFVFFTAIYCLGLVTYGIAVPSGLFIPVILAGATYGRIVGTLLGPISDLDPGLFALLGAASFLGGTMRMTVSVCVILLELTNDLLMLPLVMLVLLISKTIADSFNKGVYDQIIVMKGMPFLEAHAEPYMRHLVAGDVVSGPLISFSGVERVGNIVQALRITGHNGFPVVDEPPLSEAPELVGLVLRSHLLVLLKGKGFMKDKVKTSGSFVLKKFGAFDFAKAGSGKGPKIEDLDFTDEEMDMYVDLHPITNTSPYTVVETMSLAKAAVLFRALGLRHLLVVPKTPGRPPIVGILTRHDFMPEHIHELFPNLHKSH

SEQ ID NO: 10002 - protein, 794 aa, Panicum virgatum
MDGNHLPPSQQPPPAQPERRSSFNYDIESTDAAWRGTHTASEALMRYDDDGPREPLLRKRTTNTTSQIAIVGANVCPIESLDYEIVENDLIKQDWRSRKKQQIFQYIVLKWSLVLLIGLCTGLVGFFNNLAVENIAGFKLLLTSDLMLQKRYFTAFLAYGGCNLVLAASAAAICAYIAPAAAGSGIPEVKAYLNGIDAYAILAPSTLFVKIFGSILGVSAGFVLGKEGPMVHTGACIANLLGQGGSRKYHLTCNWLRYFKNDRDRRDLITCGSAAGVAAAFRAPVGGVLFALEEAASWWRSALLWRTFFTTAVVAVVLRGLIGFCRSGKCGLFGQGGLIMFDLSATIPTYSAQDVVAIIVLGIIGGVFGGLFNFLLDKILRAYSFINEKGAPYKILLTITISIITSACSYGLPWLAPCTPCPADAVEQCPSIGRSTNYKNFQCPPGHYNGLASLFFNTNDDAIRNLFSSGTEKEFQMSTLFVFFTAIYCLGLVTYGIAVPSGLFIPVILAGATYGRIVGTLLGPISDLDPGLFALLGAASFLGGTMRMTVSVCVILLELTNDLLMLPLVMLVLLISKTIADSFSKGVYDQIIVMKGMPFLEAHAEPYMRHLVAGDVVSGPLISFSGVERVGNIVQALRITGHNGFPVVDEPPLSEAPELVGLVLRSHLLVLLKGKGFMKDKVKTSGSFVLKKFGAFDFAKAGSGKGPKIEDLDFTDEEMDMYVDLHPITNTSPYTVVETMSLAKAAVLFRALGLRHLLVVPKTPGRPPIVGILTRHDFMPEHIHGLFPNVHKSH

SEQ ID NO: 10003 - protein, 798 aa, Sorghum bicolor
MDAAHHSPPDAQPERHGSFNYDIESTDGPWRGAGAGQDRSSEALLRYDDRYDDDGPRQPLLRKRTMNTTSQIAIVGANVCPIESLDYEIVENELFKQDWRSRKKKQIFQYIVLKWSLVLLIGLCTGLVGFFNNLAVENIAGFKLLLTSDLMLKHRYFTAFLAYGGCNLVLAATAAAICAYIAPAAAGSGIPEVKAYLNGVDAYAILAPSTLFVKIFGSILGVSAGFVLGKEGPMVHTGACIANLLGQGGSRKYHLTCNWLRYFKNDRDRRDLITCGSAAGVAAAFRAPVGGVLFALEEAASWWRSALLWRTFFTTAVVAVVLRGLIELCRSGKCGLFGQGGLIMFDLSSTVPSYSTQDIIAIIVLGIIGGVFGGLFNFLLDRILRAYSFINEKGAPYKILLTITISIITSACSYGLPWLAPCTPCPADAVEECPTIGRSGNFKNFQCPPGYYNGLASLFFNTNDDAIRNLFSSGTENEFHMSTLFVFFTAIYCLGLVTYGIAVPSGLFIPVILAGATYGRIVGTLLGPISDLDPGLFALLGAASFLGGTMRMTVSVCVILLELTNDLLMLPLVMLVLLISKTIADSFNKGVYDQIVVMKGLPFLEAHAEPHMRHLVAGDVVSGPLISFSGVERVGNIVQALRITGHNGFPVVDEPPLSEAPELVGLVLRSHLLVLLKGKGFMKEKMKTSGSFVLQRFGAFDFAKPGSGKGLKIEDLDFTDEEMDMYVDLHPITNTSPYTVVETMSLAKAAVLFRALGLRHLLVVPKTPGRPPIVGILTRHDFMPEHIHGLFPNIHKSH

SEQ ID NO: 10004 - protein, 795 aa, Zea mays
MDANHSPPAQPERNHGSLNYDIESTDGTWRGAGAWQEQDPSSEALMRYDDDGPREPLLRRRTMNTTSQIAIVGANICPIESLDYEIVENDLFKQDWRSRKKQQIFQYIVLKWSLVLLIGLCTGLVGFFNNLAVENIAGFKLLLTSDLMLKQRYFTAFLAYGGCNLVLAAAAAAICAYIAPAAAGSGIPEVKAYLNGVDAYAILAPSTLFVKIFGSILGVSAGFVLGKEGPMVHTGACIANLLGQGGSRKYHLTCNWLRYFKNDRDRRDLITCGSAAGVAAAFRAPVGGVLFALEEAASWWRSALLWRTFFTTAVVAVVLRGLIQFCRSGKCGLFGQGGLIMFDLSSTVPSYSTQDIIAIIVLGIIGGVFGGLFNFLLDRILRAYSFINERGAPYKILLTVTISIITSACSYGLPWLAPCTPCPADAVEECPTIGRSGNFKNFQCPPGYYNGLASLFFNTNDDAIRNLFSSGTENEFHMSTLFVFFTAIYCLGLVTYGIAVPSGLFIPVILAGATYGRIVGTLLGPISDLDPGLFALLGAASFLGGTMRMTVSVCVILLELTNDLLMLPLVMLVLLISKTIADSFNKGVYDQIVVMKGLPFLEAHAEPYMTHLVASDVVSGPLISFSGVERVGNIVQALRITGHNGFPVVDEPPLSEAPELVGLVLRSHLLVLLKGKGFMKEKMKTSGSFVLERFGAFDFAKPGSGKGLKIEDLDFTDEEMDLYVDLHPITNTSPYTVVETMSLAKAAVLFRALGLRHMLVVPKTPGRPPIVGILTRHDFIPEHIHGLFPNIHKSH

SEQ ID NO: 10005 - protein, 795 aa, Brachypodium distachyon
MDGDHAPPPLSERDGSFNYDIESMDGGGWRGAAAAGRFGSSEALLRYDDGEGPREPLLRKRTMNTTSQIAIVGANVFPIESLDYEIVENDLFKQDWRSRKKKQIFQYIVLKWALVLLIGVLTGLVGFFNNLAVENIAGFKLLLTGDLMLQERYFTAFLAYGGCNLVLGATAAAICAYIAPAAAGSGIPEVKAYLNGVDAYSILAPSTLFVKIFGSILGVSGGFVLGKEGPMVHTGACIANLLGQGGSRKYHLTCNWLKYFKNDRDRRDLITCGAAAGVAAAFRAPVGGVLFALEEAASWWRSALLWRTFFTTAVVAVVLKALIEICRSGKCGLFGQGGLIMFDLSSNIPTYGTQDVIAIMVLGIIGGVFGGLFNFLLDRILRVYSIINEKGPPFKILLTITVSIITSACSYGLPWLAPCTPCPVGSMEECPTIGRSGNFKNFQCPAGHYNGLASLFFNTNDDAIRNLFSRGTENEFHMTSLFVFFTAIYCLGLVTYGIAVPSGLFIPVILAGATYGRIVGTLLGPISDLDPGLFALLGAASFLGGTMRMTVSVCVILLELTNELHMLPLVMLVLLISKTIADCFNKGVYDQIVVMKGLPFMEAHAEPYMRHLVAGDVVSGPLISFSGVEKVGNIVQALRITGHNGFPVVDEPPISEAPELVGLVLRSHLLVLLKGKTFMKEKVKTSGSFVLQRFGAFDFAKAGSGKGIKIEDLDFTDEEMEMYVDLHPVTNTSPYTVVETMSLAKAAVLFRALGLRHLLVVPKTPGRPPIVGILTRHDLMPEHIHGLFPNLRKSH

SEQ ID NO: 10006 - protein, 790 aa, Avena sativa
MDGSGRGTGLAPAAAWNGSSEALPRFEDDDGGAREAALLRYDDDGGGPREPLLRKRTMNTTSQIAIVGANVFPIESLDYEIVENDLFKQDWRSRKKKQIFQYIVLKWALVLLIGLLTGLVGFFNNLAVENIAGFKLLLTGDPMLQQRYFTAFLAYGGCNLVLGATAAAICAYIAPAAAGSGIPEVKAYLNGVDAYSILAPSTLFVKIFGSILGVSAGFVLGKEGPMVHTGACIANLLGQGGSRKYHLTCNWLKYFKNDRDRRDLITCGAAAGVAAAFRAPVGGVLFALEEAASWWRSALLWRTFFTTAVVAVVLRALIEVCRSGKCGLFGQGGLIMFDLSSNVPTYGTQDVIAIVVLGIIGGVFGGLFNFLLDRILRVYSIINERGAPLKILLTITISIITSACSYGLPWLASCTPCPVGSMEECPTIGRSGNFKSFQCPPGHYNGLASLFFNTNDDAIRNLFSRGTANEFHMSSLFIFFIAIYCLGLVTYGIAVPSGLFIPVILAGATYGRIVGTLLGPVSDLDPGLFALLGAASFLGGTMRMTVSVCVILLELTNELHMLPLVMLVLLISKTIADCFNKGVYDQIVVMKGLPFMEAHAEPYMRHLVAGDVVSGPLISFSGVERVGNIVQALKITGHNGFPVVDEPPLTESPELVGLVLRSHLLVLLKGRTFMKDKAKTSGSFVLRRFGAFDFAKPGSGKGPKIEDLDFTDEEMEMYVDLHPITNTSPYTVVETMSLAKAAVLFRALGLRHLLVVPKTPGRPPIVGILTRHDLMPEHIHGLFPDLRKSH

SEQ ID NO: 10007 - protein, 799 aa, Hordeum vulgare
MDGDHAPHSNQHPPPPPMPERESSFNYDIESMDGGGWRGAGRYASSDALLRYDDDGPREPLMRKRTMNTTSQIAIVGANVFAIESLDYEIVENDLFKQDWRSRKKNQIFQYVVLKWALVLLIGLLTGLVGFFNNLAVENIAGFKLVLTGDLMLQKRYFTAFLAYGGCNLFLGATAAALCAYIAPAAAGSGIPEVKAYLNGVDAYSILAPSTLFVKIFGSILGVSGGFVLGKEGPMVHTGACIANLLGQGGSRKYHLTWNWLKYFKNDRDRRDLITCGAAAGVAAAFRAPVGGVLFALEEAASWWRSALLWRTFFTTAVVAVVLRALIEFCRKGKCGLFGQGGLIMFDLSSNIPSYGTQDLIAIIILGVIGGVFGGLFNFLLDRILRVYSIINERGAPSKILLTITISIITSACSYGLPWLAACSPCPVGSMEECPTIGRSGNFKSFQCPPGHYNGLASLFFNTNDDAIRNLFSRGTENEFHMSSLFVFFIAIYCLGLVTYGIAVPSGLFIPVILAGATYGRIVGTLLGPMSDIDPGLFALLGAASFLGGTMRMTVSVCVILLELTNELHMLPLVMLVLLISKTIADCFNKGVYDQIVVMKGLPFMEAHAEPYMRHLVASDVVSGPLISFSGVEKVGNIVHALRITGHNGFPVVDEPPVSEAPELVGLVLRSHLLVLLNGRNFMKEKVKTSGSFVLRRFGAFDFAKPGSGKGMKIEDLDFTEEEMEMYVDLHPITNTSPYTVVETMSLAKAAVLFRALGLRHLLVVPKTPGRFPIVGILTRHDLMPEHIHGLFPNLRKSH

SEQ ID NO: 10008 - protein, 809 aa, Avena sativa
MDGNHAPPERDGSFSYDIESMDGSGRGTGLAPAAAWNGSSEALPRFDDDDGAREAALLRYDDDGGGPREPLLRKRTMNTTSQIAIVGANVFPIESLDYEIVENDLFKQDWRSRKKKQIFQYIVLKWALVLLIGLLTGLVGFFNNLAVENIAGFKLLLTGDPMLQQRYFTAFLAYGGCNLVLGATAAAICAYIAPAAAGSGIPEVKAYLNGVDAYSILAPSTLFVKIFGSILGVSAGFVLGKEGPMVHTGACIANLLGQGGSRKYHLTCNWLKYFKNDRDRRDLITCGAAAGVAAAFRAPVGGVLFALEEAASWWRSALLWRTFFTTAVVAVVLRALIEVCRSGKCGLFGQGGLIMFDLSSNVPTYGTQDVIAIVVLGIIGGVFGGLFNFLLDRILRVYSIINERGAPLKILLTITISIITSACSYGLPWLASCTPCPVGSMEECPTIGRSGNFKSFQCPPGHYNGLASLFFNTNDDAIRNLFSRGTANEFHMSSLFIFFIAIYCLGLVTYGIAVPSGLFIPVILAGATYGRIVGTLLGPISDLDPGLFALLGAASFLGGTMRMTVSVCVILLELTNELHMLPLVMLVLLISKTIADCFNKGVYDQIVVMKGLPFMEAHAEPYMRHLVAGDVVSGPLISFSGVERVGNIVQALKITGHNGFPVVDEPPLTESPELVGLVLRSHLLVLLKGRTFMKDKAKTSGSFVLRRFGAFDFAKPGSGKGPKIEDLDFTDEEMEMYVDLHPITNTSPYTVVETMSLAKAAVLFRALGLRHLLVVPKTPGRPPIVGILTRHDLMPEHIHGLFPDLRKSH

SEQ ID NO: 10009 - protein, 805 aa, Secale cereale
MDGDHAPYSNSNQHPPPPPSPSPLPEREGSFNYDIESMDGGGWRGAGRYASSDALLRYDDDGPREPLLRKRTMNTTSQIAIVGANVFAIESLDYEIVENDLFKQDWRSRKKNQIFQYVVLKWALVLLIGLLTGLVGFFNNLAVENIAGFKLVLTGDLMLQKRYFTAFLAYGGCNLVLGATAAALCAYIAPAAAGSGIPEVKAYLNGVDAYSILAPSTLFVKIFGSILGVSGGFVLGKEGPMVHTGACIANLLGQGGSRKYHLTWHWLKYFKNDRDRRDLITCGAAAGVAAAFRAPVGGVLFALEEAASWWRSALLWRTFFTTAVVAVVLRALIEFCRKGKCGLFGQGGLIMFDLSSDVPSYGTQDLIAIIILGVIGGVFGGLFNFLLDRILRVYSIINERGAPSKILLTITISIITSACSYGLPWLAACSPCPVGSMEECPTIGRSGNFKSFQCPPGHYNGLASLFFNTNDDAIRNLFSRGTENEFHMSSLFVFFIAIYCLGLVTYGIAVPSGLFIPVILAGATYGRIVGTLLGPMSDIDPGLFALLGAASFLGGTMRMTVSVCVILLELTNELHMLPLVMLVLLISKTIADCFNKGVYDQIVVMKGLPFMEAHAEPYMRHLVASDVVSGPLISFSGVEKVGNIVHALRITGHNGFPVVDEPPVSEVPELVGLVLRSHVLVLLSGKNFMKEKVKTSGSFVLRRFGAFDFAKPGSGKGMKIEDLDFTEEEMEMYVDLHPITNTSPYTVVETMSLAKAAVLFRALGLRHLLVVPKTPGRFPIVGILTRHDLMPEHIHGLFPNLRKSH

SEQ ID NO: 10010 - protein, 810 aa, Panicum virgatum
MDGGSPRPPRSPEREGSYNYDIESMDGSVAGGGPPWRPQNGSAEALLRYDEGGDGDRGSAREPLLRKRTMNTTSQIAIVGANVCPIESLDYEVVENDLFKQDWRSRKKKQIFQYIVLKWSLVLLIGLLTGLVGFFNNLAVENIAGFKLLHTSRLMLKERYFKAFLVYGGCNLVLAASAAAICAYVAPAAAGSGIPEVKAYLNGVDAYSILAPSTLFVKIFGSILGVSAGFVLGKEGPMVHTGACIANLLGQGGSRKYHLTCNWLRYFKNDRDRRDLITCGSAAGVAAAFRAPVGGVLFALEEAASWWRSALLWRTFFTTAVVAVVLRGLIEFCRSGKCGLFGQGGLIMFDLSSTIATYSTPDLIAIIVLGIIGGIFGGLFNFLLDKILRVYSIINERGAPFKILLTITISIITSMCSYGLPWLAACTPCPVDAVEQCPTIGRSANYKNFQCPQGYYNDLASLFFNTNDDAIRNLFSNGTANEFRMSSLFIFFTAIYCLGLVTYGVAVPSGLFIPVILAGATYGRIVGTLLGSISDLDPGLFALLGAASFLGGTMRMTVSVCVILLELTNDLPMLPLVMLVLLISKTIADNFNKGVYDQIVVMKGLPYMEAHAEPYMRHLVAGDVVSGPLITFSGVEKVGNIVHALRITGHNGFPVVDEPPITETPELVGLVTRSHLLVLLNSKNFMKGQVKTSGSFVLRRFGAFDFAKPGSGKGLKIEDLDFTDEEMDMYVDLHPITNTSPYTVVETMSLAKAAILFRELGLRHLLVVPKTPDRPPIVGILTRHDFMPEHIHSLFPNLNPHKYHSASMAG

SEQ ID NO: 10011 - protein, 711 aa, Echinochloa colona
MDGGSPRLPRRPEREGSHNYDIESMDGSGYGGGPPWRPQNGSSKALLRYDDGDRGSTGEPLLRKRTMNTTSQIAIVGANVCPIESLDYEVVENDLFKQDWRSRKKKQIFQYIVLKWTLVLLIGLATGAVGFFNNLAVENIAGRKLLLTSDLMLKERYIKAFFVYGGCNLVLAASAAAICAYIAPAAAGSGIPEVKAYLNGVDAYSILAPSTLFVKIFGSILGVSAGFVLGKEGPMVHTGACIANLLGQGGSRKYRLTCNWLRYFKNDRDRRDLITCGSAAGVAAAFRAPVGGVLFALEEAASWWRSALLWRTFFTTAVVAVVLRGLIEFCRSGKCGLFGQGGLIMFDLSSTVATYSTPDLIVIIVLGIIGGIFGGLFNFLLDKILRVYSIINERGAPFKILLTITISIITSMCSYGLPWLAACTQCPVDAVEECPTVGRSGNYKNFQCPPGYYNDLASLFFNTNDDAIRNLFSNGTSTEFRMSSLFIFFTAIYCLGLVTYGVAVPSGLFIPVILAGATYGRIVGTLLGSISDLDPGLFALLGAASFLGGTMRMTVSVCVILLELTNDLPMLPLVMLVLLISKTIADNFNKGVYDQIVVMKGLPFMEAHAEPYMRHLVAGDVVSGPLITFSGVEKVGNIVHALRITGHNGFPVVDEPPITETPELVGLVSRSHLLVLLNSKNFMKGRVKLVVALFCEDLVPLTLQSQGQVKV

SEQ ID NO: 10012 - protein, 811 aa, Echinochloa colona
MDGGGSPRPPRRPEREGSHNYDIESMDGSGYGGGPPWRPQNGSSEALLRYDDGGAGDRGSTGEPLLRKRTMNTTSQIAIVGANVCPIESLDYEVVENDLFKQDWRSRKKKQIFQYIVLKWSLVLLIGLATGAVGFFNNLAVENIAGRKLLLTSDLMLKERYIKAFFVYGGCNLVLAASAAAICAYIAPAAAGSGIPEVKAYLNGVDAYSILAPSTLFVKIFGSILGVSAGFVLGKEGPMVHTGACIANLLGQGGSRKYHLTCNWLRYFKNDRDRRDLITCGSAAGVAAAFRAPVGGVLFALEEAASWWRSALLWRTFFTTAVVAVVLRGLIEFCRSGKCGLFGQGGLIMFDLSSTVATYSTPDLIVIIVLGIIGGIFGGLFNFLLDKILRVYSIINERGAPFKILLTITISIITSMCSYGLPWLAACTPCPVDAVEQCPTVGRSGNYKNFQCPPGYYNDLASLFFNTNDDAIRNLFSNGTSTEFRMSSLFIFFTAIYCLGLVTYGVAVPSGLFIPVILAGATYGRIVGTLLGSISDLDPGLFALLGAASFLGGTMRMTVSVCVILLELTNDLPMLPLVMLVLLISKTIADNFNKGVYDQIVVMKGLPFMEAHAEPYMRHLVAGDVVSGPLITFSGVEKVGNIVHALRITGHNGFPVVDEPPITETPELVGLVSRSHLLVLLNSKNFMKGRVKTSGSFVLRRFGAFDFAKPGSGKGLKIEDLDFTDEEMDMYVDLHPITNTSPYTVVETMSLAKAAILFRELGLRHLLVVPKTPDRPPIVGILTRHDFMPEHIHSVFPNLNPHKYHSASMAG

SEQ ID NO: 10013 - protein, 804 aa, Oryza sativa
MEGQSQHRAPEREGSHNYDIESTDGSGGLWRRNGSSSGALLRYNDSGGGRSGSAGEPLLRKRTMNTTSQIAIVGANVCPIESLDYEVVENDLFKQDWRSRKKKQIFQYIVLKWTLVLLIGLLTGLVGFFNNLAVENIAGFKLLLTGNLMLKERYLTAFFAYGGCNLVLAAAAAAICAYIAPAAAGSGIPEVKAYLNGVDAYSILAPSTLFVKIFGSILGVSAGFVLGKEGPMVHTGACIANLLGQGGSRKYRLTCNWLRYFKNDRDRRDLITCGSAAGVAAAFRAPVGGVLFALEEAASWWRSALLWRAFFTTAVVAVVLRSLIEFCRSGKCGLFGQGGLIMFDLSSTVATYSTPDLIAIIILGIIGGIFGGLFNFLLDKVLRVYSIINERGAPFKILLTITISIITSMCSYGLPWLAACTPCPVDAVEQCPTIGRSGNFKNFQCPPGHYNDLASLFFNTNDDAIRNLFSNGTESEFHMSTLFIFFTAVYCLGILTYGVAVPSGLFIPVILAGATYGRIVGTLLGSISDLDPGLFALLGAASFLGGTMRMTVSVCVILLELTNDLAMLPLVMLVLLISKTIADNFNKGVYDQIVVMKGLPYMEAHAEPYMRHLVAGDVVSGPLITFSGVEKVGNIVHALRFTGHNGFPVVDEPPLTEAPELVGLVTRSHLLVLLNGKMFMKDQLKTSGSFVLQRFGAFDFAKPGSGKGLKIQDLDFTDEEMEMYVDLHPVTNTSPYTVVETMSLAKAAILFRALGLRHLLVVPKTPDRPPIVGILTRHDFVEEHIHGLFPNLNPHKFHSTSMGG

SEQ ID NO: 10014 - protein, 810 aa, Panicum virgatum
MDGGSPRPPRRPEREGSYNCDIESMDGSVAGGGPPWRSQNGSAEALLRYDDGGAGDRGSTREPLLRKRTMNTTSQIAIVGANVCPIESLDYEVVENDLFKQDWRSRKKKQIFQYIVLKWSLVLLIGLLTGLVGFFNNLAVENIAGLKLLHTSRLMLKERYFKAFFVYGGCNLVLAASAAAICAYVAPAAAGSGIPEVKAYLNGVDAYSILAPSTLFVKIFGSILGVSAGFVLGKEGPMVHTGACIANLLGQGGSRKYHLTCNWLRYFKNDRDRRDLITCGSAAGVAAAFRAPVGGVLFALEEAASWWRSALLWRTFFTTAVVAVVLRGLIEFCRSGKCGLFGQGGLIMFDLSSTIATYSTPDLIAIIVLGIIGGIFGGLFNFLLDKILRVYSIINERGAPFKILLTITISIVTSMCSYGLPWLAACTPCPADAVEQCPTISRSGNYKNFQCPQGYYNDLASLFFNTNDDAIRNLFSNGTANEFRMSSLFIFFTAIYCLGLVTYGVAVPSGLFIPVILAGATYGRIVGTLLGSISDLDPGLFALLGAASFLGGTMRMTVSVCVILLELTNDLPMLPLVMLVLLISKTIADNFNKGVYDQIVVMKGFPYMEAHAEPYMRHLVAGDVVSGPLITFSGVEKVGNIVHALRITGHNGFPVVDEPPITETPELVGLVTRSHLLVLLNSKNFMKGQVKTSGSFVLRRFGAFDFAKPGSGKGLKIEDLDFTDEEMDMYVDLHPITNTSPYTVVETMSLAKAAILFRELGLRHLLVVPKTPDRPPIVGILTRHDFMPEHIHSLFPNLNPHKYHSASMAG

SEQ ID NO: 10015 - protein, 810 aa, Zea mays
MDGNSPRPPRRPEREGSYGYDIESMDGSGAGGPPPWSAHHNGSSEALLRYDDGGADRGSTQQPLLRKRTVNTTSQIAIVGANVCPIESLDYEVVENDLFKQDWRSRKKKQIFQYIVLKWSLVLLIGLLTGFVGFFNNLAVENIAGFKLLLTSDLMLKGRYIRAFFVYGGCNLVLAAAAAAICAYIAPAAAGSGIPEVKAYLNGVDAYSILAPSTLFVKIFGSILGVSAGFVLGKEGPMVHTGACIANLLGQGGSRKYHLTCNWLRYFKNDRDRRDLITCGSAAGVAAAFRAPVGGVLFALEEAASWWRSALLWRTFFTTAVVAVVLRGLIEFCRSGKCGLFGQGGLIMFDLSSTVAVYSTPDLIAIIVLGIIGGIFGGLFNYLLDKILRVYSIINERGAPFKILLTITISIITSMCSYGLPWLAACTPCPVDAVEQCPTVGRSGNYKNFQCPPGHYNGLASLFFNTNDDAIRNLFSNGTSTEFQMSSLFIFFTAIYCLGLVTYGIAVPSGLFIPVILAGATYGRIVGTLLGSISDLDPGLFALLGAASFLGGTMRMTVSVCVILLELTNDLPMLPLVMLVLLISKTIADSFNKGVYDQIVVMKGLPYMEAHAEPYMRHLVAGDVVSGPLITFSGVEKVGNIVHALRLTGHNGFPVLDEPPITETPELVGLVTRSHLLVLLNSKNFMKGRVKTSGSFVLRRFGAFDFAKPGSGKGLKIEDLDFTDEEMDMYVDLHPITNTSPYTVVETMSLAKAAILFRELGLRHLLVVPKTPDRPPIVGILTRHDFMPEHIHSLFPNLNPHKYHSASMAG

SEQ ID NO: 10016 - protein, 815 aa, Sorghum bicolor
MDGNGNSPRPPPRRPEREGSYNNYDIESMDGGSGAAPPPWRQHNNGSSEALLRYDDGGADRGSEARQPLLRKRTMNTTSQIAIVGANVCPIESLDYEVVENDLFKQDWRSRKKKQIFQYIVLKWSLVLLIGLLTGVVGFFNNLAVENIAGFKLLLTSDLMLKGRYIGAFFVYGGWNLVLAAAAAAICAYIAPAAAGSGIPEVKAYLNGVDAYSILAPSTLFVKIFGSILGVSAGFVLGKEGPMVHTGACIANLLGQGGSRKYHLTCNWLRYFKNDRDRRDLITCGSAAGVAAAFRAPVGGVLFALEEAASWWRSALLWRTFFTTAVVAVVLRGLIEFCRSGKCGLFGKGGLIMFDLSSTVATYSTPDLIAIIVLGIIGGIFGGLFNFLLDKILRVYSIINERGAPFKILLTITISIITSMCSYGLPWLAACTPCPVDAVEQCPTVGRSGNYKNFQCPPGHYNDLASLFFNTNDDAIRNLFSNGTSTEFQMSSLFIFFTAIYCLGLVTYGVAVPSGLFIPVILAGATYGRIVGTLLGSISDLDPGLFALLGAASFLGGTMRMTVSVCVILLELTNDLPMLPLLMLVLLISKTIADNFNKGVYDQIVVMKGLPFMEAHAEPYMRHLVAGDVVSGPLITFSGVEKVGNIVHALRLTGHNGFPVVDEPPITEAPELVGLVTRSHLLVLLNSKNFMKERFKTSGSFVLRRFGAFDFAKPGSGKGLKIEDLDFTDEEMDMYVDLHPITNTSPYTVVETMSLAKAAILFRELGLRHLLVVPKTPDRPPIVGILTRHDFMPEHIHSLFPNLNPHKYHSASMAG

SEQ ID NO: 10017 - protein, 811 aa, Setaria italica
MDGGSPRPPRRPEREGSYNYDIESMDGSGAGGVPPWRPQHNGSSEALLRYDDGGAGDRGSTHEPLLRKRTMNTTSQIAIVGANVCPIESLDYEVVENDLFKQDWRSRKKKQIFQYIVLKWSLVLLIGLLTGVVGFFNNLAVENIAGFKLLLTSDLMLNERYIKAFFVYGGCNLVLAASAAAICAYIAPAAAGSGIPEVKAYLNGVDAYSILAPSTLFVKIFGSILGVSAGFVLGKEGPMVHTGACIANLLGQGGSRKYHLTCNWLRYFKNDRDRRDLITCGSAAGVAAAFRAPVGGVLFALEEVASWWRSALLWRTFFTTAVVAVVLRGLIEFCRSGKCGLFGKGGLIMFDLSSTVATYSTPDLIAIIVLGIIGGIFGGLFNFLLDKILRVYSIINERGAPFKILLTITISIITSMCSFGLPWLAACTPCPADAVEQCPTVGRSGNYKNFQCQPGYYNDLASLFFNTNDDAIRNLFSNGTENEFRMSSLFIFFTAIYCLGLVTYGVAVPSGLFIPVILAGATYGRIVGTLLGSISDLDPGLFALLGAASFLGGTMRMTVSVCVILLELTNDLPMLPLVMLVLLISKTIADNFNKGVYDQIVVMKGLPYMEAHAEPYMRHLVAGDVVSGPLITFSGVEKVEKIVHALRITGHNGFPVVDEPPITETPELVGLVTRSHLLVLLNSKNFMKGQVKTSGSFVLRRFGAFDFAKPGSGKGLKIEDLDFTDEEMDMYVDLHPITNTSPYTVVETMSLAKAAILFRELGLRHLLVVPKAPDRPPIVGILTRHDFMPEHIHSLFPNLNPHKYHSASMAG

SEQ ID NO: 10018 - protein, 808 aa, Brachypodium distachyon
MDGHSPRPQQRLRTLEREGSHNLDIESMDGGGGGDWRQNGSAAALLRYDDSGSGRGSVREPLLRKRTLNTTSQIAIVGANVCPIESLDYEVVENNLFKQDWRSRKKKQIFQYIVMKWTLVLLIGLLTGIVGFFNNLAVENIAGLKLLLTSDLMLKQRYFTAFFAYGGCNLVLASAAAAICAYIAPAAAGSGIPEVKAYLNGVDAYSILAPSTLFVKIFGSILGVSAGFVLGKEGPMVHTGACIANLLGQGGSRKYHLTCNWLRYFKNDRDRRDLITCGCAAGVAAAFRAPVGGVLFALEEAASWWRSALLWRTFFTTAVVAVVLKGLIEFCRSGKCGLFGQGGLIMFDLSSTVATYSTPDLIAIILLGVIGGIFGGLFNFLLDKILRVYSIINERGAPSKILLTMTISVITSMCSYGLPWLAACTPCPVDAMEQCPTIGRSGNYKNFQCPPGHYNGLASLFFNTNDDAIRNLFSNGTETEFHMSSLFIFFIAIYCLGLVTYGIAVPSGLFIPVILAGATYGRIVGTLLGSISDLDPGLFALLGAASFLGGTMRMTVSVCVILLELTNDLQMLPLVMLVLLISKTIADNFNKGVYDQIVVMKGLPYMEAHAEPYMRHLVAGDVVSGPLITFSGVEKVGNIITALRITGHNGFPVVDEPPLAEAPELVGLVIRSHLLVLLKGKMFMKERVKTSGSFILERFGAFDFAKPGSGKGLKIEDLNFTDEEMEMYVDLHPIANTSPYTVVETMSLAKAAILFRALGLRHLLVVPKTPDRPPIVGILTRHDFVPEHIHGLFPSLNPHKFHSTSMGG

SEQ ID NO: 10019 - protein, 805 aa, Triticum aestivum
MDGGQSPRPQQHHRTPEREGNNNHDIEGMDGAAEGDWWQNSSSNALLRYDDRGSICEPLMRKRTINTTSQIAIVGANICPIESLDYEVVENNLFKQDWRSRKKKQIFQYIVMKWTLVLLIGLLTGLVGFFNNLAVENIAGLKLLITSDLMLKQRYFTAFLAYGGSNLVLAAAAAAICAYIAPAAAGSGIPEVKAYLNGVDAYSILAPSTLFVKIFGSILGVSAGFVLGKEGPMVHTGACIANLLGQGGSRKYHLTCNWLRYFKNDRDRRDLITCGCAAGVAAAFRAPVGGVLFALEEAASWWRSALLWRAFFTTAVVAVVLRTLIEFCRSGKCGLFGQGGLIMFDLSSTVATYSSPDLLAIILLGIIGGIFGGLFNFLLDKILRVYSIINERGAPSKILLTIIVSVITSMCSYGLPWLASCTQCPEDAVEQCPTVGRSGNYKNFQCPPGYYNGMASLFFNTNDDAIRNLFSTGTATEYHMSSLFIFFVAIYCLGLVTYGIAVPSGLFIPVILAGATYGRIVGTLLGSISSLDPGLFALLGAASFLGGTMRMTVSVCVILLELTNDLQMLPLVMLVLLISKTIADNFNKGVYDQIVVMKGLPYMEAHAEPYMRHLVAGDVVSGPLITFSGVEKVGDIVTALRITGHNGFPVVDEPPLTEVPELVGLVIRSHLLVLLKGKMFMKEPVKMSGSFVMERFGAFDFAKAGSGKGLKIEDLYFTDEEMQMYVDLHAIANTSPYTVVETMSLAKAALLFRELGLRHLLVVPKTPYRPPIVGILTRHDFVAEHIHDLFPSLNPHNFHSASMGG

SEQ ID NO: 10020 - protein, 807 aa, Avena sativa
MDGGQQSPRPQPPRRAPEREGSHNYDIERMDNGAGEGEWWQNASSDALLRYDDRGSVHEPLMRKRTVNTTSQIAIVGANVCPIESLDYEVVENNFFKQDWRSRKKKQIFQYIVMKWTLVLLIGVLTGLVGFFNNLAVENIAGLKLLHTSELMLEQRYFTAFLVYGGSNLVLATAAAAICAYIAPAAAGSGIPEVKAYLNGVDAYSILAPSTLFVKIFGSILAVSAGFVLGKEGPMVHTGACIANLLGQGGSRKYRLTWNWLRYFKNDRDRRDLITCGCAAGVAAAFRAPVGGVLFALEEAASWWRSALLWRTFFTTAVVAVVLKALIEFCRSGKCGLFGQGGLIMFDLSSTVAAYSTSDLIAIILLGIIGGVFGGIFNFLLDKILRVYSIVNERGAPSKILLTVAISIITSTCSYGLPWLAACTQCPEDAVEQCPTVGRSGNFKNFQCPPGYYNGLASLFFNTNDDAIRNLFSNGTETEFHMYSLFIFFIAIYCLGLLTYGIAVPSGLFIPVILAGATYGRIVGTLLGSISNLDPGLFALLGAASFLGGTMRMTVSVCVILLELTNDLQMLPLVMLVLLISKTIADTFNKGVYDQIVVMKGLPFMEAHAEPYMRHLVAGDVVSGPLITFSGVEKVGNIVTALRITGHNGFPVVDEPPLTESAELVGLVIRSHLLVLLQGKMFMKEPVKTSGSFLLDGFGAFDFAKAGSGKGLKIEELYFTDEEMQMYVDLHSIANTSPYTVVETMSLAKAAILFRELGLRHLLVVPKTPNRPPIVGILTRHDFVEEHIHGLFPSLNPHNFHSASMGG

SEQ ID NO: 10021 - protein, 805 aa, Hordeum vulgare
MDGGQSPRPQQHHRTPEREGNNNYDIERMDGAREGERWQNGSSDALLRYDDRQSVHEPLMRKRTINTASQIAIVGANICPIESLDYEVVENNLFKQDWRSRKKKQIFQYIVMKWTLVLLIGLLTGLVGFFNNLAVENIAGLKLLITSDLMLNQRYFTAFLAYGGSNLVLAAAAAAICAYIAPAAAGSGIPEVKAYLNGVDAYSILAPSTLFVKIFGSILGVSAGFVLGKEGPMVHTGACIANLLGQGGSRKYHLTCNWLRYFKNDRDRRDLITCGCAAGVAAAFRAPVGGVLFALEEAASWWRSALLWRAFFTTAVVAVVLRTLIEFCRSGKCGLFGQGGLIMFDLSSTVATYSTPDLLAIIILGIIGGIFGGLFNFLLDKILRIYSIINERGAPSKILLTMIVSVITSMCSYGLPWLASCTQCPVDAMEQCPTVGRSGNYKNFQCPPGYYNGMASLFFNTNDDAIRNLFSTGTATEYHMSSLFIFFVAIYCLGLVTYGIAVPSGLFIPVILAGATYGRIVGTLLGSISNLDPGLFALLGAASFLGGTMRMTVSVCVILLELTNDLQMLPLVMLVLLISKTIADSFNKGVYDQIVVMKGLPYMEAHAEPYMRHLVAGDVVSGPLITFSGIEKVADIVTALRITGHNGFPVVDEPPLTEVPELVGLVIRSHLLVLLKGKMFMKERVKTSGSFVMERFGAFDFAKPGSGKGLKIEDLHFTDEEMQMYIDLHTIANTSPYTVVETMSLAKAALLFRELGLRHLLVVPKTPYRPPIVGILTRHDFVEEHIHGLFPSFNPHNFHSTSMGG

SEQ ID NO: 10022 - protein, 807 aa, Avena sativa
MDGGQQSPRPQPPRRAPEREGSHNYDIERMDNGAGEGEWWQNASSDALLRYDDRGSVHEPLMRKRTVNTTSQIAIVGANVCPIESLDYEVVENNFFKQDWRSRKKKQIFQYIVMKWTLVLLIGVLTGLVGFFNNLAVENIAGLKLLHTSELMLEQRYFTAFLVYGGSNLVLATAAAAICAYIAPAAAGSGIPEVKAYLNGVDAYSILAPSTLFVKIFGSILAVSAGFVLGKEGPMVHTGACIANLLGQGGSRKYRLTWNWLRYFKNDRDRRDLITCGCAAGVAAAFRAPVGGVLFALEEAASWWRSALLWRTFFTTAVVAVVLKALIEFCRSGKCGLFGQGGLIMFDLSSTVAAYSTSDLIAIILLGIIGGVFGGIFNFLLDKILRVYSIVNERGAPSKILLTVAISIITSTCSYGLPWLAACTQCPEDAVEQCPTVGRSGNFKNFQCPPGYYNGLASLFFNTNDDAIRNLFSNGTETEFHMYSLFIFFIAIYCLGLLTYGIAVPSGLFIPVILAGATYGRIVGTLLGSISNLDPGLFALLGAASFLGGTMRMTVSVCVILLELTNDLQMLPLVMLVLLISKTIADTFNKGVYDQIVVMKGLPFMEAHAEPYMRHLVAGDVVSGPLITFSGVEKVGNIVTALRITGHNGFPVVDEPPLTESAELVGLVIRSHLLVLLQGKMFMKEPVKTSGSFLLDGFGAFDFAKAGSGKGLKIEELYFTDEEMQMYVDLHSIANTSPYTVVETMSLAKAAILFRELGLRHLLVVPKTPDRPPIVGILTRHDFVEEHIHGLFPSINPHNFHSASMGG

SEQ ID NO: 10023 - protein, 807 aa, Avena sativa
MDGGQQSPRPQPPRRAPEREGSHNYDIERMDNGAGEAEWWQNASSDALLRYDDRGSVHEPLMRKRTVNTTSQIAIVGANVCPIESLDYEVVENNFFKQDWRSRKKKQIFQYIVMKWTLVLLIGVLTGLVGFFNNLAVENIAGLKLLHTSELMLEQRYFTAFLVYGGSNLVLATAAAAICAYIAPAAAGSGIPEVKAYLNGVDAYSILAPSTLFVKIFGSILAVSAGFVLGKEGPMVHTGACIANLLGQGGSRKYRLTWNWLRYFKNDRDRRDLITCGCAAGVAAAFRAPVGGVLFALEEAASWWRSALLWRAFFTTAVVAVVLKTLIEFCRSGKCGLFGQGGLIMFDLSSTVAAYSTSDLIAIILLGIIGGVFGGIFNFLLDKILRVYSIVNERGAPSKILLTVAISIITSMCSYGLPWLAACTQCPVDAVEQCPTVGRSGNFKNFQCPPGYYNGLASLFFNTNDDAIRNLFSNGTETEFHMYSLFIFFIAIYCLGLLTYGIAVPSGLFIPVILAGATYGRIVGTLLGSISNLDPGLFALLGAASFLGGTMRMTVSVCVILLELTNDLQMLPLVMLVLLISKTIADTFNEGVYDQIVVMKGLPFMEAHAEPYMRHLVAGDVVSGPLITFSGVEKVGNIVTALRITGHNGFPVVDEPPLTESAELVGLVIRSHLLVLLQGKMFMKEPVKTSGSFLLDGFGAFDFAKAGSGKGLKIEELYFTDEEMQMYVDLHSIANTSPYTVVETMSLAKAAILFRELGLRHLLVVPKTPDRPPIVGILTRHDFVEEHIHGLFPSINPHNFHSASMGG

SEQ ID NO: 10024 - protein, 791 aa, Secale cereale
MPEREGNNNHDIEGMDGAAEGDWWQNGSSNALLRYDDRGSVCEPLMRKRTINTTSQIAIVGANICPIESLDYEVVENNLFKQDWRSRKKKQIFQYIVMKWTLVLLIGLLTGFVGFFNNLAVENIAGLKLLITSDLMLNQRYFTAFLAYGGSNLVLAGAAAAICAYIAPAAAGSGIPEVKAYLNGVDAYSILAPSTLFVKIFGSILGVSAGFVLGKEGPMVHTGACIANLLGQGGSRKYHLTCNWLRYFKNDRDRRDLITCGCAAGVAAAFRAPVGGVLFALEEAASWWRSALLWRAFFTTAVVAVVLRTLIEFCRSGKCGLFGQGGLIMFDLSSTVATYSSPDLLAIILLGIIGGIFGGLFNFLLDKILRIYSIINERGAPSKILLTITISIITSMCSYGLPWLASCTQCPEDAVEQCPTVGRSGNYKNFQCPPGYYNGMASLFFNTNDDAIRNLFSTGTATEYHMSSLFIFFVAIYCLGLVTYGIAVPSGLFIPVILAGATYGRIVGTLLGSISNLDPGLFALLGAASFLGGTMRMTVSVCVILLELTNDLQMLPLVMLVLLISKTIADNFNKGVYDQIVVMKGLPYMEAHAEPYMRHLVAGDVVSGPLITFSGIEKVGDIVTALRITGHNGFPVVDEPPLTEVPELVGLVIRSHLLVLLKGKMFMKEPVKVSGSFVMERFGAFDFAKAGSGKGLKIEDLHFTDEEMQMYVDLHTIANTSPYTVVETMSLAKAALLFRELGLRHLLVVPKTPYRPPIVGILTRHDFVAEHIHDLFPSIDPHNFHSASMGG

SEQ ID NO: 10025 - protein, 723 aa, Avena sativa
GANVFPIESLDYEIVENDLFKQDWRSRKKKQIFQYIVLKWALVLLIGLLTGLVGFFNNLAVENIAGFKLLLTGDLMLQQRYFTAFLAYGGCNLVLGATAAAICAYIAPAAAGSGIPEVKAYLNGVDAYSILAPSTLFVKIFGSILGVSAGFVLGKEGPMVHTGACIANLLGQGGSRKYHLTCNWLKYFKNDRDRRDLITCGAAAGVAAAFRAPVGGVLFALEEAASWWRSALLWRTFFTTAVVAVVLRALIEVCRSGKCGLFGQGGLIMFDLSSNVPTYGTQDVIAIVVLGIIGGVFGGLFNFLLDRILRVYSIINERGAPLKILLTITISIITSACSYGLPWLASCTPCPVGSMEECPTIGRSGNFKSFQCPPGHYNGLASLFFNTNDDAIRNLFSRGTANEFHMSSLFIFFIAIYCLGLVTYGIAVPSGLFIPVILAGATYGRIVGTLLGPVSDLDPGLFALLGAASFLGGTMRMTVSVCVILLELTNELHMLPLVMLVLLISKTIADCFNKGVYDQIVVMKGLPFMEAHAEPYMRHLVAGDVVSGPLISFSGVERVGNIVQALKITGHNGFPVVDEPPLTESPELVGLVLRSHLLVLLKGRTFMKDKAKTSGSFVLRRFGAFDFAKPGSGKGLKIEDLDFTDEEMEMYVDLHPITNTSPYTVVETMSLAKAAVLFRALGLRHLLVVPKTPGRPPIVGILTRHDLMPEHIHGLFPDLRKSH

SEQ ID NO: 10026 - protein, 719 aa, Avena sativa
FPIESLDYEIVENDLFKQDWRSRKKKQIFQYIVLKWALVLLIGLLTGLVGFFNNLAVENIAGFKLLLTGDLMLQQRYFTAFLAYGGCNLVLGATAAAICAYIAPAAAGSGIPEVKAYLNGVDAYSILAPSTLFVKIFGSILGVSAGFVLGKEGPMVHTGACIANLLGQGGSRKYHLTCNWLKYFKNDRDRRDLITCGAAAGVAAAFRAPVGGVLFALEEAASWWRSALLWRTFFTTAVVAVVLRALIEVCRSGKCGLFGQGGLIMFDLSSNVPTYGTQDVIAIVVLGIIGGVFGGLFNFLLDRILRVYSIINERGAPLKILLTITISIITSACSYGLPWLASCTPCPVGSMEECPTIGRSGNFKSFQCPPGHYNGLASLFFNTNDDAIRNLFSRGTANEFHMSSLFIFFIAIYCLGLVTYGIAVPSGLFIPVILAGATYGRIVGTLLGPISDLDPGLFALLGAASFLGGTMRMTVSVCVILLELTNELHMLPLVMLVLLISKTIADCFNKGVYDQIVVMKGLPFMEAHAEPYMRHLVAGDVVSGPLISFSGVERVGNIVQALKITGHNGFPVVDEPPLTESPELVGMVLRSHLLVLLKGRTFMKDKAKTSGSFVLRRFGAFDFAKPGSGKGLKIEDLDFTDEEMEMYVDLHPITNTSPYTVVETMSLAKAAVLFRALGLRHLLVVPKTPGRPPIVGILTRHDLMPEHIHGLFPDLRKSH

SEQ ID NO: 10027 - protein, 565 aa, Cocos nucifera
MVHTGACIANLLGQGGSRKYHLTWTWLRYFKNDRDRRDLITCGAAAGVAAAFRAPVGGVLFALEEAASWWRSALLWRTFFTTAVVAVVLRAFIEYCRGGKCGLFGEGGLIMFDLSSTITTYSTPDLVAILVLGVIGGVFGGLYNYLLDRILRTYSIINEKGAPFKILLTITISLLTSCCSYGLPWLARCTPCPADLREQCPTIGRSGNFKNFQCPPGHYNDLASLFLNTNDDAIRNLFSGNTDNEFHMSTLFIFFTAIYFLGLVTYGVAVPSGLFIPVILAGASYGRIVGTLLGPISDLDTGLFALLGAASFLGGTMRMTVSVCVILLELTNDLLMLPLVMLVLLISKTVADSFNPGVYDQIVKMKGLPYMEAHAEPYMRHLVAGDVVSGPLITFAGVEKVGNIVHALRLTGHSGFPVIDEPPFSDAPELCGLVLRSHLLVLLKGKSFTKERVRTGVGELLQRFGAFDFAKPGSGKGMKFEDLDIQEEEMDMYVDLHPITNTSPYTVVETMSLAKAAVLFRQLGLRHLCVVPKTPGRPPIVGILTRHDFMPEHILGLFPHFNPHK

SEQ ID NO: 10028 - protein, 778 aa, Elaeis guineensis
MDLREGTNDIESMEGLGMDVERNGSGFEDEKEAGMRQPLLLRKRTMNTTSQIAIVGANVCPIESLDYEIVENDLFKQDWRSRKKVQIFQYIVLKWTLALLIGLATGLVGFFNNLAVENIAGFKLLLTSDLMLKDRFFAAFLAYSGCNLVLAAAAAAICAYIAPAAAGSGIPEVKAYLNGIDAHSILAPSTLFVKIFGSVLGVSAGFVLGKEGPMVHTGACIANLLGQGGSRKYHLTWTWLRYFKNDRDRRDLITCGAAAGVAAAFRAPVGGVLFALEEAASWWRSALLWRTFFTTAVVAVVLRAFIEYCRSGKCGLFGEGGLIMFDLSSTITAYSTPDLVVILVLGVIGGVFGGLYNYLLDRILRTYSIINEKGAPFKILLTITISLLTSCCSYGLPWLARCTPCPADLQDQCPTIGRSGNFKNFQCPPGHYNDLASLFLNTNDDAIRNLFSGNTDNEFHMSTLFIFFTAIYFLGLVTYGVAVPSGLFIPVILAGASYGRIIGTLLGPISDLDTGLFALLGAASFLGGTMRMTVSVCVILLELTNDLLMLPLVMLVLLISKTVADSFNLGVYDQIVKMKGLPYMEAHAEPYMRHLVAGDVVSGPLITFAGVEKVGNIVHALRLTGHNGFPVIDEPPFSDAPELCGLVLRSHLLVLLKGKRFTKERVRTGVGELLQRFGAFDFAKPGSGKGMKFEDLDIQEEEMDMYLDLHPITNTSPYTVVETMSLAKAAVLFRQLGLRHLCVVPKTPGRPPIVGILTRHDFVPEHILGLFPHFNPHK

SEQ ID NO: 10029 - protein, 720 aa, Triticum aestivum
VFAIESLDYEIVENDLFKQDWRSRKKNQIFQYVVLKWALVLLIGLLTGLVGFFNNLAVENIAGFKLVLTGDLMLQKRYFTAFLAYGGCNLVLGATAAALCAYIAPAAAGSGIPEVKAYLNGVDAYSILAPSTLFVKIFGSILGVSGGFVLGKEGPMVHTGACIANLLGQGGSRKYHLTWNWLKYFKNDRDRRDLITCGAAAGVAAAFRAPVGGVLFALEEAASWWRSALLWRTFFTTAVVAVVLRALIEFCRKGKCGLFGQGGLIMFDLSSNVPSYGTQDLIAIIILGVIGGVFGGLFNFLLDRILRVYSIINERGAPSKILLTITISIITSACSYGLPWLAACSPCPVGSMEECPTIGRSGNFKSFQCPPGHYNGLASLFFNTNDDAIRNLFSRGTENEFHMSSLFVFFIAIYCLGLVTYGIAVPSGLFIPVILAGATYGRIVGTLLGPMSDIDPGLFALLGAASFLGGTMRMTVSVCVILLELTNELHMLPLVMLVLLISKTIADCFNKGVYDQIVVMKGLPFMEAHAEPYMRHLVASDVVSGPLISFSGVEKVGNIVHALRITGHNGFPVVDEPPVSEAPELVGLVLRSHVLVLLSGRNFMKEKVKTSGSFVLRRFGAFDFAKPGSGKGMKIEDLDFTEEEMEMYVDLHPITNTSPYTVVETMSLAKAAVLFRALGLRHLLVVPKTPGRFPIVGILTRHDLMPEHIHGLFPNLRKSH

SEQ ID NO: 10030 - protein, 778 aa, Musa acuminata
MDHQEGSNDIDGMEGAWREIERNGSGLYENEEAGSMREPLLRKRTMNTTSQIAIVGANVCTIESLDYEIVENDLFEQDWRSRKKVQIFQYIVLKWTLALLIGLATGLVGFFNNLAVENIAGFKLLLTSNLMLEHRYFAAFLAYCSINAILAASAAALCAYVAPAAAGSGIPEVKAYLNGVDAYSILAPSTLFVKIFGSIGGVSAGFVLGKEGPMVHTGACIANLLGQGGSRKYHLTWTWLRYFKNDRDRRDLITCGSAAGVAAAFRAPVGGVLFALEEAASWWRSALLWRTFFTTAVVAVSLRSLIEYCRSGKCGLFGKGGLIMFDVSSSVTTYSTPDLIVIIVLGVIGGVFGALFNYLLDRILRTYSFINEKGAPFKILLTVAISILTSCCSYGLPWLASCTPCPAHLQEQCPTIGRSGNFKNFQCPPGHYNDLASLFLNTNDDAIRNLFSAGTDNEFHMSTLFVFFAAVYCLGLVTYGIAVPSGLFIPVILAGSTYGRMVGTLLGPISDLDAGLFALLGAASFLGGTMRMTVSVCVILLELTNDLLLLPLVMLVLLISKTVADSFNKGVYDQIVRMKGLPFMEAHAEPHMRHLVARDVVSGPPVSFSGVEKVGTIVHALRLTGHNGFPVVDEPPFSDAPELVGLVLRSHLLILLKGKRFSKERVKTGVREMLQRFGAFDFAKAGSGKGLKLEDLNILEEEMDMFVDLHPVTNKSPYTVVETMSLAKAAILFRELGLRHLCVVPKTPGTPPIVGILTRHDFMPEHILGLFPHHHSHK

SEQ ID NO: 10031 - protein, 778 aa, Musa acuminata
MDHQEGSNDIDGMEGAWREIERNGSGLYENEEAGSMREPLLRKRTMNTTSQIAIVGANVCTIESLDYEIVENDLFEQDWRSRKKVQIFQYIVLKWTLALLIGLATGLVGFFNNLAVENIAGFKLLLTSNLMLEHRYFAAFLAYCSTNAILAASAAALCAYVAPAAAGSGIPEVKAYLNGVDAYSILAPSTLFVKIFGSIGGVSAGFVLGKEGPMVHTGACIANLLGQGGSRKYHLTWTWLRYFKNDRDRRDLITCGSAAGVAAAFRAPVGGVLFALEEAASWWRSALLWRTFFTTAVVAVSLRSLIEYCRSGKCGLFGKGGLIMFDVSSSVTTYSTPDLIVIIVLGVIGGVFGALFNYLLDRILRTYSFINEKGAPFKILLTVAISILTSCCSYGLPWLASCTPCPAHLQEQCPTIGRSGNFKNFQCPPGHYNDLASLFLNTNDDAIRNLFSAGTDNEFHMSTLFVFFAAVYCLGLVTYGIAVPSGLFIPVILAGATYGRMVGTLLGPISDLDAGLFALLGAASFLGGTMRMTVSVCVILLELTNDLLLLPLVMLVLLISKTVADSFNKGVYDQIVRMKGLPFMEAHAEPHMRHLVARDVLSGPPVSFSGVEKVGTIVHALRLTGHNGFPVVDEPPFSDAPELVGLVLRSHLLILLKGKRFSKERVKTGVREMLQRFGAFDFAKAGSGKGLKLEDLNILEEEMDMFIDLHPVTNKSPYTVVETMSLAKAAILFRELGLRHLCVVPKTPGTPPIVGILTRHDFMPEHILGLFPHHHSHK

SEQ ID NO: 10032 - protein, 648 aa, Pennisetum glaucum
MLKQRYITAFLAYAGCNVVLAASAAAICAYIAPAAAGSGIPEVKAYLNGIDAYAILAPSTLFVKIFGSILGVSAGFVLGKEGPMVHTGACIANLLGQGGSRKYHLTCNWLRYFKNDRDRRDLITCGSAAGVAAAFRAPVGGVLFALEEAASWWRSALLWRAFFTTAVVAVVLRGLIQFCRSGKCGLFGQGGLIMFDLSSTIPTYSTQDIIAIIVLGIIGGVFGGLFNFLLDRILRAYSFINEKGAPSKILLTITISIITSACSYGLPWLAPCTPCPADAPEQCPTIGRSGNFKNFQCPAGYYNGLASLFFNTNDDAIRNLFSSGTEKEFHMSTLFVFFTAIYCLGLVTYGIAVPSGLFIPVILAGATYGRIVGTLLGPISDLDPGLFALLGAASFLGGTMRMTVSVCVILLELTNDLLMLPLVMLVLLISKTIADSFNKGVYDQIIVMKGMPFLEAHAEPYMRHLVAGDVVSGPLISFSGVERVGNIVQALRITGHNGFPVVDEPPLSEAPELVGLVLRSHLLVLLNGKCFMKEKLKTSGSFVLKKFGAFDFAKAGSGKGLKIEDLDFTDEEMDMYVDLHPITNTSPYTVVETMSLAKAAVLFRALGLRHLLVVPKTPGRPPIAGILTRHDFMPEHIHGLFPNLHKSH

SEQ ID NO: 10033 - protein, 710 aa, Triticum aestivum
IVENDLFKQDWRSRKKNQIFQYVVLKWALVLLIGLLTGLVGFFNNLAVENIAGFKLVLTGDLMLQKRYFTAFLAYGGCNLVLGATAAALCAYIAPAAAGSGIPEVKAYLNGVDAYSILAPSTLFVKIFGSILGVSGGFVLGKEGPMVHTGACIANLLGQGGSRKYHLTWNWLKYFKNDRDRRDLITCGAAAGVAAAFRAPVGGVLFALEEAASWWRSALLWRTFFTTAVVAVVLRALIEFCRKGKCGLFGQGGLIMFDLSSNVPSYGTQDLIAIIILGVIGGVFGGLFNFLLDRILRVYSIINERGAPSKILLTITISIITSACSYGLPWLAACSPCPVGSMEECPTIGRSGNFKSFQCPPGHYNGLASLFFNTNDDAIRNLFSRGTENEFHMSSLFVFFIAIYCLGLVTYGIAVPSGLFIPVILAGATYGRIVGTLLGPMSDIDPGLFALLGAASFLGGTMRMTVSVCVILLELTNELHMLPLVMLVLLISKTIADCFNKGVYDQIVVMKGLPFMEAHAEPYMRHLVASDVVSGPLISFSGVEKVGNIVHALRITGHNGFPVVDEPPVSEAPELVGLVLRSHVLVLLSGRNFMKEKVKTSGSFVLRRFGAFDFAKPGSGKGMKIEDLDFTEEEMEMYVDLHPITNTSPYTVVETMSLAKAAVLFRALGLRHLLVVPKTPGRFPIVGILTRHDLMPEHIHGLFPNLRKSH

SEQ ID NO: 10034 - protein, 1409 aa, Sorghum bicolor
MAAPSPSTAPAPSSSASAAAVVFAVNGERVELREGDVDPGATLLEFLRTRTRFTGPKLGCGEGGCGACVVLLSSYDAASGAVSHAAASSCLTLVHGLHHRAVTTTEGLGGGRGSGRLHAVHERLAGFHATQCGFCSPGVCMSLAAALAGAEAKARAGRRPEPDDDPPEGFARLTAAEAERAVAGNLCRCTGYRPIADACKSFAADVDLEDLGLNSFWRKGDAHASKLPRYDEGSIGVFPEFLKAEIRASSGVDDLYTPPALVGSASTWHRPRSVEEYYKLVGSELFGESRTKVVVGNTASGVYRETDVYDRYIDLRCIPELNSVNKEANGVHIGAAVPISQAIEILRVEAGGCNDVIFCKIADHMEKVASPFVRNTASLGGNLIMAQRDQFASDIATILLAAGSSICIQASSKRLTVTLENFLQMPPCDHKTLLLNIYIPRWTLIGGLSGGKTMDGTVSKIGTSVLFETYRAAPRPLGNAVAYLNSAFLAQVSSDETSSSLVLTELCLAFGAYGSQHAIRARNIEKLLVGKPITASVLLEACRLLKETIVPKEGTRHAAYRSSLAVAFLFSFLYPVTEGTLKPVKAVHLNGYVTSGTNGNPNCGPDADVDVSLKKINDVNSGSCTNDRILEYSNQIIEINKDYLPVGIPTKKVGAELQTSGEAVFVDDIPAPKDCVYGAFIYSTKPLAHVKSIKLDLSLEQLKTLEVVTVKDIPEGGSNVGANTIFGPEPLFGDPVTQCAGEPLGVVIAETQRFANIAAKRAVIDYSTENLDAPILSIEEAVKRCSYFETPPFLLPQKIGDFSKGMAEADQKISSEVKLNSQYYFYMETQAALAIPDEDNCLVVYSSSQCPETAQNVIAKCLGLPCHNVRVITRRVGGGFGGKAVRSLPVATACALAAFKLCRPVRMYLDRKTDMIVTGGRHPMKICYSVGFKSDGKITALHIDLFINAGMTKDVSLIIPHNFIEALKKYNWGAFSYEAKICKTNIATKSAMRGPGEVQGSYVAEAIIEHVASTLSADANLVRHKNLHTVESLALFHSECSEDAMGYTLRSICDQVTASENYQHRLETIQSFNKNNKWKKRGLSFVPIVHKVLSRPTPGKVSILNDGSIAVEVGGIELGQGLWTKVKQMAAFGLGQLCPDRSQELLERIRVIQADTLSNVQGGWTTGSTTSESSCEAVRLACYVLVDRLKPVKEQFQEKQGNVSWDELISKAIMVGVNLSAREYYIPGPSGSYLNYGAAASEVEIDLLTGASTIVRSDLIYDCGQSLNPAVDLGQVEGAFVQGIGYFMTEEYVTNSDGLLISDGTWTYKIPTVDTIPKQFNVKLLNSGFHKKRVLSSKASGEPPLLLAASVHCATREAIRAARNEPHCSGFGPSPSHFDLEVPAIMPVVKELCGLDNVERYLQSLPSSE

SEQ ID NO: 10035 - protein, 496 aa, Glycine max
MEHFNKAKAVKLRSHLGKYLIADEDKLRQSKRGSTRKAIWEIELINGKNHHVRLKSSNGRYLTATDAPFLLGMTGNKVVLANFDKGTDWKFEWEPITEGFHVKLRSWCGKYLRGNGGTVPWRNSVTHDDPASSVTHTWILWASEPVQEFPEKMVSFAESDFSSLDSEDELLASEEESSRSHKSMLKTTSSNTSGATSIRSGMELFHRAKAVRLRSHHDKYLLADEDEESVTQDRNGSSRNAKWTVELIPEFDNIIRLKSCYGKYLTASNQPLLLGVTGRKVVQSLPRRLDSSVEWEPVRDGAQVKLKTRYGNFLRANGGVPPWRNSVTHDIPHRTATQDWILWDVDVLEIHVVSPAPPPIPHSDSLDFESNTPSAVNIKSTTFSRQESTDSNVGSPPKKMEGRTIYYHVAEDNGDVDDENVQGYSLNFKGNGVEQLARKFEEETGLEGVIVCTRSPLNGKLYPLRLQLPPNNVTMQVVLVLPSSKVAREFEEQGIL

SEQ ID NO: 10036 - protein, 797 aa, Glycine max
MATLADIGVSAAINILSAFAFLLAFALLRIQPINDRIYFPKWYISGDRSSPRRSGGNFVGKFVNLNFRTYLTFLNWMPQALRMSESEIISHAGLDSAAFLRIYTLGLNIFVPITLVALLVLIPVNVSSGTLFFLKKELVVSDIDKLSISNVPPKSIRFFVHIALEYLFTIWICFLLYKEYDHIASMRLHFLASQRRRVDQFAVVVRNIPHMSGHTISDTVDSFFQTNHPEHYIGHQAVYNANKFAKFAKRRDRLQNWLDYYQLKFERHPDKRPTVKNGFLGFWGGKVDAIEYYKHSIKELDTMMTMERQKIIKDPKSILPVAFLSFKSRWGASVCAQTQQSKNPTLWLTDWAPEPRDVYWQNLAIPFVSLNIRKLIISLSVFALVFFYMIPIAFVQSLANLEGLERVAPFLRPVIELKFIKSFLQGFLPGLALKIFLYILPTVLMIMSKIEGYIALSTLERKTAAKYYYFMLVNVFLGSIVTGTAFQQLHAFLHQSPTQIPRTIGVSIPMKATFFMTYIMVDGWAGIAGEILRLKPLVIYHLKNMFLVKTERDRGKAMDPGSVDFPETIPSLQLYFLLGIVYAVVTPILLPFVLVFFAFAYLVYRHQIINVYNQQYESAAAFWPLVHSRIIASLLISQLLLLGLLSTKKAAKSTPLLVILPILTFAFHKFCQRRFEPAFRKYPLEEAMSKDLLEKSTEPDLNIEAYLADAYLHPIFRSFEVDDELVEVRVDNHQTNVADSQPSEPSSPSPPHHVQQPSPPHHIHEPSPPQYSEYQTSPPSYYYQYHPPSPPHYVYQY

SEQ ID NO: 10037 - protein, 799 aa, Glycine max
MATLVDIGVSAAINILSAFAFLLAFALLRIQPINDRIYFPKWYLSGGRSSPKRSGENFVGKFVNLNFRTYLTFLNWMPQALRMSESEIISHAGLDSAVFLRIYILGFKVFAPITLVALFILIPVNVSSGTLSFLKKELVVSDIDKLSISNVPPKSIRFFVHIALEYLFTIWICILLYKEYDKIATMRLHFLASQWRRVDQFTVVVRNIPHMSGHTVSDTVDSFFQTNHPEHYIGHQAVYNANKFAKFAKRRERLQNWLDYYQLKFERHPDRRPTVKTGILGLWGGKVDAIEHYKHSIKELDKMMTLERQKIIKDPKSILPVAFLSFKSRWGASVCAQTQQSKNPTLWLTDWAPEPRDVYWRNLAIPFVSLNIRKLIISLSVFALVFFYMIPIAIVQSLANLEGLERVAPFLRPVIELKFIKSFLQGFLPGLALKIFLYILPTVLMIMSKIEGYIALSTLERKTAGKYYYFMLVNVFLGSIVTGTAFQQLHAFLHQSPTQIPRTIGVSIPMKATFFMTYIMVDGWAGIASEILRLKPLVIYHLKNMFLVKTERDRGKAMDPGSVDFPETIPSLQLYFLLGIVYAVVTPILLPFIVVFFAFAYLVYRHQIINVYNQQYESAAAFWPLVHCRIIASLLISQLLLLGLLSTKKAAKSTPLLVILPILTFAFHKFCQRRFEPAFRKYPLEEAMSKDLLEKSTEPDLNIEAYLADAYLHPIFRSFEVEEEELVEVRVDKHQTNVASSPPTEPSSPSPPHHVQQQPSPPHHIHEPSLPQYSEYQTSPPGYYYQYHPPSPPHYVYQY

SEQ ID NO: 10038 - protein, 805 aa, Cajanus cajan
MATLEDIGVSAAINILSAFAFLLAFALLRIQPINDRVYFPKWYINGGRSSPRRSGNFVAKFVNLNFRTYLTFLNWMPQALRMSESEIISHAGLDSAAFLRIYTLGLKIFAPIAVVALLVLIPVNVSSGTLFFLKKELVVSDIDKLSISNVPPKSIRFFVHIALEYMFTIWICFLLYKEYDNIASMRLHFLATQRRRVEQFTVVVRNIPHISGHTVSDSVDSFFQTNHPEHYIGHQAIYNANRFAKFAKRRDRLQNWLDYYQLKFERHPEKRPTIKTGFLGLWGGKVDAIEYYKHSIKELDKMMTLERQKIIKDPKAILPVAFLSFNSRWGASVCAQTQQSKNPTLWLTDWAPEPRDVYWRNLAIPFVSLSIRKLIISLSVFALVFFYMIPIAFVQSLANLEGLERVAPFLRPVIELKFIKSFLQGFLPGLALKIFLYILPAVLMIMSKIEGYIALSTLERKTAAKYYYFMLVNVFLGSIVTGTAFEQLHSFLHQSPTQIPRTIGVSIPMKATFFMTYIMVDGWAGIAGEILRLKPLVIYHLKNMFLVKTERDRGKAMDPGSVDFPETIPSLQLYFLLGIVYAVVTPILLPFILIFFAFAYLVYRHQIINVYNQQYESAAAFWPQVHSRIIASLLISQLLLLGLLSTKKAAKSTPLLVMLPILTFAFHKYCQRRFEPAFRKYPLEEAMSKDLLEKSTEPDLNIKAYLADAYLHPIFRSFEVEEEELVEVRVDKHQTNVASAPPSEPSSPSPPHHLDQPSPPHHDHQPSQPQYGDYPIPNPTLPPGYYYQYHPPSPSYVYHNYQYQG

SEQ ID NO: 10039 - protein, 795 aa, Lotus japonicus
MATLADIGVSAAINILSAFAFLLAFALLRIQPINDRVYFPKWYINGERTSPRSTGNFVGKFVNLNFKTYLTFLNWMPQALRMSENEIINHAGLDSAVFLRIYTLGLKIFVPVTVVALLILIPVNVSSGALFFLKRDLVVSDIDKLSISNVPSKSSRFFVHIGLEYMFTLWICFLLYKEYDNIAMMRLHFLASQRRRVEQFTVVVRSVPHISGHSVSDSVESFFQTNHPNHYIGHQAVYNANKFAKLVRRRDRLQNWLDYYQLKFQRHPDKRPTINVCVLGLWGRKVDAIEYYSHTIKELDKVMTLERQRIIKDPKCILPVAFLSFSSRWGASVCAQTQQSKNPTLWLTDWAPEPRDIYWRNLAIPFVSLSIRKLVISLSVFALVFFYMIPIAFVQSLANLEGLERVAPFLRPVIELKFIKSFLQGFLPGLALKIFLYILPAVLMIMSKIEGHIAKSTLERKTAAKYYYFMLVNVFLGSIVTGTAFEQLHSFLHQSPTQIPRTIGVSIPMKATFFMTYIMVDGWAGIAGEILRLKPLVIYHLKNMFIVKTERDRGKAMDPGSVDFPETIPSLQLYFLLGIVYAVVTPILLPFILVFFALAYLVYRHQIINVYNQQYESAAAFWPHVHSRIIASLLISQLLMLGLLSTKKAAKSTPLLAILPILTFAFHKYCQHRFEPAFRKYPLEEAMAKDLLEKTTEPDLNIKAYLADAYLHPIFRSFEVEEELVEVRVDKQPETQVASPTLSEPSSPSPLHDHVHQPSPPQHVNQYSHYPTSPPGYYYHPPPPPHYAYQYQDEP

SEQ ID NO: 10040 - protein, 798 aa, Cicer arietinum
MATLEDIGVSAAINILSAIAFLVAFALLRIQPINDRVYFPKWYISGGRSTPRSSGNFVGKFVNLNFKTYLTFLNWMPQALRMTETEIINHAGLDSAVFLRIYTLGLKMFVPVTIVALLILIPVNVSSGTLFFLRRELVVSNIDKLSISNVPPKSLRFFVHIALEYLFTIWICFLLYKEYDTIAIMRLHFLASQRRRVEQFTVVVRSIPHMSGHSVSDTVDSFFQTNHPDHYIGHQAVYNANRFAKFVTKRDRLQNWLDYYRLKFQRRPDRRPTITTGCLGLWGRKVDAIEYYEQHIKELDKLMSSERQKIIKDPKSILPVAFLSFNSRWGASVCAQTQQSKNPTLWLTDWAPEPRDIYWRNLAIPFVSLTIRKLIITLSVFALVFFYMIPIAFVQSLANLDGLEKVAPFLRPVIELKFIKSFLQGFLPGLALKVFLYILPTVLMIMSKIEGYIALSTLERKTAAKYYYFMLVNVFLGSIVTGTAFQQLHAFLHQSPTQIPRTIGVSIPMKATFFMTYIMVDGWAGIAGEILRLKPLVIYHLKNMFLVKTERDREKAMDPGSVDFPETLPSLQLYFLLGIVYAVVTPILLPFILVFFALAYLVYRHQIINVYNQRYESAAAFWPHVHSHIIASLLISQLLLLGLLSTKKAAKSTPLLVMLPILTFAFHKYCKSRFEPAFRKYPLEEAMAKDLLEKSSEPDLNIKAYLADSYLHPILRSFEVEEELVELERVEVRVDKHQTHHVSSPTLSGEPSSPSPPHHVHQHQPSPPHYNDYPTSPQDYYYQPPLPPHYVYQYHNQP

SEQ ID NO: 10041 - protein, 807 aa, Trifolium pratense
MATLQDLGVSAAINILSAFAFLLAFALLRIQPINDRVYFPKWYISGGRSNPRSSGNFVGKFVNLNVKTYLTFLNWMPQALRMSETEIINHAGLDSAVFLRIYTLGLKMFLPVTIVALLILIPVNVSSGTLFFLRKELVVSDIDKLSISNVPPKSLRFFVHIGLEYMFTIWICFLLYKEYDNIALMRLHFLASQRRRAEQFTVVVRNVPHISGHSVSDSVDGFFQTNHPDHYIGHQAVYNANRFAKFVRKRDRFQNWLDYYRLKFQRNPDKRPTMKTGCLGLWGRKVDAIEYYDQHIKELDKLMTLERQKIIKDPKSILPVAFLSFNSRWGASVCAQTQQSKNPTLWLTDWAPEPRDIYWRNLAIPFVSLTVRKLIITLSVFALVFFYMIPIAFVQSLANLDGLERVAPFLRPVIELKFIKSFLQGFLPGLALKIFLYILPTVLMIMSKIEGYIALSTLERKTAAKYYYFMLVNVFLGSIITGTAFEQLHAFLHQSPTQIPRTIGVSIPMKATFFMTYIMVDGWAGIAGEILRLKPLVIYHLKNVFIVKTERDRGKAMDPGSVDYPETLPSLQLYFLLGIVYAVVTPILLPFILVFFAFAYLVYRHQIINVYNQQYESAAAFWPQVHSRIIASLIISQLLLLGLLSTKKAARSTPLLVLLPILTFAFHKYCKNRFEPAFRKYPVEEAMAKDVLEKTTEPDLNIKAYLADSYLHPILRSFEVEEEELVELETVQVRVDKLETHHVASQTRSESSSPSPPHDVHHQHSPPHHVHQHQPSPPHYNDYPLPPEYYYHHTSPPHYNYQYQDQP

SEQ ID NO: 10042 - protein, 105 aa, Trigonella foenum-graecum
MATLQDIGVSAAINILSAFAFLLAFALLRIQPINDRVYFPKWYISGGRSNPRSSANFVGKFVNLNFKTYLTFLNWMPQALRMSQTEIINHAGLDSAVFSEFILLA

SEQ ID NO: 10043 - protein, 798 aa, Trifolium pratense
MATLQDLGVSAAINILSAFAFLLAFALLRIQPINDRVYFPKWYISGGRSNPRSSGNFVGKFVNLNFKTYLTFLNWMPQALRMSETEIINHAGLDSAVFLRIYTLGLKMFIPVTIVALLILIPVNVSSGTLFFLRKELVVSDIDKLSISNVPPKSLRFFVHIGLEYMFTIWICFLLYKEYDNIALMRLHFLASQRRRVEQFTVVVRNVPHISGHSVSDSVDSFFQTNHPDHYIGHQAVYNANRFAKFVRKRDRYQNWLDYYRLKFQRNPDTRPAITTGCLGLFGRKVDAIEYYDQHIKELDKLMFSERQKIIKDPKSILPVAFLSFNSRWGASVCAQTQQSKNPTLWLTDWAPEPRDIYWRNLAIPFVSLTIRKLIITLSVFALVFFYMIPIAFVQSLANLDGLERVAPFLRPVIELKFIKSFLQGFLPGLALKIFLYILPTVLMIMSKIEGYIALSTLERKTAAKYYYFMLVNVFLGSIITGTAFEQLHAFLHQSPTQIPRTIGVSIPMKATFFMTYIMVDGWAGIAGEILRLKPLVIYHLKNVFIVKTERDRGKAMDPGSVDYPETLPSLQLYFLLGIVYAVVTPILLPFILVFFAFAYLVYRHQIINVYNQQYESAAAFWPQVHSRIIASLIISQLLLLGLLSTKKAARSTPLLVLLPILTFAFHKYCKHRFEPAFRKYPVEEAMAKDILEKTTEPDLNIKAYLADSYLHPILRSFEVEEEELVELETVEVRVDKLQTHHVASRTMSESSSPSPPHHVHQHQPSSPPHYNDYPLPPEYYYHHTSPPHYNYEYHDQP

SEQ ID NO: 10044 - protein, 799 aa, Medicago truncatula
MATLQDIGVSAAINILSAFAFLLAFALLRIQPINDRVYFPKWYISGGRSNPRSSANFVGKFVNLNFKTYLTFLNWMPQALRMSETEIINHAGLDSAVFLRIYTLGLKMFIPVTIVALLILIPVNVSSGTLFFLRRELVVSDIDKLSISNVPPKSLRFFVHIGLEYMLTIWICFLLYKEYDNVALMRLHFLASQRRRVEQFTVVVRNVPHISGHSVSDSVDSFFKTNHPDHYIGHQAVYNANRFAKFVRKRDRLQNWLDYYRIKFQKHPDTRPTVKTGCLGLWGRKVDAIEYYDQHVKELDKLMTLERQKIIKDPKSILPVAFLSFNSRWAASVCAQTQQSKNPTLWLTDWAPEPRDIYWQNLSIPFVSLTVRKLVITLSVFALVFFYMIPIAFVQSLANLDGLEKVAPFLRPVIELKFIKSFLQGFLPGLALKIFLYILPTVLMIMSKIEGYIALSTLERKTAAKYYYFMLVNVFLGSIITGTAFEQLHAFLHQSPTQIPRTIGVSIPMKATFFITYIMVDGWAGIAGEILRLKPLVIYHLKNMFIVKTERDRGKAMDPGSVEFPETLPSLQLYFLLGIVYAVMTPILLPFILVFFAFAYLVYRHQIINVYHQQYESAAAFWPQVHSRIIASLILSQILLFGLLSTKKAVKSTPLLIMLPILTFAFHKYCKRRFEPAFRKYPVEEAMAKDILEKTTEPDLNIKAYLADSYLHPILRSFEVEEEELVELETVEVRVDKHQTHHVASPILSEPGSPSPPHHVHQHQHQPSPPHYNDYPLPPEYYYHPTSPTHYAYQYQNQP

SEQ ID NO: 10045 - protein, 788 aa, Lupinus angustifolius
MATLADIGVSATINILTAFAFLLAFAILRIQPINDRIYFPKWYISGGRTSSRTTTGNFVGKFVNLNFRTYLTFLNWMPQALRMSETEIINHAGLDSAAFLRIYTLGLKIFVPVTVVALLVLIPVNVSSGTLFNLKKELVVSDIDKLSISNVPPKSIRFFFHIALEYLVTLWVCFLLYKEYNNVSTMRLQFFVSQRRRVEQFTVVVRNVHHIHGHSVSDSVDNFFQKNHPNHYIGHQAVYNANKFARLVRKRNGLQNWLDYYQLKSERNPDKKPTVKLGFWGLWGQKVNAVEYYRRIITELDKMMISERQNVIKDPKCILPVAFLSFNSRWGASVCAQTQQSKNPTLWLTDWAPEPRDIYWQNLAIPFVSLSIRKLIISSLVFALVFFYMIPIALVQSLANLEGLEKVVPFLRPVIELKFIKSFLQGFLPGLALKLFLYVLPSILMIMSKIEGYIALSTLDRKTSSKYYYFMLVNVFLGSIVTGTAFEQLHAFLHQSPTEIPRTIGVSIPMKATFFMTYIMVDGWAGIASEILRLKEMIIYHLKNMFIVKTERDREKAMDPGSVDYKETIPSLQLYFLLGIVYAVVSPVLLPFILIFFAFAYLVYRHQIINVYNQQYESAAAFWPHVHSRIVASLIISQLLLLGLLSTKEAAKSTPLLVILPILTYAFHKYCQSRFEPAFRQYPLEEAMAKDLLEKTTEPELNIKAYLADAYLHPIFQSFEIEEHELIEVRVDKQQTQVTSPSSNDTTSPSSSHYHHHLPSPPPSPPHDDYPGFFHHVPHYGYQYQLEP

SEQ ID NO: 10046 - protein, 978 aa, Volvox carteri
MAVKTRCRQQGLLLRLDKRYDSYFARCALRELQWAQYSTNDFDSSGGSGLLGKIWRAGLGGKQKEGAESGSSGSSGSSGSSNKGGSGGAKGSSEDALVPSGPERKHHKVFVVELSRKPLFPGIYTPVMISKNEALVREVMEVKKQGAHAYVGAFLRKPPSDSNPQPQPHPEEGGNAASHLYDIGTFAQVHTVLAGDGADSAQLLLLGHRRIRKTAVISPEPLRVHIDHLRDESYTSDDILKATSMEIVNTMRDLLQLNPLYGEQFRTLLSLTGSIDLQDMSRLVDAAASLTSADDVTLQGVLEQLNVPERARMVLNLLKKEVELCKLQADIREQVEGKIAKEQRRMLLMEQLKSIKKELGLERDDKSALLQRFQARWDEKKAAAPPDVAKTVKEELDKLGGLEPVSPEFNITRTYLDWLTSLPWGTTTQEVFDLTRAKQVLDDEHFGLDDVKDRILEFIAVSHLRGSAQGKILCLVGPPGVGKTSIGRSIATALNREYYRFSVGGLHDVAEIKGHSSFTRSWRTYVGAMPGKLVQCLKSTGSSNPLVLIDEVDKLGRGHAGDPASALLELLDPEQNAAFLDHYLDLPLDLSKVLFVCTANTLDTIPGPLLDRMEVIRLSGYAQDEKRSIARRYLEPAAAADAGVPRGSVSLSDEALEGLISEYCREAGVRNLKKHIDKVYRKVALQLLKEYVGQAPFAKDKFYETTPPGVVMGLAWTPLGGATLYVEAARVAGSEAKGALTTTGQLGDVFRESATIAHTFARNFLSARDPATAHSFFGGSALHVHVPAGATPKDGPSAGCTLVTALLSLALNRTVRPDLAMTGEVTLTGCVLPIGGVKEKVLAARRSGVRVVVFPEGNRPEYEDLPQELRQGLEPHFVSSYGQVYELALGGQDPTSPPAKQGEQDSLRRDAAQLLPPLPSPSPRPAAWTASYSRCKYVPRQALTDLADGGLTTFEVSGAGWPYCSLRSLFGELPSAAP

SEQ ID NO: 10047 - protein, 372 aa, Saccharum officinarum
DESDLRALAAPGCFRAPRTSCLEVAVYYLARFGASSRCGVVAACRRKRLVGVFRVELPSSEWRDGKPVLLHHGWAGIGKGEARPELHLRVKLEADPRYIFQFDDDIALNPQVVQLHGSIRQPVFSCKFIRDRRPSQSDPLGGGQYWSSSSSEEKDMEMVRRERKGWKVVIHDLSGSAVAAAFMATPFVAAPGGDTVARSNPGAWLIVRADTTGSSDSWQPWGRLEAWRDAAASGASSGKDTVRLRLHLLPDRHDDCVLVSETPLSSDKGGEFFIDMDRQAPSATAAEHCAASLGAACAGGGFVMSCRVEGEARSSRPFVQLAMRHVTCMEDAAMFVALAAAVDLSVKACRPFRRKPNKKSGSPSPDLLELDT

SEQ ID NO: 10048 - protein, 378 aa, Setaria italica
MGELIPGLPEEVARECLVRVGFDQLPVVRRISRQWKSEVESPDYHRLRRAEGLARPVLALAQAQPAAPADDAAPAAHKHSSTAASGGPANSYRMVLLDPVEGRWAPLPALPGPTESLPLFCQVAALDGGQGRKRLVVVGGWDPETWAPMDAVFVYDFLTGAWRRGAPMPGPRRSFFACAAVGGAVYVAGGHDEEKNALRSALAYDPDADAWAWLPDMAAERDEPRGLCVAGRFLVVGGYPTQAQGRFVGSAEAFDPATSAWVPVQDGLIEDGACPRTCCAAPGASERMYMLRDGHLVARDGPAASWRPVAQVPEDALTAATVSAIPDGRVVVIGAGCHGGDQTVYVLREEAGKGASWARAPAPPEFSGHVQAACSLQI

SEQ ID NO: 10049 - protein, 383 aa, Zea mays
MGDLIPGLPDEVARECLVRVGFDQLPVVRRISRQWKSEVESPDYHRQRRAEGLARPVLALVQAQPTAPPDDDDDAGPAHKRSTAANSYRLVLLEPAEGRWTPLPPPPGPSQSLPLFCQVAAAVDGGGQGRKRLLVVVGGWDPETWAPTDAVLVYDFLSGAWRRGAPMPGPRRSFFACAAVGGAVYVAGGHDAEKNALRSALAYDPGADAWAGLPDMAEERDEPRGLCVAGRFVVVGGYPTRAQGRFVASAESFDPAAAASPAWGWAPVHDRLLPEDGACPRTCCAAPRSVGRMYMLRDGHLVARDGAAAWRPVARVPDDALTAPAVSAFPDGRVVVVGSGCHGGDQTVYVLREEGGRPASWSRAPPPPPEFAGHVQASCFLEL

SEQ ID NO: 10050 - protein, 376 aa, Triticum aestivum
MSDLIPGLPEEVARECLIRVGFDQLPAVRRISRQWKEEVESPDYGRLRRAEGLARPVVAMVQAQPEHVEPGPAQKHASASAANGGSANNYRMVLLDPVEGRWAPLPVLPGPTGSLPLFCQVAAVDGAQGRKRLVVVGGWDPESWAPTDSVYVYDFLTGAWRRGAPMPGPRRSFFATAAVGGAVYVAGGHDEEKNALRSALAYDPDADAWAALPDMAEERDEPRGLCVGGRFLVVGGYPTQAQGRFAGSAEAFDPATAAWATVQESLLEDGTCPRTCCVAPGAERMYMLRDGNLVARDAGASAGWRTVASVPEDARTASTVSAIPGGRVVVIGSGCHGGDQTVYMLRDEAGKAASWARAPAPPEFSGHVQAACLLEI

SEQ ID NO: 10051 - protein, 376 aa, Hordeum vulgare
MADLIPGLPEEVARECLIRVGFDQLPAVRRISRQWKEEVESPGYGRLRRAEGLARPVLAMVQAQPERVEPGPAHKHSSASAANGGPANNYRTVLLDPVEGRWAPLPLLPGPTGSLPLFCQVAAVDGAQGRKRLVVVGGWDPESWAPTDSVYVYDFLTGAWRSGAPMPGPRRSFFATAAVAGAVYVAGGHDEEKNALRSALAYDPDSDAWAALPDMAEERDEPRGLCVGGRFLVVGGYPTQAQGRFAGSAEAFDPVTAAWGTVQEGLLEDGACPRTCCVAPGAERMYMLRDGNLVARDGGPSAGWRTVASVPEDARTASTVSAIPGGRVVVIGSGCHGGDQTVYMLRDEAGKTASWTRASAPPEFSGHVQAACFLEI

SEQ ID NO: 10052 - protein, 374 aa, Brachypodium distachyon
MSELIPGLPEEVARECLIRVGFDQLPAVRRISRQWKEEVESPDYGRLRRAEGLARPVLALVQAQPEPVEPGPAHKHSSANGGPANDYRMVLLDPAEGRWAPIPVLPGPTGSLPLFCQVAAVDGEHGRSRKRLVVVGGWDPDTWAPTDAVHVYDFLTGAWRRGAPMPGPRRSFFACAAVGKAVYVAGGHDEEKNALRSALAYDPDADTWATLPDMAEERDEPRGLCFGGRFLVVGGYPTQAQGRFAGSAEAFDPATWAWAQVQEGLLEDGACPRTCCAAPGGQRMYMLRDGQLVARDGGGGAWRTVAPVPEDARTASTVCAIPGGHVVVIGSGCHGGEQTVYMLRDVAGKPASWARAPAPPEFSGHVQAACFLEI

SEQ ID NO: 10053 - protein, 378 aa, Triticum aestivum
MSDLIPGLPEEVARECLIRVGFDQLPAVRRISRQWKEEVESPDYGRLRRAEGLARPVLAMVQAQPERVEPGPAQKHASASAANGGPANNYRMVLLDPVAGRWAPLPVLPGPTGSLPLFCQVAAVDGPQGRKRLVVVGGWDPESWAPTDSVYVYDFLTGAWRRGAPMPGPRRSFFATAAVGGAVYVAGGHDEEKNALRSALAYDPDADAWAALPDMAEERDEPRGLCVGGRFLVVGGYPTQAQGRFAGSAEAFDPATAAWDTVQEGLLEDGACPRTCCVAPGAECMYMLREGNLVARDGGASAGWRTVASVPEDARTASTVSAIPSGRVVVIGSGCHGGDQTVYMLRDEAGNGKAASWARAPAPPEFSGHVQAACFLEI

SEQ ID NO: 10054 - protein, 570 aa, Arnica chamissonis
MDAVEYAECEAVVKDYPPFREAMKKRGIDDMELVMVDAWCVGYHSKADSPSRRLAKPLIFCRTESDSPMENGYARPVEGINVLVDMQNMVVLEFLDHKLVPLPPADPLRNYTPGHTRGGVDRSDVKPLQILQPSGPSFRVNGHYVEWQKWNFRIGFTPREGLVLHSVAYVDGSRGRRSIAHRLSFVEMVVPYGDPNDPHYRKNAFDAGEDGLGKNAHSLKKGCDCLGYIKYFDAHFTNFIGGVETIENCVCMHEEDHGILWKHQDWRTGLAEVRRSRRLTVSFICTVANYEYGFYWHFYQDGKIEAEVKLTGILSLGALQPGEVRKYGTTIAPGLYAPVHQHFFVARMDMAVDCKPGETYNQVVEVDVKVEEPGKNNVHSNAFYTQVTLLKSESQAMRDCNPLSARHWIVRNTRTVNRTGQLTGYKLVPGSNCLPLAGSEAKFLRRAAFLKHNLWVTPYAPGEDFPGGEFPNQNPRVGEGLASWVQKDRSLEETDIVLWYVFGITHVPRLEDWPVMPVERIGFMLQPHGFFNCSPAVDVPPGACESDVKDGHVKDIIAPKPVSNGLIAKL

SEQ ID NO: 10055 - protein, 744 aa, Flaveria ramosissima
ASDVVVVDDWSNDDRPIPINKPVIGPSDPSANASAKGIQVLTRAQSSHPLDPLSAAEIKVAVATVRAAGATPEVRDGMRFVEVVLLEPDKNVVALADAYFFPPFQPSLLPRSKGGAVIPTKLPPRRARLVVYNKKSNETSVWIVELSEVHAATRGGHHRGKVISSQVVVDVQPPMDAVEYAECEAVVKDYPPFREAMKKRGIDDMDLVMVDAWCVGYHSKADAPSRRLAKPLIFCRTESDSPMENGYARPVEGIYVLVDMQNMVVLEFEDRKLVPLPPADPLRNYTPGHTRGGVDRSDVKPLHILQPDGPSFRVNGHYVEWQKWNFRIGFTPREGLVIHSVAYVDGSRGRRPIAHRLSFVEMVVPYGDPNDPHYRKNAFDAGEDGLGKNAHSLKKGCDCLGYIKYFDAHFTNFIGGVETIENCVCMHEEDHGILWKHQDWRTGLAEVRRSRRLTVSFICTVANYEYGFYWHFYQDGKIEAEVKLTGILSLGALQPGEVRKYGTTIAPGLYAPVHQHFFVSRMDMAVDCKPGEAYNQVVEVDVKVEEPGENNVHNNAFYTQETLLKSESQAMRDCNPLSARHWIVRNTRTVNRTGLLTGYKLVPGSNCLPLAGSEAKFLRRAAFLKHNLWVTPYAPGEDFPGGEFPNQNPRVGEGLASWVQKNRSLEETDIVLWYVFGITHVPRLEDWPVMPVERIGFMLQPHGFFNCSPAVDVPPGACESDVKDNHVKDTITPKSDSNGLLAKL

SEQ ID NO: 10056 - protein, 543 aa, Cichorium intybus
SHPLDPLSAAEIKVAVATVRAAGATPEVRDGMRFVEVVLSEPDKNVVALADAYFFPPFQPSLLPRTKGGAVIPTKLPPRRARLVVYNQKSNETSIWIVELSEVHATTRGGHHRGKVISSRVVLDVQPPMDAVEYAECEAVVKDYPPFREAMKKRGIEDMDLVMVDAWCVGYHSEADAPSRRLAKPLIFCRTESDSPMENGYARPVEGIYVLVDMQNMVVLEFEDRKLVPLPPADPLRNYTPGHTRGGVDRSDVKPLQILQPDGPSFRVNGHYVEWQKWNFRIGFTPREGLVIHSVAYVDGSRGRRPIAHRLSFVEMVVPYGDPNEPHYRKNAFDAGEDGLGKNAHSLKKGCDCLGYIKYFDAHFTNFIGGVETIENCVCMHEEDHGILWKHQDWRTGLAEVRRSRRLTVSFICTVANYEYGFYWHFYQDGKIEAEVKLTGILSLGALQPGEVRKYGTTIAPGLYAPVHQHFLLQEWTWRLIVSLEKHTIRLLKLMLKWKSQEKITFTITRSTHRKHCLNLNHKQCAIVISYLLVIGLLGTREP

SEQ ID NO: 10057 - protein, 363 aa, Ambrosia trifida
PSDPSSKGIQVLTRAQTSHPLDPLSAAEIKVAVAAVRAAGATPEVRDGMRFVEVVLAEPDKNVVALADAYFFPPFQPSLLPRSKGGAVIPTKLPPRRARLVVYNKKSNETSVWIVELSQVHAAARGGHHRGKVISSRVVQDVQPPMDAVEYAECEAVVKDYPPFREAMKKRGIDDMDLVMVDAWCVGYHSKADAPSRRLAKPLIFCRTESDSPMENGYARPVEGIRVLVDMQNMVVLEFEDLKLVPLPPADPLRNYTPGHTRGGVDRSDVKPLQIIQPEGPSFRVNGYYVEWQKWNFRIGFTPREGLVLHSVAYVDGSRGRRSIAHRLSFVEMVVPYGDPNDPHYRKNAFDAGEDGLGKMLIP

SEQ ID NO: 10058 - protein, 523 aa, Petroselinum crispum
MLRAQSSHPLDPLSSAEISVAVATVRAAGATPEVRDGMRFVEVVLSEPSKNIVALADAYFFPPFQPSLLPRTKGGAVIPSKLPPRRARLVVYNKKSNETSIWIVELSEVHAATRGGHHRGKVISSQVVPDVQPPMDAMEYAECEAVVKEYPPFREAMKKRGIEDMDLVMVDAWCVGYYSDADAPNRRLAKPLIFCRTESDCPMENGYARPVEGIYVLVDMQNMVVIEFEDRKLVPLPPADPLRNYTPGETRGGVDRSDVKPLQIVQPEGPSFRVSGHYVEWQKWNFRIGFTPREGLVIHSVAYVDGSRGRRPIAHRLSFVEMVVPYGDPNDPHYRKNAFDAGEDGLGKNAHSLKKGCDCLGYIKYFDAHFTNFTGGIETIENCVCLHEEDHGILWKHQDWRTGLAEVRRSRRLTVSFICTVANYEYGFYWHFYQDGKIEAEVKLTGILSLGALQPGESRKYGTTIAPGLYAPVHQHFLFLEWIWLLIASLGKHTIRLLRLMSKSKNPGMTMYITMRSTLKKRC

SEQ ID NO: 10059 - protein, 678 aa, Cichorium intybus
AAGATPEVRDGMRFVEVVLSEPDKSVVALADAYFFPPFQPSLLPRSKGGAVIPSKLPPRRARLVVYNKKSNETSIWIVELSEVHATTRGGHHRGKVVSSKTIQDVQPPMDAVEYAECEAVVKEYFPFQEAMKKRGIEDMDLVMVDAWCVGYHSEADAPSRRLAKPLIFCRTESDSPMENGYARPVEGIYILVDMQNMVVIDFEDRKLVPLPPADPLRNYTPAHTRGGVDRSDVKPLQILQPDGPSFRVNGHFVEWQKWNFRIGFTPREGLVIHSVAYVDGSRGRRPIAHRLSFVEMVVPYGDPNDPHYRKNAFDAGEDGLGKNAHSLKKGCDCLGYIKYFDAHFTNFTGGVETIENCVCMHEEDHGILWKHQDWRTGLAEVRRSRRLTVSFICTVANYEYGFYWHFYQDGKIEAEVKLTGILSLGALQPGEVRKYGTTIAPGLYAPVHQHFFVARMDMAVDCKPGEAYNQVVEVNVKVEESGKDNVHNNAFYTEETLLKTENQAARDCNQLSARHWIIRNTRTVNRTGQLTGYKLVPGSNCLPLAGSEAKFLRRAEFLKHNLWVTPYALDENFPGGEFPNQNPRVGEGLASWVKQNRSLEETDIVLWYVFGITHVPRLEDWPVMPVEHIGFMLQPHGFFNCSPAVDVPPGACESDVKDNEAKEVVATKSVSNALIAKL

SEQ ID NO: 10060 - protein, 518 aa, Prunus persica
MASASKKTSSSCCFRSDSAPIPREAAPAPNAVVSASVVQDWTAIAGSEDRRDDQRPKKIAMASLITEPSANASTTGIPIMLRPQTRHPLDPLSAAEISVAVATVRAAGATPEVRDSMRFVEVVLLEPDKHVVGLADAYFFPPFQPSLLPRTKGGPIIPTKLPPRRARLVVYNKKSNETSTWVVELSEVHAATRGGHHRGKVISSQVVPDVQPPMDAVEYAECEAVVKDFPPFREAMKKRGIEDMDLVMVDAWCVGYHSDADAPSQRLAKPLIFCRTESDCPMENGYARPVEGIYVLVDMQNMVVVEFEDRKLVPLPPADPLRNYTPGETRGGVDRSDVKPLQILQPEGPSFRVNGYFVEWQKWNFRIGFTPREGLVIYSVAYVDGSRGRRPVAHRLSFVEMVVPYGDPNDPHYRKNAFDAGEDGLGKNAHSLKKGCDCLGYIKYFDAHFTNFTGGIETIENCVCLHEEDHGILWKHQDWRTGLAEVRRSRRLTVSFICTVANYEYGFFWHFYQARWED

SEQ ID NO: 10061 - protein, 524 aa, Fragaria vesca
MASASQKATPSSSCCGGGDASSVAPREAAAPPSNAVVSAAVAKDWTGSVTEDRRDDQRVPPKKIAMASLVSEPSAKNASAAGIPIMVRPQSRHPLEPLSPAEISVAVATVRAAGATPEVRDSMRFVEVVLLEPDKHVVALADAYFFPPFQPTLLPRTKGGPIIPSKLPPRRARLIVYNKTSNEISTWIVELSEVHAATRGGHHRGKVISSQVIPDVQPPMDAVEYAECEAVVKDFPPFGEAMKKRGIEDMDLVMVDAWCVGYHSEADAPSKRLAKPLIFCRTESDCPMENGYARPVEGIHILVDMQSMVVLEFEDRKLVPLPPADPLRNYTSGETRGGVDRSDVKPLKIVQAEGPSFRVDGYFVEWQKWNFRVGFTPREGLVIYSIAYDDGSRGRRPVAHRLSFVEMVVPYGDPNDPHYRKNAFDAGEDGLGKNAHSLKKGCDCLGYIKYFDAHFTNFTGGVETIENCVCLHEEDHGMLWKHQDWRTGLAEVRRSRRLTVSFICTVANYEYGFFWHFYQARWKD

SEQ ID NO: 10062 - protein, 795 aa, Ricinus communis
MATAQEKATLSSSSSSSSSCCTDNNSSNKATSSAAAAATQVLQDWSVAPVSNLAQDPIRDRSSTTTMSSLIQPVDSLTDPTPPPNPVSAKGIPTMTRAQTSHPLDPLTAAEISVAVATVRAAGATPEVRDSMRFVEVVLLEPEKNVVALADAYFFPPFQPSLIPRTKGGPLIPTKLPPRKARLIVYNKKSNETSIWIVELSEVHAATRGGHHRGKVISSKVVPDVQPPMDAVEYAECEAVVKDFPPFLEAMKKRGIEDMDLVMVDPWCSGYHSDADAPSRRLAKPLIFCRTESDCPMENGYARPVEGIHVLVDMQNMVVIEFEDRKLVPLPPADPLRNYTAGESRGGVDRSDVKPLQIIQPEGPSFRVNGHFVQWQKWNFRIGFTPREGLVIYSVAYVDGSRGRRPVAHRLSFVEMVVPYGDPNDPHYRKNAFDAGEDGLGKNAHSLKKGCDCLGFIKYFDAHFTNFSGGVETIENCVCLHEEDHGILWKHQDWRTGLAEVRRSRRLSVSFVCTVANYEYGFFWHFYQDGKIEAEVKLTGILSLGALQPGEVRKYGTTIAPGLYAPVHQHFFVARMDMAVDCKPGETFNQVVEVNVKVEEPGKDNVHNNAFYAEDKLLRSELQAMRDCNPLTARHWIIRNTRTVNRTGQLTGYKLVPGSNCLPLAGSEAKFLRRAAFLKHNLWVTPYAPDEMYPGGEFPNQNPRVGEGLATWVKQNRSLEETNIVLWYVFGVTHIPRLEDWPVMPVERIGFILMPHGFFNCSPAVDVPPSACDMDIKDNGITAKPPIQNGLLAKL

SEQ ID NO: 10063 - protein, 570 aa, Cichorium intybus
MDAVEYAECEAVVKEYFPFQEAMKKRGIEDMDLVMVDAWCVGYHSEADAPSRRLAKPLIFCRTESDSPMENGYARPVEGIYILVDMQNMVVIDFEDRKLVPLPPADPLRNYTPAHTRGGVDRSDVKPLQILQPDGPSFRVNGHFVEWQKWNFRIGFTPREGLVIHSIAYVDGSRGRRPIAHRLSFVEMVVPYGDPNDPHYRKNAFDAGEDGLGKNAHSLKKGCDCLGYIKYFDAHFTNFTGGVETIENCVCMHEEDHGILWKHQDWRTGLAEVRRSRRLTVSFICTVANYEYGFYWHFYQDGKIEAEVKLTGILSLGALQPGEVRKYGTTIAPGLYAPVHQHFFVARMDMAVDCKPGEAYNQVVEVNVKVEESGKDNVHNNAFYTEETLLKTENQAARDCNQLSARHWIIRNTRTVNRTGQLTGYKLVPGSNCLPLAGSEAKFLRRAEFLKHNLWVTPYALDENFPGGEFPNQNPRVGEGLASWVKQNRSLEETDIVLWYVFGITHVPRLEDWPVMPVEHIGFMLQPHGFFNCSPAVDVPPGACESDVKDNEAKEVVATKSVSNALIAKL

SEQ ID NO: 10064 - protein, 792 aa, Cannabis sativa
MAPASKKTTGGSSSCCFTSSDSASIHRDSTASSVVAVSAAPASDGAVVSANAVQDWTISSTDLRDDQRAKKMAMSSLISESSTTLSTKGIPIMLRAQSSHPLDPLSAAEISVAVATVRAAGATPELRDSMRFVEVVLLEPDKHVVALADAYFFPPFQPSLLPRTKGGPVIPSKLPARRARLVVYNKKSNETSTWIVELSEVHAATRGGHHRGKVISSQVVPDVQPPMDAVEYAECEAVVKDFPPFREAMKKRGIEDMDIVMVDAWCVGYHSDADAPSRRLAKPLIFCRTESDCPMENGYARPVEGIHVVVDMQNMVVIEFEDRKLVPLPPADPLRNYTPGESRGGVDRSDVKPLQIIQPEGPSFRVNGYFVEWQKWNFRIGFTPREGLIIYSVAYVDGSRGRRPVAHRLSFVEMVVPYGDPNDPHYRKNAFDAGEDGLGKNAHSLKKGCDCLGYIKYFDAHFTNFTGGVETLENCVCLHEEDHGILWKHQDWRTGLAEVRRSRRLTVSFVCTVANYEYGFFWHFYQDGKIEAEVKLTGILSLGALQPGEFRKYGTMIAPGLYAPVHQHFFVARMDMAVDCKPGETNNQVVEVDVKVEEPGENNVHNNAFYAEERLLKSESEAMRDCNPLAARHWIVRNTRTVNRTGHFTGYKLVPGSNCLPLAGPEAKFLRRAAFLKHNLWVTSYARDEMYPGGEFPNQNPRAGEGLATWVKKNRSLEETNIVLWYVFGITHVPRLEDWPVMPVEHIGFMLMPHGFFNCSPAVDVPPNASDMDTKEPDVKDAGVVKPLLAKL

SEQ ID NO: 10065 - protein, 729 aa, Ricinus communis
MSSLIQPVDSLTDPTPPPNPVSAKGIPTMTRAQTSHPLDPLTAAEISVAVATVRAAGATPEVRDSMRFVEVVLLEPEKNVVALADAYFFPPFQPSLIPRTKGGPLIPTKLPPRKARLIVYNKKSNETSIWIVELSEVHAATRGGHHRGKVISSKVVPDVQPPMDAVEYAECEAVVKDFPPFLEAMKKRGIEDMDLVMVDPWCSGYHSDADAPSRRLAKPLIFCRTESDCPMENGYARPVEGIHVLVDMQNMVVIEFEDRKLVPLPPADPLRNYTAGESRGGVDRSDVKPLQIIQPEGPSFRVNGHFVQWQKWNFRIGFTPREGLVIYSVAYVDGSRGRRPVAHRLSFVEMVVPYGDPNDPHYRKNAFDAGEDGLGKNAHSLKKGCDCLGFIKYFDAHFTNFSGGVETIENCVCLHEEDHGILWKHQDWRTGLAEVRRSRRLSVSFVCTVANYEYGFFWHFYQDGKIEAEVKLTGILSLGALQPGEVRKYGTTIAPGLYAPVHQHFFVARMDMAVDCKPGETFNQVVEVNVKVEEPGKDNVHNNAFYAEDKLLRSELQAMRDCNPLTARHWIIRNTRTVNRTGQLTGYKLVPGSNCLPLAGSEAKFLRRAAFLKHNLWVTPYAPDEMYPGGEFPNQNPRVGEGLATWVKQNRSLEETNIVLWYVFGVTHIPRLEDWPVMPVERIGFILMPHGFFNCSPAVDVPPSACDMDIKDNGITAKPPIQNGLLAKL

SEQ ID NO: 10066 - protein, 378 aa, Chelidonium majus
MVVPYGDPNEPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFFWHFYQDGKIEAEVKLTGILSLGALQPGESRKYGTTIAPGLYAPVHQHFFVARMDMAVDCRPGEKFNQVVEVNVKVEEPGPNNIHNNAFYAEEELLRTEMQAMRDCSPLSARHWIVQNTRSVNRTGQLTGYKLVPGSNCLPLAGADAKFLRRATFLKHNLWVTPYARGEMYPGGEFPNQNPRVGEGLGTWVKQNRPLEESDIVLWYVFGITHIPRLEDWPVMPVEHIGFMLMPHGFFNRSPAVDVPPSTCELDLKENGLPKPIQNAVLAKL

SEQ ID NO: 10067 - protein, 334 aa, Citrus clementina
MHISPILLEGVDTIENCVCLHEEDHGILWKHQDWRTGLAEVRRSRRLSVSFICTVANYEYAFFWHFYQDGKIEAEVKLTGILSLGALQPGEVRKYGTIIAPGLYAPVHQHFFVARMDMAVDCKPGEAHNQVVEMNVKVEEPGKNNVHNNAFYAEEELLKSELQAMRGCNPLTARHWIIRNTRTVNRTGQLTGYKLVPGSNCLPLAGSEAKFLRRAAFLKHNLWVTPYAHDEMYPGGEFPNQNPRVGEGLATWVKQNRSLEETDIVLWYVFGVTHIPRLEDWPVMPVDRIGFMLMPHGFFNCSPAVDVPPNESDLDLKDTVIAEKPVQNGLLAKL

SEQ ID NO: 10068 - protein, 517 aa, Manihot esculenta
MATAQEKATTSCCTSTKSSSAAAAAATEVLHDWSVATVSNPPQDPINKRATMSSLIRPVESLNDPSPPNTNSAKGITMMARAQTSHPLDPLTAAEISVAVATVRAAGATPEVRDSMRFVEVVLLEPDKQVVALADAYFFPPFQPSLLPRTKGGPVIPTKLPPRKARLIVYNKKSNETSIWVVELSEVHAATRGGHHRGKVISSKVVPNVQPPMDAVEYAECEALVKAFPPFQEAMKKRGIEDMDLVMVDPWCAGYHSEADAPSRRLAKPLIFCRTESDCPIENGYARPVEGIHVLVDMQNMVVIEFDDRKLVPLPPADPLRNYTAGESRGGVDRSDVKPLQIIQPEGPSFRVNGHFVQWQKWNFRIGFTPREGLVIYSVAYVDGSRGRRPVAHRLSFVEMVVPYGDPNDPHYRKNAFDAGEDGLGKNAHSLKKNCDCLGFIKYFDAHFTNFTGGVETIENCVCLHEEDHGILWKHQDWRTGLAEVRRSRRLSVSFICTVANYEYGFFWHFYQARWEN

SEQ ID NO: 10069 - protein, 566 aa, Tripterygium wilfordii
MDATEYAECEAVVKDFPPFREAMKKRGIEDMDLVMVDTWCVGYHSNADAPSHRLAKPLIFCRTESDCPMENGYARPVEGIHVLVDMQNMEVIEFEDRKLVPLPPADPLRNYTAGETRGGVDRSDVKPLQIIQPEGPSFRVNGHFVEWQKWNFRIGFTPREGLVIYSVAYVDGNRGRRPVAHRLSFVEMVVPYGDPNDPHYRKNAFDAGEDGLGKNAHSLKKGCDCLGYIKYFDAHFINFTGGVETIENCVCLHEEDHGILWKHQDWRTGLAEVRRSRRLSVSFICTVANYEYGFFWHFYQDGKMEAEVKLTGILSLGALQPGEVRKYGTTIAPGLYAPVHQHFFVARMDMAVDCKPGEAYNQVVEVNVKLEEPGKDNVHNNAFYAEEELLRSELQAMRDCNPFSARHWIVRNTRTVNRTGQLTGYKLVPGTNCLPLAGSEAKFLRRAAFLKHNFWVTPYSSDEMYPGGEFPNQNPRVGEGLATWVKQDRSLEETDIVLWYVFGVTHIPRLEDWPVMPVERIGFMLMPHGFFNRSPAVDVPPCASDMDLKDAGIVSKPIQNGLLAKI

SEQ ID NO: 10070 - protein, 779 aa, Castanea mollissima
SASCCINDDLSSSSSSSISREPTAASAAPILANAPAAAPVSASASANAAQDWTVASSADRRDDKPAPASSKAIPLMLRAQTSHPLDPLSATEISVTIATVRAAGATPEVRDSMRFIEVVLDEPNKHVVALADAYFFPPFQPSLVPKTRGGPRIPTKLPPRRARLIVYNKKSNETSVWIVELSEVHAVTRGGHHRGKVISSHVIPDVQPPMDAVEYAECEAVVKDFPPFREAMKRRGIEDMDLVMVDPWCVGYHSEADAPKRRLAKPLIFCRTESDCPMENGYARPVEGIHVLVDMQNMIVIEFEDRKLVPLPPADPLRNYTAGETRGGVDRSDVKPLQIVQHEGPSFRVNGYFVEWQKWNFRIGFTPREGLVIYSIAYVDGSRGRRPVAHRLSFVEMVVPYGDPNDPHYRKNAFDAGEDGLGKNAHSLKKGCDCLGYIKYFDAHFTNFTGGVETIENCVCLHEEDHGILWKHQDWRTGLAEVRRSRRLSVSFICTVANYEYGFYWHFYQDGKIEAEVKLTGILSLGALLPGEFRKYGTMIAPGLYAPVHQHFFVARMDMAVDCKPGEAFNQVVEVDVKVEEPGENNVHNNAFYAEERLLKSELEAMRDCSPLSARHWIVRNTRTVNRTGQLTGYKLVPGSNCLPLAGAEAKFLRRASFLKHNLWVTPYAHDEMFPGGEFPNQNPRVDEGLATWVKQNRSLEETDVVLWYVFGITHVPRLEDWPVMPAERIGFMLMPHGFFNCSPAVDVPPNACELEAKDNDVKDNGVVKPIQPALLAKL

SEQ ID NO: 10071 - protein, 704 aa, Olea europaea
MTRAQTSHPLDPLSAAEISVAVATVRAAGATPEVRDSMRFVEVVLLEPEKHVVALADAYFFPPFQPSLLPRTKGGPTIPSKLPPRRARLVVYNKKSNETSIWIVELTQVHATTRGGHHRGKVISSTVVPDVQPPMDAAEYAECEAVVKDYPPFRDAMKKRGIEDMDLVMVDPWCVGYHSEADAPSRRLAKPLIFCRTESDCPLENGYARPVEGIHVLVDMQNMVVIEFEDRKLVPLPPADPLRNYTSGETRGGVDRSDVKLLQIVQPEGPSFRVRGHYVEWQKWNFRVGFTPREGLVIHSVAYIDGNRGRRPIAHRLSFVEMVVPYGDPNDPHYRKNAFDAGEDGLGKNAHSLKKGCDCLGYIKYFDAHFTNFTGGVETIENCVCLQEEDHGVLWKHQDWRTGLAEVRRSRRLTVSFICTVANYEYGFYWHFYQDGKIEAEVKLTGILSLGALQPGESRKYGTTIAPGLYAPVHQHFFVARMDMTVDSKPGEANNQVVEVNVRVEEPGQDNVHSNAFYAEETLLRSELEAMRDCDPSSARHWIVRNTRTVNRSGQLTGYKLVPGSNCLPLAGPEAKFMRRAAFLKHNLWVTPYARGEDFPGGEFPNQNPRVGEGLASWVKKNRSLEENDIVLWYVFGITHVPRLEDWPVMPVEHIGFMLQPHGFFNCSPAVDVPPNTCEIDTKENDVKDNGVPKPTSVGLMAKI

SEQ ID NO: 10072 - protein, 786 aa, Papaver somniferum
MASASKKTTSNNNCFSIINGVGASSALELRREAVSAEILQDWTINDNKKNNNDDYEKQQNKKIVASTTNLTDPSTTNPSSKGIQIMLRAQSSHPLDPLSAAEISVAVGTVRAAGATPEVRDSMRFIEVVLLEPDKNIVALADAYFFPPFQPSLLPKSKGGAFIPSKLPARRARLVVYNKRSNETSVWIVELTEVHAATRGGPNRGKVVSSQVIPDVQPPMDAMEYAECEAVVKDFAPFQDAMKKRGIEDMDLVMVDPWCVGYYSDGDAPSRRLAKPLIFCRTESDCPMENGYARPVEGIYVLVDMQNMVVIEFEDRKLVPLPPADPLRNYTAGETRGGVDRSDVKPLQIIQPEGPSFRVNGQFVEWQKWNFRVGFTPREGLVIYSVAYTDGSGGRRPVAHRLSFVEMVVPYGDPNEPHYRKNAFDAGEDGLGKNAHSLKKGCDCLGYIKYFDAHFTNFTGGVETIENCVCLHEEDHGILWKHQDWRSGLAEVRRSRRLTVSFFCTVANYEYGFFWHFYQDGKIEAEVKLTGILSLGAIQPGESRKYGTTIAPGLYAPVHQHFFVSRMDMAVDCKPGEAFNQVVEVDVKVEEPGKNNIHNNAFYAEETLLKSEMQAMRDCNPLSARHWIIKNTRNVNRTGQLTGYKLMPGSNCSPFAGPEAKFLRRAAFLKHNLWVTQYAHDEMYPGGEFPNQNPRDSEGLTTWVKQNRSLEETNIVLWYVFGITHVPRLEDWPVMPVEHIGFTLVPHGFFNCSPAVDVPPSIGASELDLKEIGVSKPIQNGLLSKL

SEQ ID NO: 10073 - protein, 804 aa, Aquilegia formosa
MATTSEKATLCCINDTKKSNLSNLSMRSSRQPVSVSGPTTTTTTTSTSDLVAQDWIVTTNSNTDHQQQEQQQQQKKRASAMATLITPVESIPEPSTNPPTKGLQIMMRAQSSHPLDPLSAAEISVAVGTVRAAGATPEVRDSMRFIEVVLLEPDKHVVALADAYFFPPFQPSLLPKTKGGPVIPSKLPPRRARLVVYNKKSNETSIWIVELTEVHAATRGGHHRGKVITSQIVPDVQPPMDAVEYAECEAVVKDFPPFREAMKKRGIEDMDLVMVDPWCVGYHSDSDAPSRRLAKPLIFCRTESDCPMENGYARPVEGIYVVVDMQNMVVVEFEDRKLVPLPPADPLRNYTSGETRGGVDRSDVKPLQIIQPEGPSFRVHGHFVEWQKWNFRIGFTPREGLVIYSVAYTDGSRGRRPVAHRLSFVEMVVPYGDPNEPHYRKNAFDAGEDGLGKNAHSLKKGCDCLGYIKYFDAHFTNFTGGVETTENCVCLHEEDHGMLWKHQDWRTGLAEVRRSRRLTVSFVCTVANYEYGFFWHFYQDGKIEAEVKLTGILSLGAVQPGESRKYGTTIAPGLYAPVHQHFFVARMDMAVDCKPGETFNQVVEVNVKVEEPGKNNVHSNAFYAEEELLTSELDAMRDCSPLTARHWIVRNTRTVNRTGQLTGYKLVPGSNCLPLAGSEAKFLRRATFLKHNLWVTPYARGEMYPGGEFPNQNPRVGEGLATWVKQNRSLEETNIVLWYVFGVTHIPRLEDWPVMPVEHIGFMLMPHGFFNCSPAIDVPPSSNDLELKENGVSKPIQNGLLAKL

SEQ ID NO: 10074 - protein, 786 aa, Amborella trichopoda
MATTQEKATLCCTSNGAIGGNNAQSREGARSSSVVVEKAASAPLTREAVSAEVPEWTDEKQNLALTGLIHPVDALHEPPAKGAGIHVMMRAQTRHPLDPLSAAEIAVAVATVRAAGKTPEVRDGMRFIEVVLWEPDKSVVALADAYFFPPFQPSLLPKTKGGPVIPSKLPPRRARLVVYNKKSNETSIWIVELTEVHAATRGGHHRGKAVSSEVVPDVQPPMDAVEYAECEAVVKDYPPFREAMKKRGIEDMDLVMVDAWCVGYHSDADAPSRRLAKPLIFCRTESDCPMENGYARPVEGIHILVDMQNMVVIEFEDRKLVPLPPADPLRNYTPGETRGGIDRSDIKPLHILQPEGPSFRVNGYFVEWQKWNFRIGFTPREGLVIYSVAYIDGSRGRRPVAHRLSFVEMVVPYGDPNEPHYRKNAFDAGEDGLGKNAHSLKRGCDCLGYIKYFDAHFTNFTGGVETIENCVCLHEEDHGILWKHQDWRTGLAEVRRSRRLTVSFICTVANYEYGFFWHFYQDGKIEAEVKLTGILSLGALQPGESRKYGTTIAPGLYAPVHQHFFVARLDMAVDCKPGEALNQVVEVNVKVEEPGKNNIHNNAFYAEEELLRSELQAMRDCNPLTARHWIVRNTRSVNRTGQLTGYKLLPGSNCLPLAGSEAKFLRRAAFLKHNLWVTAYKRDEKYPGGEFPNQNPRIDEGLATWVKQNRPLEENDIVLWYVFGVTHIPRLEDWPVMPVDRIGFMLMPHGFFNCSPAVDVPPSSTETDLKEIGVPKPLQNGLVSKL

SEQ ID NO: 10075 - protein, 514 aa, Prunus persica
MAATQEKATPCCLDAVPAKSSALLRKASDPMRDWTVSGSDPSQDPIRNRAAVPTLIRPIETLPATSTNTTAAKGIPVMLRAQTSHPLEPLSAAEISVAVATVRAAGATPEVRDSMRFVEVALVEPDKHVVALADAYFFPPFQPSLLPRTKGGPMIPSKLPPRQARLVVYNKKSNETSICIVELSEVHAATRGGHHRGKVISSKVVPDVQPPMDAMEYAECEAVVKDFPPFREAMKKRGIEDMDLVMVDPWCAGYHSEADAPSRRLAKPLIFCRTESDCPMENGYARPVEGIHVLVDMQNMVVLEFEDRKLVPLPPADPLRNYTPGETRGGVDRSDVKPLQIIQPEGPSFRVNGHFVEWQKWNFRIGFTSKEGLVIYSVAYIDGSRGRRPVAHRLSFVEMVVPYGDPNAPHYRKNAFDAGEDGLGKNAHSLKKGCDCLGYIKYFDAHFTNFTGGVETIENCVCLHEEDHGILWKHQDWRTGLAEVRRSRRLTVSFICTVANYDHAYQFSFVGWAY

SEQ ID NO: 10076 - protein, 779 aa, Nicotiana benthamiana
MASTQEKATLSSPSRNASAAQFSPEWTAAGTVAEISDRSSTTRSAANAKSTATAAVGVIDSIDRPSLSNAPAVKGLPTLLRAQSHHPLDPLTAAEIAVAVATVRAAGSTPEVRDSMRFVEAVLVEPDKSVIALADAYFFPPFQPSLLPRTKGGPVIPSKLPPRKARLIVYNKKSNETSIWIVELSEVHAVTRGGHHRGKVISSQVVPDIQPPMDAAEYAECEAVVKDFPPFRDAMKKRGIDDMELVMVDAWCAGYFSEADAPNRRLGKPLIFCRTESDCPMENGYARPVEGIHILVDMQNMVVIEFEDRKVVPLPPADPLRNYTPGETRGGVDRSDVKPLLISQPEGPSFRVSGHFVEWQKWNFRIGFTPREGLVIYSVAYVDGSRGRRPVAHRLSFIEMVVPYGDPNEPHYRKNAFDAGEDGLGKNAHSLKKGCDCLGYIKYFDAHFTNFTGGVETIENCVCLHEEDHGMLWKHQDWRTGLAEVRRSRRLTVSFICTVANYEYGFYWHFYQDGKIEAEVKLTGILSLGALLPGEVRKYGTTIAPGLYAPVHQHFFVARMDMAVDCKPGEAHNQVVEVNARVEPPGENNVHNNAFYAEERLLRTELEAMRDCNPLTARHWIIRNTRTVNRTGQLTGYKLVPGTNCLPLAGSEAKFLRRAAFLKHNLWVTPYSGDEMFPGGEFPNQNPRVGEGLATWVKQNRSLEETQIVLWYVFGLIHVPRLEDWPVMPVEHIGFMLQPHGFFNCSPAVDVPPSTADSDIKENGVVTKSCHDGGIMAKL

SEQ ID NO: 10077 - protein, 700 aa, Medicago truncatula
MAKAQTCHPLDPLSAAEISVAVATVRAAGATPEVRDGIRFIEVGLVEPEKQVVALADAYFFPPFQPSLLPRIKGGPVIPSKLPPRKARLVVYNKKSNETSIWIVELTEVHATTRGGHHRGKVITSTVVPDVQPPMDAVEYAECEAVVKDFPPFREAMKKRGIEDMDLVMVDPWCAGYHSEGDAPSRRLAKPLFFCRTESDCPMENGYARPVEGIHVLVDMQNMVVLEFEDRKLVPLPQADPLRNYTSGETRGGVDRSDVKPLQIIQPDGPSFRVNGNFIQWQKWNFRIGFTPREGLVIYSVAYIDGSRGRRPVAHRLSFVEMVVPYGDPNDPHYRKNAFDAGEDGLGKNAHSLKKGCDCLGYIKYFDAHFTNFYGGVETIENCVCMHEEDHGMLWKHQDWRTGLAEVRRSRRLTVSFICTVANYEYGFYWHFYQDGKIEAEVKLTGILSLGALQQGETRKYGTTIAPGLYAPVHQHFFVARMDMAVDCKPGEAFNQVVEVNVKVEEPGKNNVHNNAFYAEEKLLKSELEAMRDCDPLSARHWIVRNTRSVNRTGHLTGYKLVPGSNCLPLAGSEAKFLRRAAFLKHNLWVTPYARDELHPGGEFPNQNPRVGEGLATWVKQNRPLEEADIVLWYVFGVTHIPRLEDWPVMPVEHIGFMLMPHGFFNCSPAVDVPPSPGDLDDKENGMPAKHSQNGLIAKL

SEQ ID NO: 10078 - protein, 700 aa, Lupinus angustifolius
MMRAQTCHPLDPLTAAEISVAVATVRAAGATPEVRDSMRFVEVVLVEPDKQVVALADAYFFPPFQPSLLPRTKGGPVIPTKLPTRKARLVVYNKRSNETSIWIVELREVHAATRGGHHRGKVISSEVVPDVQPPMDAVEYAECEAVVKEFPQFREAMKRRGIEDMDLVMVDAWCTGYHSEADAPSRRLAKPLIFCRTESDCPMENGYARPVEGIHVLVDMQNMVVLEFEDRKLVPLPPTDPLRNYTSGETRGGVDRSDVKPLQIIQPEGPSFRVNGHFIQWQKWNFRIGFTPREGLVIYSVAYIDGSHGRRQLAHRLSFVEMVVPYGDPNEPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFFWHFYQDGKIEAEVKLTGILSLGALQPGETRKYGTTIAPGLYAPVHQHFFIARMDMAVDCKPGEAFNQVVEVDVKVEEPGKNNVHNNAFYAEEKLLKSELEAMRDCNPSSARHWIVRNTRTVNRTGQLTGYKLVPGSNCLPLAGSEAKFLRRAAFLKHNLWVTPYNRNEMHPGGEFPNQNPRVGEGLATWVKQNRSLEEADIVLWYVFGMTHIPRLEDWPVMPVEHLGFMLMPHGFFNCSPAVDVPPSASDLDDKENGTPTKPVQNGLIAKL

SEQ ID NO: 10079 - protein, 704 aa, Quercus alba
MLRAQTSHPLDPLSATEISVTIATVRAAGATPEVRDSMRFIEVVLVEPNKHVVALADAYFFPPFQPSLVPKTKGGPIIPTKLPPRRARLIVYNKKSNETSVWIVELSEVHAVTRGGHHRGKVISSHVIPDVQPPMDAVEYAECEAVVKDFPPFREAMKRRGIEDMDLVMVDPWCVGYHSEADAPKRRLAKPLIFCRTESDCPMENGYARPVEGIHVLVDMQNMIVIEFEDRKLVPLPPADPLRNYTAGETRGGVDRSDVKPLQIVQHEGPSFRVNGYFVEWQKWNFRIGFTPREGLVIYSIAYVDGSRGRRPVAHRLSFVEMVVPYGDPNDPHYRKNAFDAGEDGLGKNAHSLKKGCDCLGYIKYFDAHFTNFTGGVETIENCVCLHEEDHGILWKHQDWRTGLAEVRRSRRLSVSFICTVANYEYGFYWHFYQDGKIEAEVKLTGILSLGALLPGEFRKYGTMIAPGLYAPVHQHFFVARMDMAVDCKPGEAFNQVVEVDVKVEEPGENNVHNNAFYAEERLLKSELEAMRDCSPLSARHWIVRNTRTVNRTGQLTGYKLVPGSNCLPLAGAEAKFLRRASFLKHNLWVTPYAHDEMFPGGEFPNQNPRVDEGLATWVKQNRSLEETDVVLWYVFGITHVPRLEDWPVMPAERIGFMLMPHGFFNCSPAVDVPPNACELEAKDNDVKDNGVVKPIQPALLAKL

SEQ ID NO: 10080 - protein, 704 aa, Citrullus lanatus
MLRAQSRHPLDPLSAAEISVAVATVRAAGATPEVRDSMRFIEVVLLEPEKHVVALADAYFFPPFQPSLLPKTKGGPVIPTKLPPRRARIVVYNKKSNETSLWIVELSEVHAVTRGGHHRGKVISSTVVPEVQPPMDAAEYAECEAVVKEYPPFIEAMKKRGIEDMDLVMVDPWCVGYHSEVDAPGRRLAKPLIFCRTESDCPMENGYARPVEGIHVLVDMQNMVVIEFEDRKLVPLPPADPLRNYTSGETRGGVDRSDVKPLQIVQPEGPSFRVNGYYVEWQKWNFRIGFTPREGLVIYSVAYVDGSRGRRPVAHRLSFVEMVVPYGDPNDPHYRKNAFDAGEDGLGKNAHSLKKGCDCLGYIKYFDAHFTNFTGGVETIENCVCMHEEDHGILWKHQDWRTGLAEVRRSRRLTVSFICTVANYEYGFFWHFFQDGKIEAEVKLTGILSLGALQPGEYRKYGTMIAPGLYAPVHQHFFVARMDMAVDCKPGEAFNQVVEVDLKVEGPGENNVHNNAFYAEETLLKSEMQAMRDCSPLSARHWIVRNTRTVNRTGQLTGYKLLPGSNCLPLAGSEAKFLRRASFLKHNLWVTQYSRDEMFPGGEFPNQNPRVGEGLSTWVKQDRPLEETDIVLWYVFGITHVPRLEDWPVMPVDRIGFTLLPHGFFNCSPAVDVPPSACELDSKDTDAKENGVTKPIQTPIISKL

SEQ ID NO: 10081 - protein, 737 aa, Medicago truncatula
MATAQEKTTPDPSQDPTRNTDSFPPKTTPTTKGIPVMMRAQTCHPLDPLSAAEISVAVATVRAAGATPEVRDSMRFVEVVLVEPVKQVVALADAYFFPPFQPSLLPRTKGGGPLIPTKLPTRKARLVVYNKKSNETSVWIVELREVHAATRGGPHRGKVISSQVVPNVQPPMDAMEYAECEAVVKDFPPFREAMKRRGIEDMDLVMVDAWCVGYHSEADAPNRRLAKPLIFCRSESDCPMENGYARPVEGIYVLVDMQNMVVLEFEDRKLIPLPPTDPLRNYTSGETRGGVDRSDVKPLQIIQPEGPSFRVNGHFIQWQKWNFRIGFTPREGLVIYSVAYIDGSRGRRPVAHRLSFVEMVVPYGDPNDPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFFWHFYQDGKIEAEVKLTGILSLGALQPGETRKYGTTIAPGLYAPVHQHFFVARMDMAVDCKPGEAFNQVVEVDVKVEDPGKNNVHNNAFYAEERLLKSELEAMRDCNPLSARHWIVRNTRTVNRTGQLTGYRLVPGSNCLPLAGSEAKFLRRAAFLKHNLWVTPYVHNEMHPGGEFPNQNPRVGDGLATWVKQNRSLEEADIVLWYVFGVTHIPRLEDWPVMPVERIGFMLMPHGFFNCSPAVDVPPSAGDLDDKENGMPAKPIQNELIAKL

SEQ ID NO: 10082 - protein, 700 aa, Cajanus cajan
MTRPQTSHPLDPLLAAEISVAVATVRAAGPTPEVRDSMRFVEVVLVEPDKQVVALADAYFFPPFQPSLLPRTKGGPVIPTKLPPRKARLVVYNKRSNETSIWIVELRQVHAATRGGHHRGKVISSKVVPNVQPPMDAVEYAECEAVVKDFPPFREAMKRRGIEDMDLVMVDAWCVGYHSEADAPSRRLAKPLIFCRTESDCPMENGYARPVEGIHILVDMQNMEILEFEDRKLIPLPPADPLRNYTSGETRGGVDRSDVKPLQIIQPEGPSFRVNGHFIQWQKWNFRIGFTPREGLVIYSVAYIDGSRGRRPVAHRLSFVEMVVPYGDPNDPHYRKNAFDAGEDGLGKNAHSLKKGCDCLGYVKYFDAHFTNFNGGVETIENCVCLQEEDHGILWKHQDWRTGLAEVRRSRRLTVSFICTVANYEYGFFWHFYQDGKIEAEVKLTGILSLGALQPGETRKYGTTIAPGLYAPVHQHFFVARMDMAVDCKPGEAFNQVVEVDVKVEESGKNNVHNNAFYAEEKLLKSELEAIRDCNPLSARHWIVRNTRTVNRTGQLTGYKLVPGSNCLPMAGSEAKFLRRAAFLKHNLWVTPYAPDEMHPGGEFPNQNLRVGEGLATWVQQNRSLEEADIVLWYVFGVTQIPRLEDWPVMPVERIGFMLMPHGFFNCSPAVDVPPSASDLDDKDNGMSAKPIQNGVIAKL

SEQ ID NO: 10083 - protein, 700 aa, Fragaria vesca
MLRAQSSHPLEPLSAAEISVAVATVRAAGATPEVRDSMRFVEVALVEPDKRVVALADAYFFPPFQPSLLPRTKGGPMIPSKLPPRQARLVVYNKKSNETSVWVVELSEVHAATRGGHHRGKVISSNVVPDVQPPMDAMEYAECEAVVKDYPPFRDAMKKRGIEDLDLVMVDPWCTGYHSEADAPSRRLAKPLIFCRTESDCPMENGYARPVEGIHVLVDMQNMVVLEFEDRKLVPLPPADPLRNYTPGETRGGVDRSDVKPLKIVQPEGPSFRVNGHFVEWQKWNFRIGFTSKEGLVIYSVAYTDGSRGRRPVAHRLSFVEMVVPYGDPNDPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFYWHFYQDGKIEAEVRLTGILSLGALQPGETRKYGTTIAPGLYAPVHQHFFVARMDMAVDSKPGETYNQVVEVNVKVEEPGKNNVHNNAFYAEEKLLKSELQAMRDCNPLSARHWIVRHTRNVNRTGQLTGYKLVPGSNCLPLAGSEAKFLRRAAFLKHNLWVTSYARDEMYPGGEFPNQNPRVGEGLATWVQQDRSLEEADIVLWYVFGVTHIPRLEDWPVMPVEHIGFTLMPHGFFNCSTAVDVPPNTCENDLKENEMSTKPIQTALVAKL

SEQ ID NO: 10084 - protein, 769 aa, Theobroma cacao
MASTQEKATPCCIPKTNDDVSKKTSSSSSSSSTEVLQNWSLAVGSGPVPSEDPIPKTASMATLIRPVEPISDPSAAKIATTKGISIMPRAQTSHPLDPLSAAEISVAVATVRAAGATPEVRDSMRFIEVVLVEPDKHVVALADAYFFPPFQPSLLPRTKGGPLIPSKLPPRQARLVVYNKRSNETSIWTVELSEVHAATRGGHHRGKVISSKVVPNVQPPMDAMEYAECEAVVKDFPPFREAMKKRGIEDMDLVMVDPWCVGYHSNADAPSRRLAKPLIFCRTESDCPMENGYARPVEGIHVLVDMQNMVVIEFEDRKLVPLPPADPLRNYTAGETRGGVDRSDVKPLQIIQPEGPSFRVNGKFIEWQKWNFRIGFTPREGLVIYSVAYVDGNRGRRPVAHRLSFVEMVVPYGDPNDPHYRKNAFDAGEDGLGKNAHSLKKGCDCLGYIKYFDAHFTNFTGGVETIENCVCLHEEDHGILWKHQDWRTGLAEVRRSRRLTVSFDGKIEAEVKLTGILSLGALQPGETRKYGTTIAPGLYAPVHQHFFVARMDMAVDCKPGEAFNQVVEVNLKVEEPGKDNVHNNAFYAEEELLRSELQAMRDCNPLSARHWIVRNTRNVNRTGQLTGFKLVPGSNCLPLAGSEAKFLRRAAFLKHNLWVTPYAREEMYPGGEFPNQNPRVGEGLATWVKKNRSLEEADIVLWYVFGVTHVPRLEDWPVMPVERIGFMLMPHGFFNCSPAVDVPPSATDLELKDNDIATKPIQNGIIAKL

SEQ ID NO: 10085 - protein, 793 aa, Nicotiana benthamiana
MATTKQKVTAPSPSPSPSSSTASCCPSTSILRREATAAISVVGDGLQNWTSNIPSVDDKQKKTASSALTSLPTNEPLSSNTSTKGIQIMTRAHTCHPLDPLSAAEISVAVATVRAAGETPEVRDGMRFIEVVLVEPDKSVVALADAYFFPPFQSSLMPRTKGGSHIPTKLPPRRARLIVYNKKTNETSIWIVELNEVHAAARGGHHRGKVISSNVVPDVQPPIDAQEYAECEAVVKSYPPFRDAMRRRGIDDLDLVMVDPWCVGYHSEADAPSRRLAKPLVFCRTESDCPMENGYARPVEGIYVLVDVQNMKIIEFEDRKLVPLPPVDPLRNYTAGETRGGVDRSDVKPLHVIQPEGPSFRISGNYVEWQKWNFRIGFTPREGLVIHSVAYLDGSRGRRQIAHRLSFVEMVVPYGDPNDPHYRKNAFDAGEDGLGKNAHSLKRGCDCLGYIKYFDAHFTNFTGGVETTENCVCLHEEDHGMLWKHQDWRTGLAEVRRSRRLTVSFVCTVANYEYAFYWHFYQDGKIEAEVKLTGILSLGALQPGEYRKYGTTILPGLYAPVHQHFFVARMNMAVDCKPGEAHNQVVEVNVKVEEPGKENVHNNAFYAEETLLRSELQAMRDCDPFSARHWIVRNTRTVNRTGQLTGYKLVPGPNCLPLAGPEAKFLRRAAFLKHNLWVTQYAPGEDFPGGEFPNQNPRVGEGLASWVKQDRPLEESDIVLWYIFGITHVPRLEDWPVMPVEHIGFVLQPHGFFNCSPAVDVPPPFACDSESTDSDVTETSVAKSTATSLLAKL

SEQ ID NO: 10086 - protein, 790 aa, Nicotiana tabacum
MATTKQKVTAPSPSPSSSTASCCPSTSILRREATAAIAVVGDGLQNWTNIPSVDEKQKKTASSALASLPTTEPLSTNTSTKGIQIMTRAQTCHPLDPLSAAEISVAVATVRAAGETPEVRDGMRFIEVVLVEPDKSVVALADAYFFPPFQSSLMPRTKGGSQIPTKLPPRRARLIVYNKKTNETSIWIVELNEVHAAARGGHHRGKVIASNVVPDVQPPIDAQEYAECEAVVKSYPPFRDAMRRRGIDDLDLVMVDPWCVGYHSEADAPSRRLAKPLVFCRTESDCPMENGYARPVEGIYVLVDVQNMKIIEFEDRKLVPLPPVDPLRNYTAGETRGGVDRSDVKPLHIIQPEGPSFRISGNYVEWQKWNFRIGFTPREGLVIHSVAYLDGSRGRRPIAHRLSFVEMVVPYGDPNDPHYRKNAFDAGEDGLGKNAHSLKRGCDCLGYIKYFDAHFTNFTGGVETTENCVCLHEEDHGMLWKHQDWRTGLAEVRRSRRLTVSFVCTVANYEYAFYWHFYQDGKIEAEVKLTGILSLGALQPGEYRKYGTTILPGLYAPVHQHFFVARMNMAVDCKPGEAHNQVVEVNVKVEEPGKENVHNNAFYAEETLLRSELQAMRDCDPFSARHWIVRNTRTVNRTGQLTGYKLVPGPNCLPLAGPEAKFLRRAAFLKHNLWVTQYAPGEDFPGGEFPNQNPRVGEGLASWVKQDRPLEESDIVLWYIFGITHVPRLEDWPVMPVEHIGFVLQPHGYFNCSPAVDVPPPFACDSESRDSDVTETSVAKSTATSLLAKL

SEQ ID NO: 10087 - protein, 309 aa, Trifolium pratense
MDAEEYAECEAVVKSFPPFIEAMKKRGIEDMDLVMVDPWCVGYHSEADAPGRRLAKPLLFCRSESDCPMENGYARPVEGIYVLVDMQNMKVIEFEDRKLVPLPPVDPLRNYTPGESRGGSDRSDVKPLQIIQPEGPSFRVNGYYVEWQKWNFRIGFTPKEGLVIYSVAYVDGSRGRRPVAHRLSFVEMVVPYGDPNEPHYRKNAFDAGEDGLGKNAHSLKKGCDCLGYIKYFDAHFTNFTGGVETIENCVCMHEEDHGILWKHQDWRTGLAEVRRSRRLSVSFVCTVANYEYAFFGTFIRMERLKLKSS

SEQ ID NO: 10088 - protein, 664 aa, Solanum phureja
MRFVEVVLVEPDKSVVALADAYFFPPFQPSLLPRTKGGPVIPSKLPPRKAKLIVYNKKSNETSIWIVELSQVHAVTRGGHHRGKVISSKVVPDIQPPMDAVEYAECEAVVKDFPPFRDAMKKRGIDDMDLVMVDAWCAGYFSEADAPNRRLGKPLIFCRTESDCPMENGYARPVEGIHIVVDMQNMVVIEFEDRKVVPLPPADPLRNYTAGETRGGVDRSDVKPLLIVQPEGPSFRVNGHFVEWQKWNFRIGFTPREGLVIYSVAYIDGSRGRRPVAHRLSFIEMVVPYGDPNEPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFYWHFYQDGKIEAEVKLTGILSLGALLPGEVRKYGTTIAPGLYAPVHQHFFVARMDMAVDCKSGESHNQVVEVNARVEPPGENNVHNNAFYAEERLLRTELEAMRDCNPLTARHWIIRNTRTVNRTGQLTGYKLVPGSNCLPLAGSEAKFLRRAAFLKHNLWVTPYSREEIFPGGEFPNQNPRVGEGLATWVQQNRSLEETQIVLWYIFGLIHVPRLEDWPVMPVEHIGFMLQPHGFFNCSPAVDVPPSMSDSDIKENGTVAKSCHNDAVMSKL

SEQ ID NO: 10089 - protein, 703 aa, Amorphophallus konjac
GIQMLTRAQTSHPLDPLSAAEIAVAVATVRAAGATPEVRDSMRFVEVVLLEPEKQVVALADAYFFPPFQPSLLPKTKGGPVIPSKLPPRRARLVVYNKRSNETSVWIVELSEVHATTRGGHHRGKVISSEVVPDVQPPMDAMEYAECEAVVKDFPPFMEAMRKRGIEDMDLVMVDTWCVGYHSEADAPSRRLAKPLIFCRTESDCPMENGYARPVEGIHVLVDMQNMVVIEFEDRKFVPLPPADPLRNYTSGETRGGVDRSDVKPLHIIQPEGPSFRVNGHFIEWQKWNFRIGFTPREGLVIYSVAYIDGSRGRRPVAHRLSVVEMVVPYGDPNEPHYRKNAFDAGEDGLGKNAHSLKKGCDCLGYIKYFDAHFPNFTGGVETIENCVCLHEEDHGILWKHQDWRTGLAEVRRSRRLTVSFICTVANYEYGFFWHFYQDGKIEAEVKLTGILSLGALQQGESRKYGTTIAPGLYAPVHQHFFVARMDMSVDCKPAEPFNQVVEVNVKVEDPGKNNIHNNAFYAEEQVLRSELQAMRDCNPSTARHWIIRNTRAVNRTGQLTGYKLVPGSNCLPLAGPDAKFLRRAAFLKHNLWVTPYKRNEMYPGGEFPNQNPRVNEGLATWVKQNRPLEETDTVLWYVFGITHIPRLEDWPVMPVDRIGFMLMPHGFFNSSPAVDVPPNSSEVDLKENGSPKPVQTGLLAKL

SEQ ID NO: 10090 - protein, 704 aa, Plantago ovata
MTRAQTRHPLDPLSAIEISMAVATVRAAGATPEVRDSMRFVEAVLEEPEKHIVALADAYFFPPFQPSLLPRTKAGPAIPSKLPPRRARLIVYNKRSNETSLWIVELTEVHATTRGGHHRGKVVSSSVIPDVQPPMDAVEYAECEAVVKDYLPFVEAMKKRGIDDMDLVMVDPWCVGYHSEADAPSRRLAKPLIFCRTESDCPLENGYARPVEGIHVLVDMQNMVVIEFEDRKLVPLPPADPLRNYTPAESRGGVDRSDVKPLQIVQPEGPSFRIRGNYVEWQKWNFRIGFTPREGLVIHSVAYVDGSRGRRPIAHRLSFVEMVVPYGDPNEPHYRKNAFDAGEDGLGKNAHSLKKGCDCLGYIKYFDAHFVNFTGGVETIENSVCLHEEDHGILWKHQDWRTGLAEVRRSRRLTVSFICTVANYEYGFYWHFYQDGKIEAEVKLTGILSLGALQSGEVRKYGTTIAPGLYAPVHQHFFVARMDMSVDCKPGEAHNQVVEVNVRVEEPGNDNIHNNAFYAEDTLLRSELEAMRDCDPFSARHWIIRNTRVVNRNGQLTGYKLVPGSNCLPLAGPEAKFMRRAAFLKHNLWVTAYARGEDFPGGEFPNQNPRAGEGLASWVKQNRSLEETDVVLWYVFGITHVPRLEDWPVMPVEHIGFVLQPFGFFNCSPAVDVPPNACEMEAKESDVKDGVVVKPISSTLIAKL

SEQ ID NO: 10091 - protein, 701 aa, Trigonella foenum-graecum
MMRAQTCHPLDPLSAAEISVAVATVRAAGATPEVRDSMRFVEVVLVEPVKQVVALADAYFFPPFQPSLLPRTKGGGPLIPTKLPTRKARLVVYNKKSNETSVWIVELREVHAATRGGHHRGKVISSHVVPNVQPPMDAVEYAECEAVVKDFPPFREAMKRRGIEDMDLVMVDAWCVGYHSETDAPNRRLAKPLFFCRTESDCPMENGYARPVEGIHVLVDMQNMVVLEFEDRKLVPLPQADPLRNYTSGETRGGVDRSDVKPLQIIQPEGPSFRVNGHFIQWQKWNFRIGFTPREGLVIYSVAYIDGSRGRRPVAHRLSFVEMVVPYGDPNDPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFFWHFYQDGKIEAEVKLTGILSLGALQPGEIRKYGTTIAPGLYAPVHQHFFVARMDMAVDCKPGEAFNQVVEVDVKVEDPGKNNVHNNAFYAEEKLLKSELEAMRDCNPLSARHWIVRNTRTVNRTGQLTGYRLVPGSNCLPLAGSEAKFMRRAAFLKHNLWVTPYVHNEMHPGGEFPNQNPRVGEGLATWVKQNRSLEEADIVLWYVFGVTHIPRLEDWPVMPVERIGFMLMPHGFFNCSPAVDVPPSAGDLDDKDNGLPAKPIQNELIAKL

SEQ ID NO: 10092 - protein, 1394 aa, Vitis vinifera
MATASKKATSCCIGDDSRSIRREAVAAAAAAPSVAAAAAAAVADVEQDWSGVGVVGDGKKAALASLIRPVEPIAGASANASVKGIQIMTRAQTCHPLDPLSATEISVAVATVRAAGATPEVRDGMRFVEVVLYEPDKHVVALADAYFFPPFQPSLLPRTKGGPVIPSKLPPRKARLIVYNKKSNETSIWIVELSEVHAATRGGHHRGKAITTQVVPDIQPPMDAVEYAECEAVVKDCPLFREAMKKRGVEDMDLVMVDAWCVGYHGEADAPSRRLAKPLIFCRTESDCPMENGYARPVEGIYVVVDMQNMVVIEFEDRKLVPLPPADPLRNYTPGETRGGVDRSDVKPLQIVQPEGPSFRVHGHYVEWQKWNFRIGFTPREGLVIHSVAYVDGSRGRRPVAHRLSFVEMVVPYGDPNEPHYRKNAFDAGEDGLGKNANSLKKGCDCLGFIKYFDAHFTNFTGGVETIENCVCLHEEDHGILWKHQDWRTGLAEVRRSRRLTASFICTVANYEYGFFWHFYQAIRNSFLLQDGRIEAEVKLTGILSLGALQPGESRKYGTTIAPGLYAPVHQHFFIARMDMAVDCKPGEAFNQVVEVNMKVENPGKDNVHNNAFYAEEKLLRSEMQAMRDCDPLSARHWIVRNTRTVNRTGQLTGYKLVPGSNCLPLAGSEAKFLRRAAFLKHNLWVTPYARDEMFPGGEFPNQNPRVGEGLATWVKQNRPLEETDIVLWYVFGLVHVPRLEDWPVMPVERIGFMLQPHGFFNCSPAVDVPPNAFAAIMGEVEEKTIQDELTVTIQLADRVIKSAEEAESSKAECSEIARQVERLSKMLRSAARLATSTQWLYERPVRRIAADVTKNLDRALTLVRKCKHSGVLRQVFSITTAADFRKVLALLESSIGDLKWLVTIVDPDDINLTLPPIANNDPTLAWVWSYIATIQMGQLRDRVEAANALVLLAHKNDRTKKIVVDEGGIMPLLKLLKEGASADAQIAAANALFHIGNEEERVRSIADAAGVPIIVQVLGESVMRVQVSVANLVARMAEMDSAVREAFARENVTRPLVSLLSVDTVLVLDDPKLKPSKPSISSLVQFNKELAGKSAGHNSYNPSLNSVSSFTSSGGHSSLSVHSSSEGSSRGGHNRKDREVETPELKLKLKVSCAEALWKLSKDSVLNSRKITETKGLICLAKIIEKEKGELQYNCLMAVMEIAMVAEQDADLRRAAFKTSSPAAKAVLDQLLRVIQEESSSTMKIPAIKSIGSLARTFPARETRIIGPLVAQLSNSDNEVAIEATIALGKFVHPENFNRVEHAKAIIEFDGVPPLLRLLRTSERANIYGLILLSYLALHVGNSKALEQAQALSVLDLAIRSGVPQDYKELFARAIHNLNLYQAGVHTHRPYPP

SEQ ID NO: 10093 - protein, 786 aa, Solanum phureja
MATTSKKVAKSFTDSCPSTSLLRREATAATAVVVDDGPQKWTVIPSTDDNKQKQTPSAIASLASNTEPLPSNTSTKGIQIMLKAQTCHPLDPLSAAEISVAVATVRAAGETPEVRDGMRFIEVVLLEPDKSVVALADAYFFPPFQSSLMPRNKGGSLIPTKLPPRRARLIVYNKKTNETSIWIVELTEVHAAARGGHHRGKVISSNSVPDVQPPIDAQEYAECEAVVKNYPPFREAMKRRGIDDMDLVMVDPWCVGYHSEADAPSRRLAKPLVFCRSESDCPMENGYARPVEGIHVLVDVQNMEIIEFEDRKLVPLPPVDPLRNYTAGETRGGVDRSDVKPLHIIQPEGPSFRISGNYVEWQKWNFRIGFTPREGLVIHSVAYLDGSRGRRPIAHRLSFVEMVVPYGDPNDPHYRKNAFDAGEDGLGKNAHSLKRGCDCLGYIKYFDSHFTNFTGGVETTENCVCLHEEDHGMLWKHQDWRTGLSEVRRSRRLTVSFVCTVANYEYAFYWHFYQDGKIEAEVKLTGILSLGALQPGESRKYGTTIAPGLYAPVHQHFFVARMNMAVDCKPGEAHNQVVEVNVKVEEPGKENVHNNAFYAEETLLRSELQAMRDCDPFSARHWIVRNTRTVNRTGQLTGYKLVPGPNCLPLAGPEAKFLRRAAFLKHNLWVTQYAPGEDFPGGEFPNQNPRAGEGLASWVKQDRPLEESDTVLWYIFGITHVPRLEDWPVMPVEHIGFMLQPHGFFNCSPAVDVPPPSGCDSESRDSEVTDNSSVAKHTTTGLMAKL

SEQ ID NO: 10094 - protein, 788 aa, Solanum lycopersicum
MATNSKKVTKSFTNSCPSTSLLLRRETTAATAVVVDDGPQKWTVIPSVDDNKQKKTSSSAIASLASNTEPLPSNTSTKGIQIMLRAQTCHPLDPLSAAEISVAVATVRAAGETPEVRDGMRFIEVVLLEPDKSVVALADAYFFPPFQSSLMPRTKGGSLIPTKLPPRRARLIVYNKKTNETSIWIVELTEVHAAARGGHHRGKVISSNVVPDVQPPIDAQEYAECEAVVKNYPPFREAMKRRDIDDMDLVMVDPWCVGYHSEADAPNRRLAKPLVFCRSESDCPMENGYARPVEGIHVLVDVQNMQIIEFEDRKLVPLPPVDPLRNYTAGETRGGVDRSDVKPLHIIQPEGPSFRISGNYVEWQKWNFRIGFTPREGLVIHSVAYLDGSRGRRPIAHRLSFVEMVVPYGDPNDPHYRKNAFDAGEDGLGKNAHSLKRGCDCLGYIKYFDAHFTNFTGGVETTENCVCLHEEDHGMLWKHQDWRSGLAEVRRSRRLTVSFVCTVANYEYAFYWHFYQDGKIEAEVKLTGILSLGALQPGEYRKYGTTIAPGLYAPVHQHFFVARMNMAVDCKPGEAHNQVVEVNVKVEEPGKENVHNNAFYAEETLLRSELQAMRDCDPFSARHWIVRNTRTVNRTGQLTGYKLVPGPNCLPLAGPEAKFMRRAAFLKHNLWVTQYAPGEDFPGGEFPNQNPRAGEGLASWVKQDRPLEESDTVLWYIFGITHVPRLEDWPVMPVEHIGFMLQPHGFFNCSPAVDVPPPSGCDSETRDSDVTESTSVAKHTTTGLMAKL

SEQ ID NO: 10095 - protein, 776 aa, Nicotiana tabacum
ITLGIFIPFAMAATLHKVTPTTASASASIARRESAAASVLVDDQQKQTPALTSLLNSQPPSSNPSSKGKQIMPRAHTCHPLDPLSAAEISVAVATVRAAGETPEVRDGMRFIEVVLLEPDKSVVALADAYFFPPFQSSLMSRRKGGLPIPTKLPPRRARLIAYNKKTNETSIWIVELAEVHAAARGGHHKGKVISSNVVPDVQPPIDAQEYADCEAVVKNYPPFREAMKRRGIDDMDVVMVDPWCVGYHSEADAPSRRLAKPLVFCRTESDCPMENGYARPVEGIYALVDVQNMQVIEFEDRKLVPLPPADPLRNYTAGETRGGVDRSDVKPLQIIQPEGPSFRVNGNYVEWQKWNFRVGFTPREGLVIHSVAYLDGSRGRRPIAHRLSFVEMVVPYGDPNDPHYRKNAFDAGEDGLGKNAHSLKRGCDCLGYIKYFDANFANFTGGVETTENCVCLHEEDHGMLWKHQDWRTGLAEVRRSRRLTVSFICTVANYEYGFYWHLYQDGKIEAEVKLTGILSLGALPPGESRKYGTTIAPGLYAPVHQHFFVARMNMAVDCKPGEAHNQVVEVNVRVEEPGKENVHNNAFYAKETVLTSELQAMRDCDTLSARHWIVRNTRTSNRTGQLTGYKLVPGPSCLPLAGPEAKFLRRAAFLKHNLWVTQYAPGEDFPGGEFPNQNPRVGEGLASWVKQDRSLEESDVVLWYVFGITHVPRLEDWPVMPVEHIGFMLQPHGFFNCSPAVDVPPPRGCDLEIKDSDGSENGVAKPTPSSLMAKL

SEQ ID NO: 10096 - protein, 776 aa, Solanum lycopersicum
MASAQEKTTVSAPSRNASAASETEWNAGGTVTDVSDLSSTRSASSAAPSTLTAVIDSIDRPSAQNQQPAVKGLPTLLRAQTHHPLDPLTAAEISVAVATVRAAGSTPEVRDSMRFVEVVLVEPDKSVVALADAYFFPPFQPSLLPRTKGGPVIPSKLPPRKAKLIVYNKKSNETSIWIVELSQVHAVTRGGHHRGKVISSKVVPDIQPPMDAVEYAECEAVVKDFPPFRDAMKKRGIDDMDLVMVDAWCAGYFSDADAPNRRLGKPLIFCRTESDCPMENGYARPVEGIHIVVDMQNMVVIEFEDRKVVPLPPADPLRNYTAGETRGGVDRSDVKPLLIVQPEGPSFRVNGHFVEWQKWNFRIGFTPREGLVIYSVAYIDGSRGRRPVAHRLSFIEMVVPYGDPNEPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFYWHFYQDGKIEAEVKLTGILSLGALLPGEVRKYGTTIAPGLYAPVHQHFFVARMDMAVDCKSGESHNQVVEVNARVEPPGENNVHNNAFYAEERLLRTELEAMRDCNPLTARHWIIRNTRTVNRTGQLTGYKLVPGSNCLPLAGSEAKFLRRAAFLKHNLWVTPYSREEMFPGGEFPNQNPRVGEGLATWVQQNRSLEETQIVLWYIFGLIHVPRLEDWPVMPVEHIGFMLQPHGFFNCSPAVDVPPSMSDSDIKENGTVAKSCHNDGVMSKL

SEQ ID NO: 10097 - protein, 309 aa, Trifolium pratense
MDAEEYAECEAVVKSFPPFIDAMKKRGIEDMDLVMVDPWCVGYHSEADAPGQRLAKPLLFCRSESDCPMENGYARPVEGIYVLVDMQNMKVIEFEDRKLVPLPPVDPLRNYTPGESRGGSDRSDVKPLQIIQPEGPSFRVNGYYVEWQKWNFRIGFTPKEGLIIYSVAYVDGSRGRRPVAHRLSFVEMVVPYGDPNEPHYRKNAFDAGEDGLGKNAHSLKKGCDCLGYIKYFDAHFTNFTGGVETIENCVCMHEEDHGILWKHQDWRTGLAEVRRSRRLSVSFVCTVANYEYAFFGIFIRMERLKPKSS

SEQ ID NO: 10098 - protein, 570 aa, Trigonella foenum-graecum
MDAEEYAECEAVVKSFPPFIEAMKKRGIEDMDLVMVDPWCVGYHSESDAPGKRLAKPLLFCRSESDCPMENGYARPVEGIYVLVDMQNMVVIEFEDRKLVPLPPVDPLRNYTPGETRGGSDRSDVKPLQIIQPEGPSFRVNGYYVEWQKWNFRIGFTPKEGLIIYSVAYVDGSRGRRPVAHRLSFVEMVVPYGDPNEPHYRKNAFDAGEDGLGKNAHSLKKGCDCLGYIKYFDAHFTNFTGGVETIENCVCLHEEDHGILWKHQDWRTGLAEVRRSRRLSVSFVCTVANYEYAFFWHFYQDGKIEAEVKLTGILSLGALMPGEFRKYGTMIAPGLYAPVHQHFFVARMDMSVDSRPGEALNQVVEVNMKVEEPGANNIHNNAFYAQETLLRSEMEAMRDCNPLTARHWIVRNTRTGNRTGQLTGYKLVPGSNCLPLAGSEAKFLRRAAFLKHNVWVTAYSRDEMFPGGEFPNQNPRVGEGLATWIKQNRSLEETNIVLWYVFGITHVPRLEDWPVMPVEHIGFMLMPHGFFNCSPAVDVPPNSCEVESKDSEIKDNGSSKPIQSGLASKL

SEQ ID NO: 10099 - protein, 700 aa, Quercus alba
MVRAQTSHPLDPLSAAEISVAVATVRAAGATPEVRDSMRFVEVALVEPAKSVVALADAYFFPPFQPSLLPKAKGGPVIPSKLPPRQARLVVYNKKSNETSVWIVELSEVHAATRGGHHRGKVISSKVVPDVQPPMDAVEYAECEAVVKDFPPFREAMKRRGIEDMDLVMVDAWCAGYHSDADAPSRRLAKPLIFCRTESDCPMENGYARPVEGIHVLVDMQNMVLIEFEDRKLVPLPPADPLRNYTPGETRGGVDRSDVKPLQIIQPEGPSFRVNGNFVQWQKWNFRVGFTPREGLIIYSVAYIDGSRGRRPVAHRLSFVEMVVPYGDPNEPHYRKNAFDAGEDGLGKNAHSLKKGCDCLGYVKYFDAHFTNFNGGVDTIENCVCLHEEDHGLLWKHHDWRTGLAEVRRSRRLTVSFICTVANYEYGFFWHFYQDGKIEAEVKLTGILSLGALQQGEARKYGTTIAPGLYAPVHQHFFVARMDMAVDCKPGEAFNQVVEVNLKVEEPGKDNVHNNAFYAEEELLRSEMQAMRDCNPLSARHWIIRNTRNVNRTGQLTGYKLVPGSNCLPLAGSEAKFLRRATFLKHNLWVTPYARDEKYPGGEFPNQNPRVGEGLATWVNQNRSLEEADIVLWYVFGMTHIPRLEDWPVMPVERLGFMLMPHGFFNCSPAVDVPPNTSDVEIKDNGMAVKPIQNELLAKL

SEQ ID NO: 10100 - protein, 700 aa, Quercus alba
MVRAQTSHPLDPLSAAEISVAVATVRAAGATPEVRDSMRFVEVALVEPAKSVVALADAYFFPPFQPSLLPKAKGGPVIPSKLPPRQARLVVYNKKSNETSVWIVELSEVHAATRGGHHRGKVILSNVVPDVQPPMDAVEYAECEAVVKDFPPFREAMKRRGIEDMDLVMVDAWCVGYHSDADAPSRRLAKPLIFCRTESDCPMENGYARPVEGIHVLVDMQNMVLIEFEDRKLVPLPPADPLRNYTPGETRGGVDRSDVKPLQIIQPEGPSFRVNGNFVQWQKWNFRVGFTPREGLIIYSVAYIDGSRGRRPVAHRLSFVEMVVPYGDPNEPHYRKNAFDAGEDGLGKNAHSLKKGCDCLGYVKYFDAHFTNFNGGVDTIENCVCLHEEDHGLLWKHHDWRTGLAEVRRSRRLTVSFICTVANYEYGFFWHFYQDGKIEAEVKLTGILSLGALQQGEARKYGTTIAPGLYAPVHQHFFVARMDMAVDCKPGEAFNQVVEVNLKVEEPGKDNVHNNAFYAEEELLRSEMQAMRDCNPLSARHWIIRNTRNVNRTGQLTGYKLVPGSNCLPLAGSEAKFLRRATFLKHNLWVTPYARDEKYPGGEFPNQNPRVGEGLATWVNQNRSLEEADIVLWYVFGMTHIPRLEDWPVMPVERLGFMLMPHGFFNCSPAVDVPPNTSDVEIKDNGMAVKPIQNELLAKL

SEQ ID NO: 10101 - protein, 776 aa, Capsicum annuum
MASITEKTTVRNASSAASETTEWTGGTVADVSDISATRSAKVKATAASTAAPSTNLTAVIDSIDRPSTQKPPAVKGLPILLRAQTHHPLDPLTAAEISVAVATVRAAGSTPEVRDSMRFVEAVLVEPERSVVALADAYFFPPFQPSLLPRTKGGPVIPSKLPPRQAKLIVYNKKSNETSIWIVELSEVHAVTRGGHHRGKVISSKVVPDIQPPMDAVEYAECEAVVKDFPPFRDAMKKRGIDDMDLVMVDAWCAGYFSEADAPNRRLGKPLIFCRTESDCPMENGYARPVEGIHILVDMQNMVVIEFEDRKLVPLPPADPLRNYTPGETRGGVDRSDVKPLRISQPEGPSFRVNGHFVEWQKWNFRIGFTPREGLVIHSVAYIDGSRGRRPVAHRLSFIEMVVPYGDPNEPHYRKNAFDAGEDGLGKNAHSLKKGCDCLGYIKYFDAHFTNFTGVVETIENCVCLHEEDHGILWKHQDWRTGLAEVRRSRRLTVSFICTVANYEYGFYWHFYQDGKIEAEVKLTGVLSLGALLPGEVRKYGTTIAPGLYAPVHQHFFVARMDMAVDCKAGESHNQVVEVNARVEPPGENNVHNNAFYAEERLLRTELEAMRDCNPLTARHWIIRNTRTVNRTGQLTGYKLVPGSNCLPLAGSEAKFLRRAAFLKHNLWVTPYSRDEMFPGGEFPNQNPRVGEGLATWVQQNRSLEETQIVLWYNFGLIHVPRLEDWPVMPVEHIGFMLQPHGFFNCSPAVDVPPSIAYLDKENGKSCHSDGIMAKL

SEQ ID NO: 10102 - protein, 327 aa, Capsicum annuum
MASITEKTTVRNASSAASETTEWTGGTVADVSDISATRSAKVKATAASTAAPSTNLTAVIDSIDRPSTQKPPAVKGLPILLRAQTHHPLDPLTAAEISVAVATVRAAGSTPEVRDSMRFVEAVLVEPERSVVALADAYFFPPFQPSLLPRTKGGPVIPSKLPPRQAKLIVYNKKSNETSIWIVELSEVHAVTRGGHHRGKVISSKVVPDIQPPMDAVEYAECEAVVKDFPPFRDAMKKRGIDDMDLVMVDAWCAGYFSEADAPNRRLGKPLIFCRTESDCPMENGYARPVEGIHILVDMQNMVVIEFEDRKLVPLPPADPLRNYTPG

SEQ ID NO: 10103 - protein, 747 aa, Cicer arietinum
MATVEEKTTPPCCSLQNNNKSAAAASSTVDSRSDPPPKSPSAKGITVMAKAQTCHPLDPLSAAEISVAVATVRAAGATPEVRDSMRFIEVDMVEPEKHVVALADAYFFPPFQPSLLPRTKGGPVIPSKLPPRKARLVVYNKKSNETSIWIVELTEVHATTRGGHHRGKVISSTIVPDVQPPMDAVEYAECEAVVKNYPPFQEAMKKRGIEDMDLVMVDPWCAGYDSEADAPSRRLAKPLFFCRTESDCPMENGYARPVEGIHVLVDMQNMVVLEFEDRKLVPLPPADPLRNYTSGETRGGVDRSDVKPLQIIQPDGPSFRVNGHFIQWQKWNFRIGFTPREGLIIYSVAYIDGSRGRRPVAHRLSFVEMVVPYGDPNDPHYRKNAFDAGEDGLGKNAHSLKKGCDCLGYIKYFDAHFTNFYGSVETIENCVCLHEEDHGMLWKHQDWRTGLAEVRRSRRLTVSFICTVANYEYGFYWHFYQDGKIEAEVKLTGILSLGALQQGETRKYGTTIAPGLYAPVHQHFFVARMDMAVDCKPGEAFNQVVEVNVKIEEPGKNNVHNNAFYAEEKPLKSELEAMRDCDPLSARHWIVRNTRSVNRTGYLTGYKLVPGANCLPLAGSEAKFLRRAAFLKHNLWVTPYARGEMYPGGEFPNQNPRDGEGLATWVKQNRPLEEADVVLWYVFGVTHIPRLEDWPVMPVEHIGFMLMPHGFFNCSPAVDVPPSPSDLDDKENGMPAKPSQNGLIAKL

SEQ ID NO: 10104 - protein, 782 aa, Sorghum bicolor
MAAAKEKASACCSRDAPARVAGGAPVVPMRAIAASPVGKVVALAAGGGERVAASAAGASGAVIEEIAAVQPTTAKASSKGIPIMTRAQRCHPLDPLSAAEIAVAVATVRAAGRSPEERDSMRFVEVVLLEPEKNVVALADAYFFPPFQPSLLPRSKGSAVIPSRLPPRRARLVVYNKQSNETSIWIVELSEVHAATRGGHHRGKVISSEVVPDVQPAMDAMEYAECEATVKSYPPFIEAMKRRGVDDMDLVMVDAWCAGYYSEADAPSRRLGKPLIFCRTESDSPMENGYARPVEGIHVVVDMQNNAVIEFEDRKLVPLPPPDHLRNYTPGETRGGVDRSDVKPLIINQPEGPSFRINGYFVEWQKWNFRIGFTPKEGLVIYSVAYVDGSRGRRPIAHRLSFVEMVVPYGDPSEPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFYWHFYQDGKIEAEVKLTGILSLGALMPGESRKYGTTIAPGLYAPVHQHFFVARMDMAVDCKPNEAHNQVVEVNVKVESAGTHNVHNNAFYAEEKLLKSELQAMRDCDPSSARHWIVRNTRTVNRTGQPTGYRLVPGSNCLPLALPEAKFLRRAGFLKHNLWVTQYKRDEMFPGGEFPNQNPRIHEGLPTWVKKDRPLEETDIVLWYVFGLTHIPRLEDWPVMPVEHIGFMLMPHGFFNCSPAVDVPPSSSDADVKEAESPKAIQNGLVSKL

SEQ ID NO: 10105 - protein, 771 aa, Musa acuminata
MAATQEKATPAHASVGVAGAKAGGVPGPVQEWVTAAVEKQASAPPVEAVSPLIAPVEDVQDPPAKPSSKGIPVMMRAQTSHPLDPLSSAEISVAVATVRAAGATPEVRDGMRFIEVVLLEPEKNIVALADAYFFPPFQPSLLPRTKGGPVIPSKLPPRRARLVVYNKRSNETSIWIVELSEVHAATRGGHHRGKVISSEVVHDVQPSMDAMEYAECEAAVKNYPAFIEAMRKRGVEDMDLVMVDAWCVGYYSDADGPSRRLAKPLIFCRTESDCPMENGYARPVEGIHVLVDIQNNVIIEFEDRKLVPLPPADPLRNYTAGEMRGGIDRSDVKPLHILQPEGPSFRVNGYFVQWQKWNFRIGFTPREGLVIHSVAYIDGSRGRRPIAHRLSFVEMVVPYGDPNEPHYRKNAFDAGEDGLGKNAHSLKKGCDCLGYIKYFDAHFTNYTGGVETIENCVCLHEEDHGILWKHQDWRTGLAEVRRSRRLSVSFICTVANYEYGFFWHFYQDGKIEAEVKLTGILSLGALQPGESRKFGTTIAPGLYAPVHQHFFVARMNMAVDCKPNEAFNQVVEVNVKVEEPGKDNIHNNAFYAEEKLLRSELQAMRDCQPLSARHWIVRNTRTVNRTGQPAGYKLMPGSNCLPLAGPEAKFLRRAAFLKHNLWVTSYKHDEMYPGGEFPNQNPRINEGLATWVRKNRSLEETDIVLWYVFGITHIPRLEDWPVMPVEHIGFMLMPHGFFNCSPAVDVPPSPNEADKECGAPKLMHNGLVAKL

SEQ ID NO: 10106 - protein, 718 aa, Mimulus guttatus
MPRAQTKHPLDPLSATEISVAVATVRAAGATPEVRDSMRFVEVVLLEPEKQVVALADAYFFPPFQPSLLPRTKGGPAIPSKLPPRRARLIVYNKKSNETSLWVVELTEVHATTRSGLHRGKVISSKVVPDVQPPMDAVEYAECEAVVKDYPPFIEAMRKRGIDDMDLVMVDPWCVGYHSEADAPSRRLAKPLLFCRIESDCPLENGYARPVEGIHVLVDMQNMVVIEFEDRKIVPLPPADPLRNYTSGETRGGVDRSDVKPLQIIQPEGPSFRIKGQYVEWQKWNFRIGFTPREGLVIHSVAYVDGSRGRRPIAHRLSFVEMVVPYGDPNDPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFYWHFYQASGMHSLLGACDGKIEAEVKLTGILSLGSLQPGEFRKYGTTIAPGLYAPVHQHFFVARMDMAVDCKPGEMHNQVVEVNVRVEEPGEENVHNNAFYAEETLLRSELEAMRDCDPLSARHWIIRNTRTVNRSGELTGYKLVPGSNCLPLAGPEAKFLRRAAFLKHNLWVTQYAPGEDFPGGEFPNQNPRVGEGLVSWVKQNRPLEETDVVLWYVFGITHVPRLEDWPVMPVEHIGFVLQPHGFFNCSPAVDVPPSACELEAKENDVKDSAAANKASSSSGLVMAKL

SEQ ID NO: 10107 - protein, 374 aa, Tropaeolum majus
MVVPYGDPNDPHYRKNAFDAGEDGLGKNAHSLKKGCDCLGDIKYFDAHFTNFTGGVETVENCVCMHEEDHGLLWKHQDWRTGLAEVRRSRRLTVSFVCTVANYEYGFFWHFYQDGKIEAEVKLTGILSLGALQPGETRKYGTLIAPGLYAPVHQHFFVARMDMAVDCRPGEALNQVVEINAKVEEPGENNIHHNAFYAEETLLRSELEAMRDCNPQSARSWIVRSTRAVNRTGQWTGYKLAPGSNCLPLARPEAKFLRRAAFLKHNLWVTAYKRDEKYPGGEFPNQNPRVGEGLASWVKQNRSIEEANIVLWYVFGITHVPRLEDWPVMPVEHIGFTLEPCGFFNCSPAVDVPPSACELDTKEKPVQNVLLAKL

SEQ ID NO: 10108 - protein, 705 aa, Trifolium pratense
SSNVSQQKQQPPFISAVDSRLDPPPKSASSKGITVMAKAQTLHPLDPLTAAEISVAVATVRAAGATPEVRDSMRFIEVDLVEPEKQVVALADAYFFPPFQPSLLPRTKGGPVIPSKLPPRKARLVVYNKKSNETSIWIVELTEVHATTRGGHHRGKVISSTIVPDVQPPMDAVEYAECEAVVKDYPPFREAMKKRGIEDMDLVMVDPWCAGYHSEGDAPSRRLAKPLFFCRTESDCPMENGYARPVEGIHVLVDMQNMVVLEFEDRKLVPLPQADPLRNYTSGETRGGVDRSDVKPLQIIQPDGPSFRVNGNFVQWQKWNFRIGFTPREGLVVYSVAYIDGSRGRRPVAHRLSFVEMVVPYGDPNDPHYRKNAFDAGEDGLGKNAHSLKKGCDCLGYIKYFDAHFTNFYGSVETIENCVCMHEEDHGMLWKHQDWRTGLAEVRRSRRLTVSFICTVANYEYGFYWHFYQDGKIEAEVKLTGILSLGALQQGETRKYGTTIAPGLYAPVHQHFFVARMDMAVDCKPGEAFNQVVEVNVKVEEPGKNNVHNNAFYAEEKLLKSELEAMRDCDPLSARHWIVRNTRSVNRTGHLTGYKLVPGSNCLPLAGSEAKFLRRAAFLKHNLWVTPYARDELHPGGEFPNQNPRVGEGLATWVKQNRPLEEADIVLWYVFGVTHIPRLEDWPVMPVEHIGFMLMPHGFFNCSPA

SEQ ID NO: 10109 - protein, 740 aa, Trifolium pratense
MATTQEKTTPDPSLDPTRNTTSLDSFPPKTTPTSKGFPVMMRVQTHHPLDPLSAAEISVAVATVRAAGATPEVRDSMRFVEVVLVEPVKQVVALADAYFFPPFQPSLLPRTKGGGPLIPTKLPTRKARLVVYNKRSNETSLWIVELREVHAATRGGPHRGKVISSQVVPNVQPPMDAMEYAECEAVVKDFPPFREAMKRRGIEDMDLVMVDAWCVGYHSEADAPNRRLAKPLIFCRSESDCPMENGYARPVEGIYILVDMQNMVVLEFEDRKLIPLPPTDPLRNYTSGETRGGVDRSDVKPLQIIQPEGPSFRVNGHFIQWQKWNFRIGFTPREGLVIYSVAYIDGSRGRRPVAHRLSFVEMVVPYGDPNDPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFFWHFYQDGKIEAEVKLTGILSLGAMQPGETRKYGTTIAPGLYAPVHQHFFVARMDMAVDCKPGEAFNQVVEVDVKVEDPGKNNVHNNAFYAEEKLLKSELEAMRDCNPLSARHWIVRNTRMVNRTGQLTGYRLVPGSNCLPLAGSEAKFLRRAAFLKHNLWVTPYVHNEMHPGGEFPNQNPRVGDGLATWVKQNRSLEEADIVLWYVFGVTHIPRLEDWPVMPVERIGFMLMPHGFFNCSPAVDVPPSAGDLDDKEIGMPAKPIQNELIAKL

SEQ ID NO: 10110 - protein, 755 aa, Phaseolus vulgaris
MATAQEKTTPCCATGTTKPSSSAPPQQQQRPSVATFIPAINPPPKTASAKGISVMVRAQTSHPLDPLSAAEISVAVATVRAAGATPEVRDGMRFIEVDLVEPEKQVVALADAYFFPPFQPSLLPRTKGGPVIPTKLPLRKARLVVYNKKSNETSIWIVELREVHAATRGGHHRGKVVSSTVVPDVQPPMDAVEYAECEAIVKDFPPFREAMKKRGIEDMDLLMVDPWCAGYHSEVDAPSRRLAKPLIFCRTESDCPMENGYARPVEGIHVLVDMQNMVVLEFEDRKLVPLPPADPLRNYTSGETRGGVDRSDVKPLQIIQPEGPSFRVNGRFIEWQKWNFRIGFTPREGLVIHSVAYIDGSRGRRPVAHRLSFVEMVVPYGDPNDPHYRKNAFDAGEDGLGKNAHSLKKGCDCLGYIKYFDAHFTNFYGGVETIENCVCLHEEDHGILWKHQDWRTGLAEVRRSRRLTVSFVCTVANYEYGFFWHFYQDGKIEAEVKLTGILSLGALRPGETRKYGTTIAPGLYAPVHQHFFVARMDMAVDCKPGEAFNQVVEVNVKIEEPGDNNVHNNAFYAEEKLLKSELEAMRDCDPLSARHWIVRNTRTVNRTGHLTGYKLVPGSNCLPLAGSEAKFLRRAAFLKHNLWVTPYARDEMHPGGEFPNQNPRVGEGLATWVKQNRSLEEADIVLWYVFGVTHIPRLEDWPVMPVEHIGFMLMPHGFFNCSPAIDVPPNPGDLDDKENNGLPTKPNQNGLIAKL

SEQ ID NO: 10111 - protein, 696 aa, Fragaria vesca
MVRAQSRHPLEPLCPAEISVAVATVRAAGATPEVRDGMRFAEVVLLEPDKHVVALADAYFFPPFQPSLLPRTKGGHMIPSKLPPRRARLVVYNKMSNETSTWIVELSEVHAATRGGHHRGNVISSQVIHDVQPSMDAVEYAECEAVVKDFPPFREAMKKRGIEDMDLVMVDAWCVGYHSEADAPSKRLAKPLIFCRTESDCPMENGYARPVEGIYILVDMQNMEVIEFEDRKLVPLPPADPLRNYTCAETRGGVDRSDLKPLKIVQAEGPSFRVDGYFVEWQKWNFRVGFTPKEGLVVYSIAYDDGSRGRRPVAHRLSFVEMVVPYGDPNDPHYRKNAFDAGEDGLGKNAHSLRKGCDCSGYVKYFDAHFTNFTGGVETIENCVCLHEEDHGMLWKHQDWRTGFAEVRRSRRLTVSFLCTVANYEYGFFWHFYQDGKIEAEVKLTGILSLGALQPGEVRKYGTVIAPGLYAPVHQHFFVARMDMAVDCKPGEAYNQVVEVDVKVEDPGENNVHSNAFYAEERLLRTESEAMRDCNALSARHWIVRNTRTVNRTGQLTGYKLVPGSNCLPLAGSEAKFLRRAAFLKHNLWVTQYSPDEMFPGGEFPNQNPRVGEGLATWVQKNRSLEETDIVLWYVFGITHVPRLEDWPVMPVEHIGFKLVPHGFFNCSPAVDVPPSACESKAKEDDVKDNGLMAKL

SEQ ID NO: 10112 - protein, 774 aa, Phalaenopsis aphrodite
MAAAEEKATPRFPSAEAVSGGTVRGKAAGVGAAAGWVAEDAAGGGGGTKTMNAGVLIRPVDDLPDPPAKPSTKGIQVMPRAQSSHPLDPLSAAEISVAVATVRAAGRTPEVRDSMRFVEVVLLEPEKSVVALADAYYFPPFQPSLLPRTKGGPVIPSKLPPRRARLVVYNKKSNETGIWIVELTEVHAATRGGHHRGKVISSDVVPDVQPPMDAMEYAECEATVKDFLPFREAMRKRGIEDMDLVMVDAWCVGYYGEADAPSRRLAKPLIFCRTESDCPMENGYARPVEGIHIVVDIQNMVIIEFEDRKLVPLPPADPLRNYTPGETRGGVDRSDLKPLHIHQPEGPSFRVNGYFVEWQKWNFRIGFTPREGLVIHSVAYIDGSRGRRSIAHRLSFVEMVVPYGDPNEPHYRKNAFDAGEDGLGKNAHSLKKGCDCLGYIKYFDAHFTNYTGGVETIEQCVCLHEEDHGVLWKHQDWRTGLAEVRRSRRLSVSFICTVANYEYGFFWYFYQDGKIEAEVKLTGVLSLGALLPGESRKYGTTIAPGLYAPVHQHFFVARMDMAVDCKPNETFNQVVEVNLKVEEPGKNNVHNNAFYAEETVLRTELQAMRDCNPLSARHWIVRNTRTVNRTGQFTGYKLLPGSNCLPLAGPEAKFLRRAAFLKHNLWVTSYSRDETFPGGEFPNQNPRINEGLATWVKKNRSLEETDIVLWYVFGITHIPRLEDWPVMPVDRLGFTLMPHGFFNCSPAVDVPPSDIELKENAISKPIHNGLLSKM

SEQ ID NO: 10113 - protein, 780 aa, Zea mays
MAAAKEKASVCCRDAPARVAGAPVVPMRAIAASPVGKVVALAAGGGERVSASAAGSSGAVIEEIAAVQPTTAKASSKGIPIMTRAQRCHPLDPLSAAEIAVAVATVRVAGRSPEERDSMRFVEAVLLEPEKNVVALADAYFFPPFQPSLLPRSKGSAVIPSRLPPRRARLVVYNKQSNETSIWIVELSEVHAATRGGHHRGKVISSEVIPDVQPAMDAMEYAECEATVKSYPPFIEAMKRRGVDDMDLVMVDAWCAGYYSEADAPSRRLGKPLIFCRTESDSPMENGYARPVEGIHVVVDMQNNAVIEFEDRKLVPLPPPDHLRNYTPGETRGGVDRSDVKPLIINQPEGPSFRINGYFVEWQKWNFRIGFTPKEGLVIYSVAYVDGSRGRRPIAHRLSFVEMVVPYGDPSEPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFYWHFYQDGKIEAEVKLTGILSLGALMPGESRKYGTTIAPGLYAPVHQHFFVARMDMAVDCKPNEAHNQVVEVNVKVESAGTHNVHNNAFYAEEKLLKSELQAMRDCDPSSARHWIVRNTRTVNRTGQPTGYRLVPGSNCLPLALPEAKFLRRAGFLKHNLWVTQYKRGEMFPGGEFPNQNPRIHEGLPTWVKNDRPLEETDIVLWYVFGLTHIPRLEDWPVMPVEHIGFMLMPHGFFNCSPAVDVPPSSSDADVKEAESPKAIQNSLISKL

SEQ ID NO: 10114 - protein, 618 aa, Brassica rapa
MASASKTASVCAHGGGGFAPSPKLVSAVANTRSVGSSESDDRRDSKVAVDSVVRPVDSMPDTAKKPANKGISVMPMPRTETKHPLDPLSAAEISVAVATVRAAGANPEVRDSMRFIEVASVEPEKNVVALADAYFFPPFQPSLLPRTKAGPVIPMRLPPRRAKLVVYNKKSNETSVWIVELSEVHAVTRGGHHRGRVVSSEVIPDVQPPMDAAEYAECEAIVKDFPPFIEAMKRRGIDDMDLVMVDPWCVGYHSEADAPSRRLAKPLIYCRTDSDSPMENGYARPVEGIYVLVDMQNMVVIEFEDRKFVPLPPPDPLRNYTPGESRGGVDRSDVKPLQIIQPEGPSFRVRGYFVEWQKWNFRIGFTPREGLVIHSVAYVDGSRGRRPVAHRLSFVEMVVPYGDPNEPHYRKNAFDAGEDGLGKNAHSLKKGCDCLGTIKYFDAHFTNFTGGVETIENCVCLHEEDHGILWKHQDWRTGLAEVRRSRRLTVSFLCTVANYEYGFYWHFYQDGKIEAEVKLTGILSLGALQPGETRKYGTTIAPGLYAPVHQHFFIARMDMSVDCKPGEAFNQVVEVNVRVDEQVRTISTTMRFMRKRSYLDPRQRRCVTVTLLVLATGL

SEQ ID NO: 10115 - protein, 770 aa, Echinacea purpurea
MASTSENPPPLLRREATSDVVQDWTTDPSVGDQIRHRGTAASVDNSTRPVVVAQTSAATAAAKGPGPTSMVKAQTRHPLDPLAAAEISIAVATVRAAGATPEVRDSMRFIEVVLVEPSKSVVALADAYLFPPFQPSLLPRTKGGPIIPTKLPPRQARLIVYNKISNETSIWIVELSEVHALTRGGHHRGKVISSKVVPDVQPPMDAVEYAECEAVVKDFPPFREAMKRRGIEDMDLVMVDPWCVGYHSKADAPNRRLAKPLIFCRTESDCPMENGYARPVEGIDVLVDMQNMVVIEFKDRKLIPLPPADPLRNYTAGETRGGVDRSDVKPLNIVQPDGPSFRVNGHFVQWQKWNFRIGFTPREGLVIHSVAYVDGNRGRRPVAHRLSFVEMVVPYGDPNDPHYRKNAFDAGEDGLGKNAHSLKKGCDCLGYVKYFDAHLTNFTGGVETIEDCVCLHEEDDGILWKHQDWRTGLAEVRRSRRLVVSFICTVANYEYGFYWYFYQDGKIEAEVKLTGILSLGALQPGETRKYGTTIAPGLYAPVHQHFFVARMDVSVDCKPGESHNQVVEVDVKVEEPGDANLHNNAFYAEEKLLKTELEAMRDCNPSSARHWIIRNTRTVNRTGQLTGYKLVPGSNCLPLAGTEAKFLRRAAFLIHNLWVTQYDPEEMFPGGEFPNQNPRVGEGLATWVKKNRSLEETDLVLWYVFGVTHVPRLEDWPVMPVEHIGFRLMPHGFFNCSPAIDVPPSSLADMEMKENGVVDKSCHNGLVSKM

SEQ ID NO: 10116 - protein, 740 aa, Trifolium pratense
MATTQEKTTPDPSLDPTRNTTSLDSFPPKTTPTSKGFPVMMRVQTHHPLDPLSAAEISVAVATVRAAGATPEVRDSMRFVEVVLVEPVKQVVALADAYFFPPFQPSLLPRTKGGGPLIPTKLPTRKARLVVYNKRSNETSLWIVELREVHAATRGGPHRGKVISSQVVPNVQPPMDAMEYAECEAVVKDFPPFREAMKRRGIEDMDLVMVDAWCVGYHSEADAPNRRLAKPLIFCRSESDCPMENGYARPVEGIYILVDMQNMVVLEFEDRKLIPLPPTDPLRNYTSGETRGGVDRSDVKPLQIIQPEGPSFRVNGHFIQWQKWNFRIGFTPREGLVIYSVAYIDGSRGRRPVAHRLSFVEMVVPYGDPNDPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFFWHFYQDGKIEAEVKLTGILSLGAMQPGETRKYGTTIAPGLYAPVHQHFFVARMDMAVDCKPGEAFNQVVEVDVKVEDPGKNNVHNNAFYAEERLLKSELEAMRDCNPLSARHWIVRNTRMVNRTGQLTGYRLVPGSNCLPLAGSEAKFLRRAAFLKHNLWVTPYVHNEMHPGGEFPNQNPRVGDGLATWVKQNRSLEEADIVLWYVFGVTLIPRLEDWPVMPVERIGFMLMPHGFFNCSPAVDVPPSAGDLDDKEIGMPAKPIQNELIAKL

SEQ ID NO: 10117 - protein, 706 aa, Brassica napus
VTPRSETKHPLDPLSAAEISVAVATVRAAGANPEVRDSMRFIEVASVEPEKHVVALADAYFFPPFQPSLLPRNKSGPVIPMKLPPRRARLVVYNKTSNETSVWIVELSSVHAVTRGGHHRGRVVSSQVIPDVQPPMDAEEYAECEAIVKDFPPFIEAMKRRGIDDMDLVMVDPWCVGYHSEADAPSRRLAKPLIYCRTDSDCPMENGYARPVEGIYVLVDMQNMVVIEFEDRKFVPLPPPDPLRNYTPGESRGGVDRSDVKPLEIIQPEGPSFRVRGYFVEWQKWNFRIGFTPREGLVIHSVAYVDGSRGRRPVAHRLSFVEMVVPYGDPNEPHYRKNAFDAGEDGLGKNAHSLKKGCDCLGSIKYFDAHFTNFTGGVETIENCVCLHEEDHGILWKHQDWRTGLAEVRRSRRLTVSFFCTVANYEYGFYWHFYQDGKIEAEVKLTGILSLGALQPGETRKYGTTIAPGLYAPVHQHFFIARMDMSVDCKPGEAYNQVVEVNVKVDEPGENNIHNNAFYAEEKLLRSEAEATRDCDPFSARHWIVRNTRTVNRTGQLTGYKLVPGSNCLPLARPEAKFLRRAAFLKHNLWVTRYAPDEKFPGGEFPNQNPRAGEGLATWVKQNRSLEESDVVLWYVFGIIHVPRLEDWPVMPVEHIGFTLMPHGFFNCSPAVDVPPNPACELDTKDSEVKEVVAPKPLQSGLLSKL

SEQ ID NO: 10118 - protein, 757 aa, Brassica napus
MASASQKTTPCAHHGASAPPPPKLLSAVESVIRPVDSIPDTAKKPANKGISVTPRSETKHPLDPLSAAEISVAVATVRAAGANPEVRDSMRFIEVASVEPEKHVVALADAYFFPPFQPSLLPRTKAGPVIPMKLPPRRARLVVYNKTSNETSVWIVELSSVHAVTRGGHHRGRVVSSQVIPDVQPPMDAEEYAECEAIVKDFPPFIEAMKRRGIDDMDLVMVDPWCVGYHSEADAPSRRLAKPLIYCRTDSDCPMENGYARPVEGIYVLVDMQNMVVIEFEDRKFVPLPPPDPLRNYTPGESRGGVDRSDVKPLEIIQPEGPSFRVRGYFVEWQKWNFRIGFTPREGLVIHSVAYVDGSRGRRPVAHRLSFVEMVVPYGDPNEPHYRKNAFDAGEDGLGKNAHSLKKGCDCLGSIKYFDAHFTNFTGGVETIENCVCLHEEDHGILWKHQDWRTGLAEVRRSRRLTVSFFCTVANYEYGFYWHFYQDGKIEAEVKLTGILSLGALQPGETRKYGTTIAPGLYAPVHQHFFIARMDMSVDCKPGEAYNQVVEVNVKVDEPGENNIHNNAFYAEEKLLRSEAEATRDCDPFSARHWIVRNTRTVNRTGQLTGYKLVPGSNCLPLARPEAKFLRRAAFLKHNLWVTRYAPDEKFPGGEFPNQNPRAGEGLATWVKQNRSLEESDVVLWYVFGITHVPRLEDWPVMPVEHIGFTLMPHGFFNCSPAVDVPPNPACELDTKDSEVKEVVAPKPLQSGLLSKL

SEQ ID NO: 10119 - protein, 755 aa, Panax ginseng
MASAPEKATPLSADPLAADQIRLTKRTPMAATLIRPVDSIPQPSTNPTSAKGLPSLFRAQTRHPLEPLAAAEISVAVATVRAAGATPEVRDSMRFVEVVLVEPDKHVVALADAYFFPPFQPSLLPRTKGGPIIPTKLPPRQARLVVYNKKSNETSIWVVELSEVHAVTRGGHHRGKVISSKVVPDVQPPMDATEYAECEAIVKEFLPFREAMKRRGIEDMDLVMVDPWCVGYHSEVDAPNRRLAKPLIFCRTESDCTLENGYARPVEGIHVLVDMQNMIVVEFEDRKLVPLPPADPLRNYTAGESRGGVDRSDVKPLHIIQPEGPSFRVNGYFVEWQKWNFRIGFTPREGLVIYSVAYVDGSRGRRPVAHRLSFVEMVVPYGDPNDPHYRKNAFDAGEDGLGKNAHSLKKGCDCLGFIKYFDAHFTNFTGGVETIENCVCLHEEDHGILWKHQDWRTGLAEVRRSRRLTVSFICTVANYEYGFFWHFYQDGKIEAEVKLTGILSLGALQPGEIRKYGTTIAPGLYAPVHQHFFVARLDMAVDCKPGEAHNQVVEVDVKVEEPGENNVHNNAFYAEEKLLRSELEAMRDCNSLSARHWVIRNTRTVNRTGQLTGYKLLPGSNCLPLAGAEAKVLRRAAFLKHNLWVTPYARDQMFPGGEFPNQNPRVGEGLATWVKQNRSLEETDVVLWYVFGMTHVPRLEDWPVMPVEHIGFMLMPHGFFNCSPAVDVPPSSGDTDLKDNGLVAKACHDGLIAKL

SEQ ID NO: 10120 - protein, 710 aa, Nicotiana benthamiana
NLNFTGLPTLLRAQSHHPLDPLTAAEITVAVATVRAAGSTPEVRDSMRFVEAVLVEPDKSMIALADAYFFPPFQPSLLPRTKGGPVIPSKLPPRKARLIVYNKKSNETSIWIVELSEVHAVTRGGHHRGKVISSKVVPDIQPPMDAAEYAECEAVVKDFPPFHDAMKKRGLDDMELVMVDAWCAGYFSEADAPNRRLGKPLIFCRTESDCPMENGYARPVEGIHILVDMQNMVVIEFEDRKVVPLPPADPLRNYTPGETRGGVDRSDVKPLLISQPEGPSFRVSGHFVEWQKWNFRIGFTPREGLVIYSVAYVDGSRGRRPIAHRLSFIEMVVPYGDPNEPHYRKNAFDAGEDGLGKNAHSLKKGCDCLGYIKYFDAHFTNFTGGVDTIENCVCLHEEDHGILWKHQDWRTGLAEARRSRRLTVSFICTVANYEYGFYWHFYQDGKIEAEVKLTGILSLGALLPGEVRKYGTTIAPGLYAPVHQHFFVARMDMAVDCKPGEAHNQVVEVNARVEPPGEKNVHNNAFYAEERLLRTELEAMRDCSPLTARHWIIRNTRTVNRTGQLTGYKLVPGTNCLPLAGSEAKFLRRAAFLKHNLWVTPYSGDEMFPGGEFPNQNPRIGEGLATWVKQNRSLEETQIVLWYVFGLVHVPRLEDWPVMPVEHIGFMLQPHGFFNCSPAVDVPPSTADSDIKENGVVAKSCHDGGIMAKL

SEQ ID NO: 10121 - protein, 782 aa, Panicum virgatum
MAAAQEKAAACCRAAPARVAGGAPAVPVRAIAAPPPGKVVALAAGSGERVAASAAGAGGAVIEEIAAVQPTTAKASSKGIPIMTRAQRCHPLDPLSAAEIAVAVATVRAAGRSPEERDSMRFVEVVLLEPEKNVVALADAYFFPPFQPSLLPRTKGSAVIPSRLPPRRARLVVYNKQSNETSIWIVELSEVHAATRGGHHRGKVISSVVVPDVQPAMDAMEYAECEATVKSYPPFIEAMKRRGVDDMDLVMVDAWCAGYYGEADAPSRRLGKPLIFCRTESDSPMENGYARPVEGIHVVVDMQNNTVIEFEDRKLVPLPPPDHLRNYTPGETRGGVDRSDVKPLIINQPEGPSFRINGYFVEWQKWNFRIGFTPKEGLVIYSVAYVDGSRGRRPIAHRLSFVEMVVPYGDPNEPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFYWHFYQDGKIEAEVKLTGILSLGALMPGESRKYGTTIAPGLYAPVHQHFFVARMDMAVDCKPNEAHNQVVEVNVKVESAGTHNVHNNAFYAEEKLLKSELKAMRDCDPSSARHWIVRNTRTVNRTGQPTGYRLVPGSNCLPLALPEAKFLRRAGFLKHNLWVTQYKSDEMFPGGEFPNQNPRIHEGLATWVQKDRPLEETNIVLWYMFGLTHIPRLEDWPVMPVERIGFMLMPHGFFNCSPAVDVPPSSSDADVKEAESPKAIQSGSLISKL

SEQ ID NO: 10122 - protein, 755 aa, Panax ginseng
MASAPEKATPLSADPLAADQIRLTKRTPMADTLIRPVDSIPQPSTNPTSAKGLPSLFRAQTRHPLEPLAAAEISVAVATVRAAGATPEVRDSMRFVEVVLVEPDKHVVALADAYFFPPFQPSLLPRTKGGPIIPTKLPPRQARLVVYNKKSNETSIWVVELSEVHAVTRGGHHRGKVISSKVVPDVQPPMDATEYAECEAIVKEFLPFREAMKRRGIEDMDLVMVDPWCVGYHSEIDAPNRRLAKPLIFCRTESDCTLENGYARPVEGIHVLVDMQNMIVVEFEDRKLVPLPPADPLRNYTAGESRGGVDRSDVKPLHIIQPEGPSFRVNGYFVEWQKWNFRIGFTPREGLVIYSVAYVDGSRGRRPVAHRLSFVEMVVPYGDPNDPHYRKNAFDAGEDGLGKNAHSLKKGCDCLGFIKYFDAHFTNFTGGVETTENCVCLHEEDHGILWKHQDWRTGLAEVRRSRRLTVSFICTVANYEYGFFWHFYQDGKIEAEVKLTGILSLGALQPGEIRKYGTTIAPGLYAPVHQHFFVARLDMAVDCKPGEAHNQVVEVDVKVEEPGENNVHNNAFYAEEKLLRSELEAMRDCNSLCARHWVIRNTRTVNRTGQLTGYKLLPGSNCLPLAGAEAKVLRRAAFLKHNLWVTPYARDEMFPGGEFPNQNPRVGEGLATWVKQNRSLEETDVVLWYVFGMTHVPRLEDWPVMPVEHIGFMLMPHGFFNCSPAVDVPPSSGDTDLKDNGLVAKACHDGLIAKL

SEQ ID NO: 10123 - protein, 755 aa, Panax ginseng
MASAPEKATPLSADPLAADQIRLTKRTPMADTLIRPVDSIPQPSTNPTSAKGLPSLFRAQTRHPLEPLAAAEISVAVATVRAAGATPEVRDSMRFVEVVLVEPDKHVVALADAYFFPPFQPSLLPRTKGGPIIPTKLPPRQARLVVYNKKSNETSVWVVELSEVHAVTRGGHHRGKVISSKVVPDVQPPMDATEYAECEAIVKEFLPFREAMKRRGIEDMDLVMVDPWCVGYHSEIDAPNRRLAKPLIFCRTESDCTLENGYARPVEGIHVLVDMQNMIVVEFEDRKLVPLPPADPLRNYTAGESRGGVDRSDVKPLHIIQPEGPSFRVNGYFVEWQKWNFRIGFTPREGLVIYSVAYVDGSRGRRPVAHRLSFVEMVVPYGDPNDPHYRKNAFDAGEDGLGKNAHSLKKGCDCLGFIKYFDAHFTNFTGGVETTENCVCLHEEDHGILWKHQDWRTGLAEVRRSRRLTVSFICTVANYEYGFFWHFYQDGKIEAEVKLTGILSLGALQPGEIRKYGTTIAPGLYAPVHQHFFVARLDMAVDCKPGEAHNQVVEVDVKVEEPGENNVHNNAFYAEEKLLRSELEAMRDCNSLSARHWVIRNTRTVNRTGQLTGYKLLPGSNCLPLAGAEAKVLRRAAFLKHNLWVTPYARDEMFPGGEFPNQNPRVGEGLATWVKQNRSLEETDVVLWYVFGMTHVPRLEDWPVMPVEHIGFMLMPHGFFNCSPAVDVPPSSGDTDLKDNGLVAKACHDGLIAKL

SEQ ID NO: 10124 - protein, 567 aa, Echinacea purpurea
MDAVEYAECEAVVKDFPPFREAMKRRGIEDMDLVMVDPWCVGYHSKADAPNRRLAKPLIFCRTESDCPMENGYARPVEGIDVLVDMQNMVVIEFKDRKLIPLPPADPLRNYTAGETRGGVDRSDVKPLNIVQPDGPSFRVNGHFVQWQKWNFRIGFTPREGLVIHSVAYVDGNRGRRPVAHRLSFVEMVVPYGDPNDPHYRKNAFDAGEDGLGKNAHSLKKGCDCLGYVKYFDAHLTNFTGGVETIEDCVCLHEEDDGILWKHQDWRTGLAEVRRSRRLVVSFICTVANYEYGFYWYFYQDGKIEAEVKLTGILSLGALQPGETRKYGTTIAPGLYAPVHQHFFVARMDVSVDCKPGESHNQVVEVDVKVEEPGDANLHNNAFYAEEKLLKTELEAMRDCNPSSARHWIIRNTRTVNRTGQLTGYKLVPGSNCLPLAGTEAKFLRRAAFLIHNLWVTQYDPEEMFPGGEFPNQNPRVGEGLATWVKKNRSLEETDLVLWYVFGVTHVPRLEDWPVMPVEHIGFRLMPHGFFNCSPAIDVPPSSLTDMEMKENGVVDKSCHNGLVSKM

SEQ ID NO: 10125 - protein, 747 aa, Cyclamen graecum
MASASKETTLAEAAPASAEVVLQDWPVGGERGGDRIIQKPASGVLSKGIVTTIRAQTSHPLDPLTAAEIKVAVAAVRAAGATPEIRDSVRFIEVVLLEPPKNIVALADAYFFPPFQPSLLPRTKGGPMIPSKLPPRQARLIVYNKKSNETSIWIVELSEVHATTRSGHHRGKVVSSEVVPDVQPPMDAVEYAECEAVVKDYPPFQEAMKKRGVEDMDLVMVDPWCAGYHSDADAPKRRLAKPLIFCRTESDCPLENGYARPVEGIHVIVDMQNMVVIEFEDRKLVPLPPADPLRNYTPGETRGGIDRSDIKPLLIDQPEGPSFRVRGNYVEWQKWNFRIGFTPREGLVIHSVAYVDGSRGRRPVAHRLSFVEMVVPYGDPNEPHYRKNAFDAGEDGLGKNAHSLKKGCDCLGYIKYFDAHFTNFTGGVETIENCVCMHEEDYGILWKHQDWRTGLAEVRRSRRLTVSFLCTVANYEYGFFWHFYQDGKIEAEVKLTGILSLGALLPGEIRKYGTMIAPGLYAPVHQHFFVARMDMAVDSKPGEAHNQVVEVNVKVEEPGKNNIHHNAFYCEETLLRSETQAMRDINPLSARHWIVRNTRQVNRTGQLTGYKLIPGSNCLPLAGAEAKFLRRAAFLKHNLWVTQYAHDENFPGGEFPNQNPRAGEGLATWVKQNRSLEETDIVLWYVFGITHVPRLEDWPVMPVEHIGFTLQPHGFFNCSPAVDVPPSACDMDTKADNGAAKPMMAKL

SEQ ID NO: 10126 - protein, 756 aa, Lupinus angustifolius
MASTQKKTTPCCSPGVINNNPTTPSSPPISAFISAVDSLSDTPPKTPSAKGIPVMVRAQTCHPLDPLSAAEISVAVATVRAAGATPEVRDGMRFVEVALIEPDKQVVALADAYFFPPFQPSLLPRTKGGPVIPSKLPPRKARLIVYNKGSNETSIWIVELSEVHAATRGGHHRGKVISSKVVPDVQPPMDAVEYAECEAVVKDFPPFQEAMKKRGIEDMDLVMVDPWCAGYHSEADSPSRRLAKPLIFCRTESDCPLENGYARPVEGIHVLVDMQNMVVLEFEDRRLVPLPPADPLRNYTSAETRGGVDRSDVKPLQIIQPEGPSFRVNGHFIQWQKWNFRIGFTPREGLVIYSVAYIDGSRGRRPVAHRLSFVEMVVPYGDPNDPHYRKNAFDAGEDGLGKNAHSLKKGCDCLGYIKYFDAHFTNFYGGVETIENCVCLHEEDHGILWKHQDWRTGLAEVRRSRRLTVSFICTVANYEYGFFWHFYQDGKIEAEVKLTGVLSLGALQPGETRKYGTTIAPGLYAPVHQHFFVARMDMAVDCKPGEAFNQVVEMNVKVEEPGNNNVHNNAFYAEEKLLKSELEAMRDCDSSSARHWIVRNTRTVNRTGHLTGFKLVPGSNCLPFAGSEAKFLRRAAFLKHNLWVTAYAHDEMYPGGEFPNQNPRAGEGLATWVKQNRPLEEADIVLWYVFGVTHIPRLEDWPIMPVDRIGFMLMPHGFFNCSPAVDVPPSTSELDEKENSIHHNKPIIQNGFIAKL

SEQ ID NO: 10127 - protein, 783 aa, Echinochloa colona
MASAKEKASACCRTAPARVAGGAPTVAPVRAIAASPPGKVLAIAAGGGERVAASAAGAGGAVIEEIAAAQPTTAKASSKGIPIMTRAQRCHPLDPLSAAEIAVAVATVRAAGRSPEERDSMRFVEAVLLEPEKNVVALADAYFFPPFQPSLLPRSKGSAVIPSRLPPRRARLVVYNKQSNETSIWIVELSEVHAATRGGHHRGKVISAEVVPDVQPAMDAMEYAECEATVKSYPPFIEAMKRRGVDDMDLVMVDAWCAGYYSEADAPSRRLAKPLIFCRTESDSPMENGYARPVEGIHAIVDMQINAVIEFEDRKLVPLPPPDHLRNYTPGETRGGVDRSDVKPLIINQPEGPSFRINGYFVEWQKWNFRIGFTPKEGLVIYSVAYVDGSRGRRPIAHRLSFVEMVVPYGDPSEPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFYWHFYQDGKIEAEVKLTGILSLGALMPGESRKYGTTIAPGLYAPVHQHFFVARMDMAIDCKPNEAHNQVVEVNVKVESEGTHNVHNNAFYAEEQLLKSELQAMRDCDPSSARHWIVRNTRTVNRTGQPTGYRLVPGSNCLPLALPEAKFLRRAGFLKHNLWVTQYRSDEMFPGGEFPNQNPRIHEGLPTWVKKDRPLEENDIVLWYVFGLTHIPRMEDWPVMPVEHIGFMLMPHGFFNCSPAVDVPPSSADADVKEAESPKAIQTVGLISKL

SEQ ID NO: 10128 - protein, 783 aa, Echinochloa colona
MASAKEKASACCRTAPARVAGGAPTVAPVRAIAASPPGKVLAIAAGGGERVAASAAGAGGAVIEEIAAAQPTTAKASSKGIPIMTRAQRCHPLDPLSAAEIAVAVATVRAAGRSPEERDSMRFVEAVLLEPEKNVVALADAYFFPPFQPSLLPRSKGSAVIPSRLPPRRARLVVYNKQSNETSIWIVELSEVHAATRGGHHRGKVISAEVVPDVQPAMDAMEYAECEATVKSYPPFIEAMKRRGVDDMDLVMVDAWCAGYYSEADAPSRRLAKPLIFCRTESDSPMENGYARPVEGIHAIVDMQINAVIEFEDRKLVPLPPPDHLRNYTPGETRGGVDRSDVKPLIINQPEGPSFRINGYFVEWQKWNFRIGFTPKEGLVIYSVAYVDGSRGRRPIAHRLSFVEMVVPYGDPSEPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFYWHFYQDGKIEAEVKLTGILSLGALMPGESRKYGTTIAPGLYAPVHQHFFVARMDMAIDCKPNEAHNQVVEVNVKVESEGTHNVHNNAFYAEEQLLKSELQAMRDCDPSSARHWIVRNTRTVNRTGQPTGYRLVPGSNCLPLALPEAKFLRRAGFLKHNLWVTQYRSDEMFPGGEFPNQNPRIHEGLPTWVKKDRPLEENDIVLWYVFGLTHIPRMEDWPVMPVEHIGFMLMPHGFFNCSPAVDVPPSSSDADVKEAESPKAIQTGGLISKL

SEQ ID NO: 10129 - protein, 583 aa, Chrysanthemum coronarium
MVKAQTRHPMDPLAAAEISIAVATVRAAGATPEVRDSMRFIEVVLVEPDKNVVALADAYFFPPFQPSLLPRTKGGPIIPTKLPPRQARLIVYNKKSNETSIWIVELSEVHALTRGGHHRGKVISSKVVPDVQPPMDAVEYAECEAIVKEYPPFREAMKRRGIDDLDLVMVDPWCVGYHSEADAPNRRLAKPLIFCRTESDCPMENGYARPVEGIDVLVDMQNMVVIEFKDRKLVPLPPADPLRNYTAGETRGGVDRSDVKPLNIVQPDGPSFRVNGHFVQWQKWNFRIGFTPREGLVIYSVAYVDGNRGRRPVAHRLSFVEMVVPYGDPNDPHYRKNAFDAGEDGLGKNAHSLKKGCDCLGYIKYFDAHLTNFTGGVETIEDCICLHEEDHGILWKHQDWRTGLAEVRRSRRLVVSFICTVANYEYGFYWYFYQDGKIEAEVKLTGILSLGALQPGEVRKYGTMIAPGLYAPVHQHFFVARMDMSVDCKPGESHNQVVELDVKVEEPGDANVHNNAFYAEETLLKSELEAIRDCNSACARHWIIRNTRTVNRTGQLTGYKLVPGSNCLPLGGAEAKFLRRAAF

SEQ ID NO: 10130 - protein, 773 aa, Arnica chamissonis
MASTSEKATPILRREVTSSSAADVVPDWTTDPSVGDQIRHRGTAASVDNSTRPVVTQTSAAATAAKGTGPTSMVKAQTRHPLDPLAAAEISIAVATVRAAGATPEVRDSMRFIEVVLVEPAKSVVALADAYFFPPFQPSLLPRTKGGPIIPTKLPPRQARLIVYNKKSNETSIWIVELSEVHALTRGGHHRGKVISSKVVPDVQPPMDAVEYAECEAIVKEFPPFREAMKRRGIEDMDLLMVDPWCVGYHSEADAPNRRLAKPLIFCRTESDCPMENGYARPVEGIDVLVDMQNMVVIEFKDRKLVPLPPADPLRNYTAGETRGGVDRSDVKPLNIVQPDGPSFRVNGHFVQWQKWNFRIGFTPREGLVIYSVAYVDGSRGRRPVAHRLSFVEMVVPYGDPNDPHYRKNAFDAGEDGLGKNAHSLKKGCDCLGYVKYFDAHLTNFTGGVETIEDCVSLHEEDDGILWKHQDWRTGLAEVRRSRRLVVSFICTVANYEYGFYWYFYQDGKIEAEVKLTGILSLGALQPGESRKYGTTIAPGLYAPVHQHFFVARMDVSVDCKPGESHNQVVEVDVKVEGPGDANVHNNAFYAEEKLLKSELEAMRDCNPSSARHWIIRNTRTVNRTGQLTGYKLVPGSNCLPLGGAEAKFLRRAAFLMHNLWVTPYEPEEMFPGGEFPNQNPRVGEGLATWVKKNRSLEETDLVLWYVFGLTHVPRLEDWPVMPVEHIGFSLMPHGFFNCSPAIDVPPSSLADIEMKENVMVDKSCHNSLVSKM

SEQ ID NO: 10131 - protein, 774 aa, Helianthus annuus
MASTSEKPPPLLRREATSSSATADVVQDWTTDPSVGDQIRLRGTAASVDNSTRPVVAQTSAASAAAKGPGPTSMVKAQTRHPLDPLAAAEISIAVATVRAAGATPEVRDSMRFIEVVLVEPAKSVVALADAYFFPPFQPSLLPRTKGGPIIPTKLPPRQARLIVYNKKSNETSVWIVELSEVHALTRGGHHRGKVISSKVVPDVQPPMDAVEYAECEAIVKDFPPFREAMKRRGIEDMDLVMVDPWCVGYHSEADAPNRRLAKPLIFCRTESDCPMENGYARPVEGIDVLVDMQNMVVIEFKDRKLVPLPPADPLRNYTAGETRGGVDRSDVKPLNIVQPDGPSFRVNGHFVQWQKWNFRIGFTPREGLVIYSVAYVDGNRGRRPVAHRLSFVEMVVPYGDPNDPHYRKNAFDAGEDGLGKNAHSLKKGCDCLGYVKYFDAHLTNFTGGVETIEDCVCLHEEDDGILWKHHDWRTGLAEVRRSRRLVVSFICTVANYEYGFYWYFYQDGKIEAEVKLTGILSLGALQPGESRKYGTTIAPGLYAPVHQHFFVARMDMSVDCKPGESHNQVVEVDVKVEGPGDANVHNNAFYTEEKLLKSELEAIRDCNPSSARHWIIRNTRTVNRTGQLTGYKLVPGSNCLPLGGAEAKFLRRAAFLMHNLWVTQYEPEEMFPGGEFPNQNPRVGEGLATWVKKNRSLEETDLVLWYVFGVTHVPRLEDWPVMPVEHIGFRLMPHGFFNCSPAIDVPPSSSADMEMKENGMVDKSCHSSLVSKI

SEQ ID NO: 10132 - protein, 757 aa, Brassica oleracea
MASASQKTTPCAHHGASAPPPPKLLSAVESVLRPVDSIPDTAKKPANKGISVTPRSETKHPLDPLSAAEISVAVATVRAAGANPEVRDSMRFIEVASVEPEKHVVALADAYFFPPFQPSLLPRNKSGPVIPMKLPPRRARLVVYNKTSNETSVWIVELSSVHAVTRGGHHRGRVVSSQVIPDVQPPMDAEEYAECEAIVKDFPPFIEAMKRRGIDDMDLVMVDPWCVGYHSEADAPSRRLAKPLIYCRTDSDCPMENGYARPVEGIYVLVDMQNMVVIEFEDRKFVPLPPPDPLRNYTPGESRGGVDRSDVKPLEIIQPEGPSFRVRGYFVEWQKWNFRIGFTPREGLVIHSVAYVDGSRGRRPVAHRLSFVEMVVPYGDPNEPHYRKNAFDAGEDGLGKNAHSLKKGCDCLGSIKYFDAHFTNFTGGVETIENCVCLHEEDHGILWKHQDWRTGLAEVRRSRRLTVSFFCTVANYEYGFYWHFYQDGKIEAEVKLTGILSLGALQPGETRKYGTTIAPGLYAPVHQHFFIARMDMSVDCKPGEAYNQVVEVNVKVDEPGENNIHNNAFYAEEKLLRSEAEATRDCDPFSARHWIVRNTRTVNRTGQLTGYKLVPGSNCLPLARPEAKFLRRAAFLKHNLWVTRYAPDEKFPGGEFPNQNPRAGEGLATWVKQNRSLEESDVVLWYVFGIIHVPRLEDWPVMPVEHIGFTLMPHGFFNCSPAVDVPPNPACELDTKDSEVKEVVAPKPLQSGLLSKL

SEQ ID NO: 10133 - protein, 757 aa, Brassica rapa
MASASQKTTPCPHHGASAPPPPKLLSAVDSVLRPVDSIPDTAKKPANKGISVTPRSETKHPLDPLSAAEISVAVATVRAAGANPEVRDSMRFIEVASVEPEKHVVALADAYFFPPFQPSLLPRNKSGPVIPMKLPPRRARLVVYNKTSNETSVWIVELSSVHAVTRGGHHRGRVVSSQVIPDVQPPMDAEEYAECEAIVKDFPPFIEAMKRRGIDDMDLVMVDPWCVGYHSEADAPSRRLAKPLIYCRTDSDCPMENGYARPVEGIYVLVDMQNMVVIEFEDRKFVPLPPPDPLRNYTPGESRGGVDRSDVKPLEIIQPEGPSFRVRGYFVEWQKWNFRIGFTPREGLVIHSVAYVDGSRGRRPVAHRLSFVEMVVPYGDPNEPHYRKNAFDAGEDGLGKNAHSLKKGCDCLGSIKYFDAHFTNFTGGVETIENCVCLHEEDHGILWKHQDWRTGLAEVRRSRRLTVSFLCTVANYEYGFYWHFYQDGKIEAEVKLTGILSLGALQPGETRKYGTTIAPGLYAPVHQHFFIARMDMSVDCKPGEAYNQVVEVNVKVDEPGENNIHNNAFYAEEKLLRSEAEATRDCDPFSARHWIVRNTRTVNRTGQLTGYKLVPGSNCLPLARPEAKFLRRAAFLKHNLWVTRYAPDEKFPGGEFPNQNPRAGEGLATWVKQNRSLEESDVVLWYVFGIIHVPRLEDWPVMPVEHIGFTLMPHGFFNCSPAVDVPPNPACELDTKDSEVKEVVAPKPLQSGLLSKL

SEQ ID NO: 10134 - protein, 703 aa, Brassica napus
MPRTETKHPLDPLSAAEISVAVATVRAAGANPEVRDSMRFIEVASVEPEKNVVALADAYFFPPFQPSLLPRTKAGPVIPMRLPPRRAKLVVYNKKSNETSVWIVELSEVHAVTRGGHHRGRVVSSEVIPDVQPPMDAAEYAECEAIVKDFPPFIEAMKRRGIDDMDLVMVDPWCVGYHSEADAPSRRLAKPLIYCRTDSDSPMENGYARPVEGIYVLVDMQNMVVIEFEDRKFVPLPPPDPLRNYTPGESRGGVDRSDVKPLQIIQPEGPSFRVRGYFVEWQKWNFRIGFTPREGLVIHSVAYVDGSRGRRPVAHRLSFVEMVVPYGDPNEPHYRKNAFDAGEDGLGKNAHSLKKGCDCLGTIKYFDAHFTNFTGGVETIENCVCLHEEDHGILWKHQDWRTGLAEVRRSRRLTVSFLCTVANYEYGFYWHFYQDGKIEAEVKLTGILSLGALQPGETRKYGTTIAPGLYAPVHQHFFIARMDMSVDCKPGEAFNQVVEVNVRVDEPGENNIHNNAFYAEEKLLRSEAEAMRDCDPFSARHWIVRNTRTVNRTGQLTGYKLVPGSNCLPLARPEAKFLRRAAFLKHNLWVTRYDPEEKFPGGEFPNQNPRSGEGLATWVKQNRSLEESDVVLWYVFGIIHVPRLEDWPVMPVEHIGFTLMPHGFFNCSPAVDVPPNPACELETKDSEVKEVVAAPKPGLLSKL

SEQ ID NO: 10135 - protein, 703 aa, Brassica napus
MPRTETKHPLDPLSAAEISVAVATVRAAGANPEVRDSMRFIEVASVEPEKNVVALADAYFFPPFQPSLLPRTKAGPVIPMRLPPRRAKLVVYNKKSNETSVWIVELSEVHAVTRGGHHRGRVVSSEVIPDVQPPMDAAEYAECEAIVKDFPPFIEAMKRRGIDDMDLVMVDPWCVGYHSEADAPSRRLAKPLIYCRTDSDSPMENGYARPVEGIYVLVDMQNMVVIEFEDRKFVPLPPPDPLRNYTPGESRGGVDRSDVKPLQIIQPEGPSFRVRGYFVEWQKWNFRIGFTPREGLVIHSVAYVDGSRGRRPVAHRLSFVEMVVPYGDPNEPHYRKNAFDAGEDGLGKNAHSLKKGCDCLGTIKYFDAHFTNFTGGVETIENCVCLHEEDHGILWKHQDWRTGLAEVRRSRRLTVSFLCTVANYEYGFYWHFYQDGKIEAEVKLTGILSLGALQPGETRKYGTTIAPGLYAPVHQHFFIARMDMSVDCKPGEAFNQVVEVNVRVDEPGENNIHNNAFYAEEKLLRSEAEAMRDCDPFSARHWIVRNTRTVNRTGQLTGYKLVPGSNCLPLARPEAKFLRRAAFLKHNLWVTRYDPEEKFPGGEFPNQNPRSGEGLATWVKQNRSLEESDVVLWYVFGIIHVPRLEDWPVMPVEHIGFTLMPHGFFNCSPAVDVPPNPACELETKDSEVKEVLAAPKPGLLSKL

SEQ ID NO: 10136 - protein, 775 aa, Musa acuminata
MATTEEKATPCCSPNLLPPKASGAKGGAPRSEAAVGEWIAAADPKRSASAATAMSPLVPVEDVKDPPAKASLPGIPMMMRAQTRHPLDPLSAAEISVAVATVRSAGATPEVRDSMRFVEVVLLEPEKNIVALADAYFFPPFQPSLLPRTKGGPVILSKLPPRRARLVVYNKKSNETSIWIVELSEVHAATRGGHHRGKVISSEVVPDVQPPMDAIEYAECEAAVKNYPPFIEAMRKRGVDDMDLVMVDAWCAGYHSDADAPSRRLAKPLIFCRTESDCPVENGYARPVEGIYILVDMQNNLIIEFEDRKLVPLPPADPLRNYTPGETRGGVDRSDIKPLHILQPEGPSFRINGYFVEWQKWSFRIGFTPREGLVIHSVAYIDGSRGRRPVAHRLSFVEMVVPYGDPNEPHYRKNAFDAGEDGLGKNAHSLKRGCDCLGYIKYFDAHFTNYTGGIETIENCVCLHEEDHGILWKHQDWRTGLAEVRRSRRLTVSFICTVANYEYGFFWHFYQDGKIEAEVKLTGILSLGALQPGESRKYGTTIAPGLYAPVHQHFFVARMDMAVDCKPTEAFNQVIEVNAKVEDPGQNNVHNNAFYAEEKLLKSELEAMRDCDPFSARHWIVRNTRTVNRTGQPTGYKLMPGLNCLPLAGPEAKFLRRAAFLKHNLWVTPYSRDEMYPGGEFPNQNPRINEGLVTWVKKNRSLEEADIVLWYVFGITHIPRLEDWPVMPVDRIGFMLMPHGFFNCSPAVDVPPSANEIDKDGGSPKLIQNGLLAKL

SEQ ID NO: 10137 - protein, 783 aa, Echinochloa colona
MASAKEKASACCRTAPARVAGGAPTVAPVRAIAASPPGKVLAIAAGGGERVAASAAGAGGAVIEEIAAAQPTTAKASSKGIPIMTRAQRCHPLDPLSAAEIAVAVATVRAAGRSPEERDSMRFVEAVLLEPEKNVVALADAYFFPPFQPSLLPRSKGSAVIPSRLPPRRARLVVYNKQSNETSIWIVELSEVHAATRGGHHRGKVISAEVVPDVQPAMDAMEYAECEATVKSYPPFIEAMKRRGVDDMDLVMVDAWCAGYYSEADAPSRRLAKPLIFCRTESDSPMENGYARPVEGIHAIVDMQINAVIEFEDRKLVPLPPPDHLRNYTPGETRGGVDRSDVKPLIINQPEGPSFRINGYFVEWQKWNFRIGFTPKEGLVIYSVAYVDGSRGRRPIAHRLSFVEMVVPYGDPSEPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFYWHFYQDGKIEAEVKLTGILSLGALMPGESRKYGTTIAPGLYAPVHQHFFVARMDMAIDCKPNEAHNQVVEVNVKVESEGTHNVHNNAFYAEEQLLKSELQAMRDCDPSSARHWIVRNTRTVNRTGQPTGYRLVPGSNCLPLALPEAKFLRRAGFLKHNLWVTQYRSNEMFPGGEFPNQNPRIHEGLPTWVKKDRPLEENDIVLWYVFGLTHIPRMEDWPVMPVEHIGFMLMPHGFFNCSPAVDVPPSSADADVKEAESPKAIQTGGLISKL

SEQ ID NO: 10138 - protein, 707 aa, Phaseolus vulgaris
MTRPQSSHPLDPLTAAEISVAVATVRAAGATPELRDSMRFIEVVLLEPDKNVVALADAYFFPPFQPSLLPRTRGGPLIPTKLPPRCARLVVYNKKSNETSIWIVELSQVHAVVSTQSGHYGRGKVIASHVVPDVQPPMDAEEYAECEAVVKSFPPFIEAMKKRGIEDMDLVMVDPWCVGYYSEADAPGRRLAKPLLFCQSESDCPMENGYARPVEGIYVLVDMQNMVVIEFEDRKLVPLPPVDPLRNYTPGETRGGSDRSDVKPLQIIQPEGPSFRVNGYFVEWQKWNFRIGFTPKEGLVIYSVAYVDGSHGRRPVAHRMSFVEMVVPYGDPNEPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFFWHFYQDGRIEAEVKLTGILSLGALLPGEFRKYGTMIAPGLYAPVHQHFFVARMDMSVDSKPGEALNQVVEVNMKVEEPGENNVHNNAFYAEETLLRSELEAMRDCNSLTARHWIVRNTRTCNRTGQLTGYKLVPGSNCLPLAGSEAKFLRRAAFLKHNFWVTTYSRNEMFPGGEFPNQNPRDREGLATWVKQNRSLEETNIVLWYVFGITHVPRLEDWPVMPVEHIGFMLTPHGFFNCSPAVDVPPNACEMDSKDNEIKDNGSSKPIQNGLTAKL

SEQ ID NO: 10139 - protein, 673 aa, Chrysanthemum coronarium
GQRWNEICGGGSIRTGKNVVALADAYFFPPFQPSLLPRSKGGALLPFKLPPRRARLVVYNKKSNETSVWIVELSEVHAATRGGHHRGKVISTRVVPDVQPPMDAVEYAECEAVVKDYPPFVEAMKKRGIDDMDLVMVDAWCVGYHSDADAPSRRLAKPLIFCRTESDSPMENGYARPVEGIYVLVDMQNMVVLEFEDRKLVPLPPADPLRNYTPGHTRGGVDRSDVKALQILQPDGPSFRVNGNYVEWQKWNFRIGFTPREGLVIHSIAYVDGSRGRRPIAHRLSFVEMVVPYGDPNEPHYRKNAFDAGEDGLGKNAHSLKKGCDCLGYIKYFDAHFTNFIGGVETIENCVCMHEEDHGMLWKHQDWRTGLAEVRRSRRLTVSFVCTVANYEYGFYWHFYQDGKIEAEVKLTGILSLGALQPGEVRKYGTTIAPGLYAPVHQHFFVARMDMAVDCKPGEAHNQVVEVNVKVEEPGKDNVHNNAFYTQETLLKSESQAMRDCNQLSARHWIVQNTRNVNRTGQLTGYKLVPGSNCLPLAGSEAKFLRRAAFLKHNLWVTQYASGEDFPGGEFPNQNPRVGEGLASWVQQNRSLEETDIVLWYVFGITHVPRLEDWPVMPVERIGFMLQPHGFFNSSPAVDVPPGACESDAKDCHVKDKDAIVPKSVSNGLMAKL

SEQ ID NO: 10140 - protein, 781 aa, Setaria italica
MAAAKEKAPASCCRAAPARVAGGAPAAPVRAIAAPPAGKVVAVASGGGERVAAAGAGSAVIEEIAAVQPTTAKASSKGIPIMTRAQRCHPLDPLSAAEIAVAVVTVRAAGRSPEERDSMRFVEAVLLEPNKNVVALADAYFFPPFQPSLLPRTKGSAVIPSRLPPRRARLVVYNKQSNETSIWIVELSEVHAATRGGHHRGKVISAEVVPDVQPAMDAMEYAECEATVKSYPPFIEAMKRRGVDDMDLVMVDAWCAGYYGEADAPSRRLGKPLIFCRTESDSPMENGYARPVEGIHVVVDMQNNTVIEFEDRKLVPLPPPDHLRNYTPGETRGGVDRSDVKPLIINQPEGPSFRINGYFVEWQKWNFRIGFTPKEGLVIYSVAYVDGNRGRRPIAHRLSFVEMVVPYGDPSEPHYRKNAFDAGEDGLGKNAHSLKKGCDCLGYIKYFDAHFTNFTGAVETIENCVCLHEEDHGILWKHQDWRTGLAEVRRSRRLTVSFICTVANYEYGFYWHFYQDGKIEAEVKLTGILSLGALMPGESRKYGTTIAPGLYAPVHQHFFVARMDMAVDCKPNEAHNQVVEVNVKVESAGTHNVHNNAFYAEEELLKSELQAMRDCDPSSARHWIVRNTRTVNRTGQPTGYRLVPGSNCLPLALPEAKFLRRAGFLKHNLWVTQYKSDEMFPGGEFPNQNPRIHEGLPTWVKKDRPLEETDIVLWYVFGLTHIPRLEDWPVMPVEHIGFMLMPHGFFNCSPAVDVPPSSSDADVKEAESPKDIQTGGLNSKL

SEQ ID NO: 10141 - protein, 767 aa, Euphorbia peplus
MSLKYYNGLTSAKTTPSSSSADWTAAGAQVPVRDRAAAMASLIPPVDSLSDPTTATTTTATSSSSKGTRVQTSHPLDPLTAAEISVAVATVRAAGATPEVRDSMRFVEVVLLEPEKNVVALADAYFFPPFQPSLLPRSKGGPVIPTKLPPRKARLVVYNKRSNETSIWIVELSEVHAATRGGHHRGKVKSSNVVPNVQPPMDAVEYAECEAIVKEFPPFLEAMKKRGIEDMDLVMVDPWCVGYHSEADAPSRRLAKPLIFCRTESDCPIENGYARPVEGIHVLVDMQNMVVIEFEDRKLVPLPPADPLRNYTAGETRGGVDRSDVKPLQIIQPEGPSFRVNGHFIQWQKWNFRIGFTPREGLVIYSVAYVDGNRGRRPVAHRLSFVEMVVPYGDPNDPHYRKNAFDAGEDGLGKNAHSLKKNCDCLGFIKYFDAHFTNFSGGVETIENCVCLHEEDHGILWKHQDWRTGLAEVRRSRRLSVSSICTVANYEYGFFWHFYQDGKIEAEIKLTGILSLGALQPGEVRKYGTTIAPGLYAPVHQHFFVARMDMAVDCKPGETFNQVVEVNVKVDEPGKANVHNNAFYAEEELLKSELQAIRDCNPLSARHWIIRNTRTVNRTGQLTGFKLVPGSNCLPLAGSEAKFLRRAAFLKHNLWVTPYARDEMYPGGEFPNQNPRNEEGLATWVKKDRPIEEANVVLWYVFGVTHIPRLEDWPVMPVERIGFMLMPHGFFNCSPAVDVPPSASDMELKENVITAKPIQNALLAAKL

SEQ ID NO: 10142 - protein, 775 aa, Secale cereale
MASAQEKAALCCGGPARDAPRAAIAAPGKVSMSAAGGGGERVVSAAGGGAVMDDIAASAAQPTTAKASSKGIPIMTRAQRFHPLDPLSAAEIAVAVATVRAAGKSPEERDSMRFVEAVLLEPEKNVVALADAYFFPPFQPSLLPRTKGSAVIPSRLPPRRAKLVVYNRHSNETTIWIVELSEVHAATRGGHHRGKVISSEVVPDVQPAMDAMEYAECEATVKNYPPFIEAMKKRGVDDMELVMVDAWCAGYYSDADAPSRRLARPLIFCRTESDSPMENGYARPVEGIHVVVDMQNNIVIEFEDRKFVPLPPADHLRNYTPGETRGGVDRSDVKPLIINQPEGPSFRINGYFVEWQKWNFRIGFTPKEGLVIYSVAYVDGSRGRRPIAHRLSFVEMVVPYGDPSEPHYRKNAFDAGEDGLGKNAHSLKKGCDCLGYIKYFDAHFTNFTGHVETIENCVCLHEEDHGILWKHQDWRTGLAEVRRSRRLTVSFICTVANYEYGFYWHFYQDGKIEAEIKLTGILSLGALMPGESRKYGTTIAPSLYAPVHQHFFVARMDMAVDCKPNEAHNQVVEVNVKVESAGTNNVHNNAFYAEEKILKSELQAMRDCDPSSARHWIVRNTRAVNRTGQPTGFRLVPGSNCLPFALPEAKFLRRAGFLKHNLWVTPYKSDEKFPGGEFPNQNPRLHEGLATWVKQDRPLEETDIVLWYVFGLTHIPRLEDWPVMPVERIGFMLMPHGFFNCSPAVDVPPGTSDAADVKEAESPKAVQNGGLVSKL

SEQ ID NO: 10143 - protein, 774 aa, Triticum aestivum
MASAQEKAALCCGGPARDAPRAAIAAPGKVSMSAAGGGGERVVSAAGGGAVMDDIASAAQPTTAKASSKGIPIMTRAQRFHPLDPLSAAEIAVAVATVRAAGKSPEERDSMRFVEAVLLEPEKNVVALADAYFFPPFQPSLLPRTKGSAVIPSRLPPRRAKLVVYNRHSNETTIWIVELSEVHAATRGGHHRGKVISSEVVPDVQPAMDAMEYAECEATVKNYPPFVEAMKKRGVDDMELVMVDAWCAGYYSDADAPSRRLARPLIFCRTESDSPMENGYARPVEGIHVVVDMQNNIVIEFEDRKFVPLPPPDHLRNYTPGETRGGVDRSDVKPLIINQPEGPSFRINGYFVEWQKWNFRIGFTPKEGLVIYSVAYVDGSRGRRPIAHRLSFVEMVVPYGDPSEPHYRKNAFDAGEDGLGKNAHSLKKGCDCLGYIKYFDAHFTNFTGHVETIENCVCLHEEDHGILWKHQDWRTGLAEVRRSRRLTVSFICTVANYEYGFYWHFYQDGKIEAEVKLTGILSLGALMPGESRKYGTTIAPSLYAPVHQHFFVARMDMAVDCKPNEAHNQVVEVNVKVESAGTNNVHNNAFYAEEKILKSELQAMRDCDPSSARHWIVRNTRAVNRTGQPTGFRLVPGSNCLPFALPEAKFLRRAGFLKHNLWVTPYKSDEKFPGGEFPNQNPRLHEGLATWVKKDRPLEETDIVLWYVFGLTHIPRLEDWPVMPVEHIGFMLMPHGFFNCSPAVDVPPGTSDAADVKEAESPKAIQNGALVSKL

SEQ ID NO: 10144 - protein, 773 aa, Hordeum vulgare
MASAQEKAALCCGGPARDAPRAAIAAPAPGKVSMSGAGDRVVSAAGGGAVMDDIASAAQPTTAKASSKGIPIMTRAQRFHPLDPLSAAEIAVAVATVRAAGKSPEERDSMRFVEAVLLEPEKNVVALADAYFFPPFQPSLLPRTKGSAVIPSRLPPRRAKLVVYNRHSNETTIWIVELSEVHAATRGGHHRGKVISSEVVPDVQPAMDAMEYAECEATVKNYPPFVEAMKKRGVDDMELVMVDAWCAGYYSDADAPSRRLARPLIFCRTESDSPMENGYARPVEGIHVVVDMQNNVVIEFEDRKFVPLPPPDHLRNYTPGETRGGVDRSDVKPLIINQPEGPSFRINGYFVEWQKWNFRIGFTPKEGLVIYSVAYVDGSRGRRPIAHRLSFVEMVVPYGDPSEPHYRKNAFDAGEDGLGKNAHSLKKGCDCLGYIKYFDAHFTNFTGHVETIENCVCLHEEDHGILWKHQDWRTGLAEVRRSRRLTVSFICTVANYEYGFYWHFYQDGKIEAEVKLTGILSLGALMPGESRKYGTTIAPSLYAPVHQHFFVARMDMAVDCKPNEAHNQVVEVNVNVESAGTNNVHNNAFYAEEKILKSELQAMRDCDPSSARHWIVRNTRAVNRTGQPTGFRLVPGSNCLPFALPEAKFLRRAGFLKHNLWVTPYKSDEKFPGGEFPNQNPRLHEGLATWVKQDRPLEETDIVLWYVFGLTHIPRLEDWPVMPVERIGFMLMPHGFFNCSPAVDVPPGTSDAADVKEAESPKAIQNGGLVSKL

SEQ ID NO: 10145 - protein, 787 aa, Solanum lycopersicum
MAETSQNVIPTPTNTTAAAAASFIPPTSVSVVRRENTAVSVSDSAVDSVVVDNQKEQTPATASSKGIQIMHRAHTCHPLDPLTAAEISVAVATVRAAGDTPEVRDGMRFVEVVLLEPDKTFVALADAYFYPPFQSSLMPRTKGGLLVPSKLPPRHARLIVYNKKTNETSVWIVRLTEVHAAVRGGQHRGKVISSKVIPDVQPPMDAQEYADCESVVKNYPPFIEAMKRRGIDDMDLVMVDPWCVGYHSEADAPSRRLAKPLIFCRTESYCPMENGYARPVEGIHVLVDVQIMQVIEFEDRKLVPLLPADPLRNYTAGETRGGVDRSDVKPLQIIQPEGPSFRVDGNYVQWQKWNFRVGFTPREGLVIHSVAYLDGSRGRRSIAHRLSFVEMVVPYGDPNDPHYRKNAFDAGEDGLGKNAHSLKRGCDCLGYIKYFDANFTNFTGGVETIKNCVCLHEEDHGMLWKHQDWRTGLAEVRRSRRLTVSFICTVANYEYGFYWHFYQARIRKSFIRKCSFDGKIEAEVKLTGILSLGALQPGESRKYGTTISPGLYAPVHQHFFVARMNMAVDCKPGEAHNQVVEVNLKVEEPGKENVHNNAFYAEETQLRSELQAMRDCDPLSARHWIVRNTRTSNRTGQLTGYKLVPGQNCLPLAGPEAKFLRRAAFLKHNLWVTQYAPGEDFPGGEFPNQNPRVGEGLASWVKEDRSLEESDIVLWYVFGITHVPRLEDWPVMPVEHIGFMLQPHGFFNCSPAVDVPPPRGCDSESKDSDASENGESKPTTTGLTAKL

SEQ ID NO: 10146 - protein, 701 aa, Flaveria ramosissima
MVKAQTRHPLDPLAAAEISIAVATVRAAGATPEVRDSMRFIEVVLVEPSKNVVALADAYFFPPFQPSLLPRTKGGPIIPTKLPPRQARLIVYNKKSNETSVWIVELSEVHALTRGGHHRGKVISSTVVPDVQPPMDAVEYAECEAIVKDFPPFREAMKRRGIEDMDLVMVDPWCVGYHSEADAPNRRLAKPLIFCRTESDCPMENGYARPVEGIDVLVDMQNMVVIEFKDRKLVPLPPADPLRNYTAGETRGGVDRSDVKPLNIVQPDGPSFRVNGHFVQWQKWNFRIGFTPREGLVIYSVAYVDGSRGRRPVAHRLSFVEMVVPYGDPNDPHYRKNAFDAGEDGLGKNAHSLKKGCDCLGYVKYFDAHLTNFTGGVETIEDCVCLHEEDDGMLWKHQDWRTGLAEVRRSRRLVVSFICTVANYEYGFYWYFYQDGKIEAEVKLTGILSLGALQPGETRKYGTTIAPGLYAPVHQHFFVARMDVSVDCKPGEAHNQVVEVDVKVEGPGDANVHNNAFYAEEKLLKSELEAMRDCNPSSARHWIIRNTRTVNRTGQLTGYKLVPGSNCLPLGGSEAKFLRRAAFLMHNLWVTQYEPEEMFPGGEFPNQNPRVGEGLATWVKKNRSLEETDLVLWYVFGVTHVPRLEDWPVMPVEHIGFRLMPHGFFNCSPAVDVPPSPLADMEMKENGMVDKSCHNGLVSKM

SEQ ID NO: 10147 - protein, 771 aa, Triticum aestivum
MASAQEKAALCCGGPARDAPRAAIAAPGKAVSMSAAAAGGSAAGGGAVMDDIASAAQPTTAKASSKGIPIMTRAQRFHPLDPLSAAEIAVAVATVRAAGKSPEERDSMRFVEAVLLEPEKNVVALADAYFFPPFQPSLLPRTKGSAVIPSRLPPRRAKLVVYNRHSNETTIWIVELSEVHAATRGGHHRGKVISSEVVPDVQPAMDAMEYAECEATVKNYPPFVEAMKKRGVDDMELVMVDAWCAGYYSDADAPSRRLARPLIFCRTESDSPMENGYARPVEGIHVVVDMQNNIVIEFEDRKFVPLPPPDHLRNYTPGETRGGVDRSDVKPLIINQPEGPSFRINGYFVEWQKWNFRIGFTPKEGLVIYSVAYVDGSRGRRPIAHRLSFVEMVVPYGDPSEPHYRKNAFDAGEDGLGKNAHSLKKGCDCLGYIKYFDAHFTNFTGHVETIENCVCLHEEDHGILWKHQDWRTGLAEVRRSRRLTVSFICTVANYEYGFYWHFYQDGKIEAEVKLTGILSLGALMPGESRKYGTTIAPSLYAPVHQHFFVARMDMAVDCKPNEAHNQVVEVNVKVESAGTNNVHNNAFYAEEKILKSELQAMRDCDPSSARHWIVRNTRAVNRTGQPTGFRLVPGSNCLPFALPEAKFLRRAGFLKHNLWVTPYKSDEKFPGGEFPNQNPRLHEGLATWVKKDRPLEETDIVLWYVFGLTHIPRLEDWPVMPVERIGFMLMPHGFFNCSPAVDVPPGTSDAADVKEAESPKAIQNGSLVSKL

SEQ ID NO: 10148 - protein, 701 aa, Secale cereale
MTRAQRFHPLDPLSAAEIAVAVATVRAAGKSPEERDSMRFVEAVLLEPEKNVVALADAYFFPPFQPSLLPRTKGSAVIPSRLPPRRAKLVVYNRHSNETTIWIVELSEVHAATRGGHHRGKVISSEVVPDVQPAMDAMEYAECEATVKNYPPFIEAMKKRGVDDMELVMVDAWCAGYYSDADAPSRRLARPLIFCRTESDSPMENGYARPVEGIHVVVDMQNNIVIEFEDRKFVPLPPADHLRNYTPGETRGGVDRSDVKPLIINQPEGPSFRINGYFVEWQKWNFRIGFTPKEGLVIYSVAYVDGSRGRRPIAHRLSFVEMVVPYGDPSEPHYRKNAFDAGEDGLGKNAHSLKKGCDCLGYIKYFDAHFTNFTGHVETIENCVCLHEEDHGILWKHQDWRTGLAEVRRSRRLTVSFICTVANYEYGFYWHFYQDGKIEAEIKLTGILSLGALMPGESRKYGTTIAPSLYAPVHQHFFVARMDMAVDCKPNEAHNQVVEVNVKVESAGTNNVHNNAFYAEEKILKSELQAMRDCDPSSARHWIVRNTRAVNRTGQPTGFRLVPGSNCLPFALPEAKFLRRAGFLKHNLWVTPYKSDEKFPGGEFPNQNPRLHEGLATWVKQDRPLEETDIVLWYVFGLTHIPRLEDWPVMPVERIGFMLMPHGFFNCSPAVDVPPGTSDAADVKEAESPKAIQNGGLVSKL

SEQ ID NO: 10149 - protein, 775 aa, Secale cereale
MASAQEKAALCCGGPARDAPRAAIAAPGKVSMSAAGGGGERVVSAAGGGAVMDDIAASAAQPTTAKASSKGIPIMTRAQRFHPLDPLSAAEIAVAVATVRAAGKSPEERDSMRFVEAVLLEPEKNVVALADAYFFPPFQPSLLPRTKGSAVIPSRLPPRRAKLVVYNRHSNETTIWIVELSEVHAATRGGHHRGKVISSEVVPDVQPAMDAMEYAECEATVKNYPPFIEAMKKRGVDDMELVMVDAWCAGYYSDADAPSRRLARPLIFCRTESDSPMENGYARPVEGIHVVVDMQNNIVIEFEDRKFVPLPPADHLRNYTPGETRGGVDRSDVKPLIINQPEGPSFRINGYFVEWQKWNFRIGFTPKEGLVIYSVAYVDGSRGRRPIAHRLSFVEMVVPYGDPSEPHYRKNAFDAGEDGLGKNAHSLKKGCDCLGYIKYFDAHFTNFTGHVETIENCVCLHEEDHGILWKHQDWRTGLAEVRRSRRLTVSFICTVANYEYGFYWHFYQDGKIEAEIKLTGILSLGALMPGESRKYGTTIAPSLYAPVHQHFFVARMDMAVDCKPNEAHNQVVEVNVKVESAGTNNVHNNAFYAEEKILKSELQAMRDCDPSSARHWIVRNTRAVNRTGQPTGFRLVPGSNCLPFALPEAKFLRRAGFLKHNLWVTPYKSDEKFPGGEFPNQNPRLHEGLATWVKQDRPLEETDIVLWYVFGLTHIPRLEDWPVMPVERIGFMLMPHGFFNCSPAVDVPPGTSDAADVKEAESPKAIQNGGLVSKL

SEQ ID NO: 10150 - protein, 701 aa, Chrysanthemum coronarium
MVKAQTRHPMDPLAAAEISIAVATVRAAGATPEVRDSMRFIEVVLVEPDKNVVALADAYFFPPFQPSLLPRTKGGPIIPTKLPPRQARLIVYNKKSNETSIWIVELSEVHALTRGGHHRGKVISSKVVPDVQPPMDAVEYAECEAIVKEYPPFREAMKRRGIDDLDLVMVDPWCVGYHSEADAPNRRLAKPLIFCRTESDCPMENGYARPVEGIDVLVDMQNMVVIEFKDRKLVPLPPADPLRNYTAGETRGGVDRSDVKPLNIVQPDGPSFRVNGHFVQWQKWNFRIGFTPREGLVIYSVAYVDGNRGRRPVAHRLSFVEMVVPYGDPNDPHYRKNAFDAGEDGLGKNAHSLKKGCDCLGYIKYFDAHLTNFTGGVETIEDCICLHEEDHGILWKHQDWRTGLAEVRRSRRLVVSFICTVANYEYGFYWYFYQDGKIEAEVKLTGILSLGALQPGEVRKYGTMIAPGLYAPVHQHFFVARMDMSVDCKPGESHNQVVELDVKVEEPGDANVHNNAFYAEETLLKSELEAIRDCNSACARHWIIRNTRTVNRTGQLTGYKLVPGSNCLPLGGAEAKFLRRAAFLMHNLWVTAYDPEEMFPGGEFPNQNPRVGEGLATWVKKNRSLEETDLVLWYVFGVTHVPRLEDWPVMPVEHIGFRLMPHGFFNSSPAVDVPPSSMTDSELKENGLVDKSCHTGLVAKM

SEQ ID NO: 10151 - protein, 698 aa, Musa acuminata
MMRAQTSHPLDPLSSAEISVAVATVRAAGATPEVRDGMRFIEVVLLEPEKNIVALADAYFFPPFQPSLLPRTKGGPVIPSKLPPRRARLVVYNKRSNETSIWIVELSEVHAATRGGHHRGKVISSEVVHDVQPSMDAMEYAECEAAVKNYPAFIEAMRKRGVEDMDLVMVDAWCVGYYSDADGPSRRLAKPLIFCRTESDCPMENGYARPVEGIHVLVDIQNNVIIEFEDRKLVPLPPADPLRNYTAGEMRGGIDRSDVKPLHILQPEGPSFRVNGYFVQWQKWNFRIGFTPREGLVIHSVAYIDGSRGRRPIAHRLSFVEMVVPYGDPNEPHYLKNAFDAGEDGLGKNAHSLKKGCDCLGYIKYFDAHFTNYTGGVETIENCVCLHEEDHGILWKHQDWRTGLAEVRRSRRLSVSFICTVANYEYGFFWHFYQDGKIEAEVKLTGILSLGALQPGESRKFGTTIAPGLYAPVHQHFFVARMNMAVDCKPNEAFNQVVEVNVKVEEPGKDNIHNNAFYAEEKLLRSELQAMRDCQPLSARHWIVRNTRTVNRTGQPAGYKLMPGSNCLPLAGPEAKFLRRAAFLKHNLWVTSYKHDEMYPGGEFPNQNPRINEGLATWVRKNRSLEETDIVLWYVFGITHIPRLEDWPVMPVEHIGFLLMPHGFFNCSPAVDVPPSPNEADKECGAPKLMHNGLVAKL

SEQ ID NO: 10152 - protein, 705 aa, Capsicum annuum
MHRAHTCHPLDPLSAAEISVAVATVRAAGDSPEVRDGMRFVEVVLLEPDKAFVALADAYFFPPFQSSLMPRTKGGLPVPTKLPPRRARLIVYNKKTNETSIWIVQLTEVHAATRGGQHKGKVISSKVVPDVQPPIDAQEYAECESVIKDYPPFVEAMKKRGIDDMDLVMVDPWCVGYHSEADAPSRRLAKPLVFCRTESDCPMENGYARPVEGIHVLVDVQKMQVLEFEDRKLVPLPPADPLRNYTAGETRGGVDRSDVKPLQISQPEGPSFRIDGNYVQWQKWNFRVGFTPREGLVIHSVGYLDGSRGRRSIAHRLSFVEMVVPYGDPNEPHYRKNAFDAGEDGLGKNAHSLKRGCDCLGYIKYFDANFTNFTGGVESIENCVCLHEEDHGMLWKHQDWRTGLAEVRRSRRLTVSFICTVANYEYGFYWHFYQDGKIEAEVKLTGILSLGALQPGESRKYGTTIKPGLYAPVHQHFFVARMNMAVDSKPGDAHNQIVEVNVKVEEPGKENIHNNAFYAEETLLRSELQAMRDCDPLSARHWIVRNTRTSNRTGQLTGYKLVPGQNCLPLAGPEAKFLRRAAFLKHNLWVTQYAAGEDFPGGEFPNQNPRVGEGLASWVKEDRSLEESDIVLWYVFGITHVPRLEDWPVMPVEHIGFMLQPHGFFNCSPAVDVPPPRGCDSESKDSDVSENGVAKSTSTGLMAKL

SEQ ID NO: 10153 - protein, 393 aa, Sciadopitys verticillata
MKKRGIEDMDLVMVDPWCVGYHGEEDAPSRRLARPLIFCRTESDCPMENGYARPVEGIHVLVDMQKMEVIEFEDRKLVPLPPPDPLRNYTAGQSRGGVDRSDVKPLHILQPEGPSFRVNGYHVEWQKWNFRVGFTPREGLVIHSVAYDDGSRGRRSVAHRLSFVEMVVPYGDPNVPHYRKNAFDAGEDGLGKNAHSLKKGCDCLGYIKYFDAHFTNFTGGVETIENCVCLHEEDNGVLWKHQDWRTGLAEVRRSRRLTVSFICTVANYEYGFFWHFYQDGKIEAEVKLTGILSLGAVQQGETRKYGTTIAPGLYAPVHQHFFVARMDMAVDCKPGEAVNQVVEVNVNVEDLVPIIFTTTHFTPKKICYDLNYKLREILIHCLPGTGLLGTQGL

SEQ ID NO: 10154 - protein, 355 aa, Cedrus atlantica
MASASKETTICCQSGASAPDLAAKASSSSSPSLRREAASAEVPLAEEWGVNTDLGEEKRKRNSETRIPAAVLSSMDTIAEASIAAAKGTAMQMLRAHPRHPLDPLSAAEIAVAVATVRAAGATPEMRDGMRFIEVVLKEPDKHVVALADAYFFPPFQPSLLPKTKGGPVIPRQLPPRQARIIVYNKRSNETSVWIVELLEVHAAARGGHHRGKVISSKVIEDVQPPMDAIEYADCESVVKDYPPFKEAMKKRGIDDMDLVMVDPWCVGYYLEEDAPSRRLARPLIFCRTESDCPMENGYARPVEGIHVLVDMQKMEVVELKIKSLFPCLPQIPLETTLQEKHVVEWIGVMSNHCK

SEQ ID NO: 10155 - protein, 751 aa, Populus trichocarpa
MASTSKKTTPSPPCCDSTTPAPPPIRRDATSSSSLVPQDWTVPSADRRPVVDSLPEPSKTASAVIPVMLRAQTSHPLDPLSAAEISVAVATVRAAGATPELRDSMRFVEVVLFEPDKHVVALADAYFFPPFQPSLLPRSKGGPIIPTKLPPRRARLVVYNKRSNETSLWIVELSEVHAATRGGHHRGKVISSQVVPDVQPPMDAVEYAECEAVVKDFPPFREAMKKRGIEDMDLLMVDAWCVGYHSDADAPSRRLAKPLIFCRTESDCPMENGYARPVEGIHVLVDMQNMRVIEFEDRKLVPLPPADPLRNYTPGETRGGVDRSDVKPLQIIQPEGPSFRANGHYVEWQKWNFRIGFTPREGLVIHSVAYVDGSRGRRPIAHRLSFVEMVVPYGDPNEPHYRKNAFDAGEDGLGKNAHSLKKGCDCLGFIKYFDAHFTNFTGGIETIENCVCLHEEDHGILWKHQDWRTGLAEVRRSRRLTDGKIEAEVKLTGILSLGALQPGETRKYGTTIAPGLYAPVHQHFFVARMDMAVDCRPGEAFNQVVEVNVEVEKPGEKNVHNNAFYAKETLLRSELEAMRACNPQTARHWIVRNTRTVNRTGQLTGYKLVPGSNCLPLAGSEAKFLRRAAFLNHNLWVTPYTHGEMFPGGEFPNQNPRVDEGLATWVKQNRPLEETDIVLWYVFGITHVPRLEDWPVMPVERLGFMLMPHGFFNCSPAVDVPPSTCELDAKDNDVKDNGVTKPLQNGVLAKL

SEQ ID NO: 10156 - protein, 699 aa, Chrysanthemum coronarium
MVKAQTRHPMDPLAAAEISIAVATVRAAGATPEVRDSMRFIEVVLVEPDKNVVALADAYFFPPFQPSLLPRTKGGPIIPTKLPPRQARLIVYNKKSNETSIWIVELSEVHALTRGGHHRGKVISSKVVPDVQPPMDAVEYAECEAIVKEYPPFREAMKRRGIDDLDLVMVDPWCVGYHSEADAPNRRLAKPLIFCRTESDCPMENGYARPVEGIDVLVDMQNMVVIEFKDRKLVPLPPADPLRNYTAGETRGGVDRSDVKPLNIVQPDGPSFRVNGHFVQWQKWNFRIGFTPREGLVIYSVAYVDGNRGRRPVAHRLSFVEMVVPYGDPNDPHYRKNAFDAGEDGLGKNAHSLKKGCDCLGYIKYFDAHLTNFTGGVETIEDCICLHEEDHGILWKHQDWRTGLAEVRRSRRLVVSFICTVANYEYGFYWYFYQDGKIEAEVKLTGILSLGALQPGEVRKYGTMIAPGLYAPVHQHFFVARMDMSVDCKPGESHNQVVELDVKVEEPGDANVHNNAFYAEETLLKSELEAIRDCNSACARHWIIRNTRTVNRTGQLTGYKLVPGSNCLPLGGAEAKFLRRAAFLMHNLWVTAYDPEEMFPGGEFPNQNPRVGEGLATWVKKNRSLEETDLVLWYVFGVTHVPRLEDWPVMPVEHIGFRLMPHGFFNSSPAVDVPPSSMTDSELKENGLVDKSCHTGLVA

SEQ ID NO: 10157 - protein, 701 aa, Chrysanthemum coronarium
MVKAQTRHPMDPLAAAEISIAVATVRAAGATPEVRDSMRFIEVVLVEPDKNVVALADAYFFPPFQPSLLPRTKGGPIIPTKLPPRQARLIVYNKKSNETSIWIVELSEVHALTRGGHHRGKVISSKVVPDVQPPMDAVEYAECEAIVKEYPPFREAMKRRGIDDLDLVMVDPWCVGYHSEADAPNRRLAKPLIFCRTESDCPMENGYARPVEGIDVLVDMQNMVVIEFKDRKLVPLPPADPLRNYTAGETRGGVDRSDVKPLNIVQPDGPSFRVNGHFVQWQKWNFRIGFTPREGLVIYSVAYVDGNRGRRPVAHRLSFVEMVVPYGDPNDPHYRKNAFDAGEDGLGKNAHSLKKGCDCLGYIKYFDAHLTNFTGGVETIEDCICLHEEDHGILWKHQDWRTGLAEVRRSRRLVVSFICTVANYEYGFYWYFYQDGKIEAEVKLTGILSLGALQPGEVRKYGTMIAPGLYAPVHQHFFVARMDMSVDCKPGESHNQVVELDVKVEEPGDENVHNNAFYAEETLLKSELEAIRDCNSACARHWIIRNTRTVNRTGQLTGYKLVPGSNCLPLGGAEAKFLRRAAFLMHNLWVTQYDPEEMFPGGEFPNQNPRVGEGLATWVKKDRSLEETDLVLWYVFGVTHVPRLEDWPVMPVEHIGFRLMPHGFFNSSPAVDVPPSSMTDSELKENGLVDKSCHTGLVAKM

SEQ ID NO: 10158 - protein, 760 aa, Petroselinum crispum
MASSATTQKAKPLVAGADAIAGDQIQLSTRTSLASALIRPVDSISQPSSASTSTKGIASLFRAQTRHPLEPLAAAEISVAVATVRAAGATPEVRDSMRFVEVALVEPDKHVVALADAYFFPPFQPSLLPRTKGGPVLPTKLPPRQARLVVYNKKSNETSIWIVELLEVHAVTRGGHHRGKVISSKVVPDVQPPMDAMEYAECEAIVKEFPPFQEAMKRRGIEDMDLVMVDPWCVGYHSESDAPNRRLAKPLIFCRTESDCTLENGYARPVEGIHVLVDMQNMIVVEFVDRKLIPLPPADPLRNYAAAESRGGVDRSDVKPLNIIQPEGPSFRVNGHFVEWQKWNFRIGFTPREGLVIYSVAYVDGSRGRRPVAHRLSFVEMVVPYGDPNDPHYRKNAFDAGEDGLGKNAHSLKKGCDCVGFIKYFDAHFTNFTGGIETIENCVCLHEEDHGILWKHQDWRTGLAEVRRSRRLTVSFICTVANYEYGFFWHFYQDGKIEAEVKLTGILSLGALQPGEVRKYGTTIAPGLYAPVHQHFFVARMDMAVDCKPGEAHNQVVEVNVIVEEPGENNVHNNAFYAEEKLLKSEEEAMRDCNSLSARHWVIRNTRTVNRTGQLTGYKLLPGSNCLPLAGAEAKFLRRAAFLKHNLWVTPYSRDEMFPGGEFPNQNPRVGEGLATWVKQNRSLEETDVVLWYVFGVTHVPRLEDWPVMPVDRIGFMLLPHGFFNRSPAVDVPPASSSDSDLKDDVLVAKVCHDGLIAKL

SEQ ID NO: 10159 - protein, 698 aa, Musa acuminata
MMRAQTRHPLDPLSAAEISVAVATVRSAGATPEVRDSMRFVEVVLLEPEKNIVALADAYFFPPFQPSLLPRTKGGPVILSKLPPRRARLVVYNKKSNETSIWIVELSEVHAATRGGHHRGKVISSEVVPDVQPPMDAIEYAECEAAVKNYPPFIEAMRKRGVDDMDLVMVDAWCAGYHSDADAPSRRLAKPLIFCRTESDCPVENGYARPVEGIYILVDMQNNLIIEFEDRKLVPLPPADPLRNYTPGETRGGVDRSDIKPLHILQPEGPSFRINGYFVEWQKWSFRIGFTPREGLVIHSVAYIDGSRGRRPVAHRLSFVEMVVPYGDPNEPHYRKNAFDAGEDGLGKNAHSLKRGCDCLGYIKYFDAHFTNYTGGIETIENCVCLHEEDHGILWKHQDWRTGLAEVRRSRRLTVSFICTVANYEYGFFWHFYQDGKIEAEVKLTGILSLGALQPGESRKYGTTIAPGLYAPVHQHFFVARMDMAVDCKPTEAFNQVIEVNAKVEDPGQNNVHNNAFYAEEKLLKSELEAMRDCDPFSARHWIVRNTRTVNRTGQPTGYKLMPGLNCLPLAGPEAKFLRRAAFLKHNLWVTPYSRDEMYPGGEFPNQNPRINEGLVTWVKKNRSLEEADIVLWYVFGITHIPRLEDWPVMPVDRIGFMLMPHGFFNCSPAVDVPPSANEIDKDGGSPKLIQNGLLAKL

SEQ ID NO: 10160 - protein, 701 aa, Chrysanthemum coronarium
MVKAQTRHPMDPLAAAEISIAVATVRAAGATPEVRDSMRFIEVVLVEPDKNVVALADAYFFPPFQPSLLPRTKGGPIIPTKLPPRQARLIVYNKKSNETSIWIVELSEVHALTRGGHHRGKVISSKVVPDVQPPMDAVEYAECEAIVKEYPPFREAMKRRGIDDLDLVMVDPWCVGYHSEADAPNRRLAKPLIFCRTESDCPMENGYARPVEGIDVLVDMQNMVVIEFKDRKLVPLPPADPLRNYTAGETRGGVDRSDVKPLNIVQPDGPSFRVNGHFVQWQKWNFRIGFTPREGLVIYSVAYVDGNRGRRPVAHRLSFVEMVVPYGDPNDPHYRKNAFDAGEDGLGKNAHSLKKGCDCLGYIKYFDAHLTNFTGGVETIEDCICLHEEDHGILWKHQDWRTGLAEVRRSRRLVVSFICTVANYEYGFYWYFYQDGKIEAEVKLTGILSLGALQPGEVRKYGTMIAPGLYAPVHQHFFVARMDMSVDCKPGESHNQVVELDVKVEEPGDENVHNNAFYAEETLLKSELEAIRDCNSACARHWIIRNTRTVNRTGQLTGYKLVPGSNCLPLGGAEAKFLRRAAFLMHNLWVTQYDPEEMFPGGEFPNQNPRVGEGLATWVKKDRSLEETDLVLWYVFGVTHVPRLEDWPVMPVEHIGFRLMPHGFFNSSPAVDVPPSSMTDSELKENGLVDKSCHTGLVSKM

SEQ ID NO: 10161 - protein, 790 aa, Abies balsamea
MASASKETTICCQSGASSPDLAGNVSSSSSPSLRREAASAEVPLAAEWDVNKDLAEEKRKRSTEARIPAAVLSSMDAIAEASKAAAKGTGMQMLRAHPRHPLEPLSAAEIAVAVSTVRAAGATPEVRDGMRFIEVVLKEPDKHIVALADAYFFPPFQPSLLPKTKGGPVIPRQLPPRQARIIVYNKRSNETSIWLVELLEVHAAARGGLHRGKVISSKVIEDVQPPMDAMEYADCESVVKDYPPFREAMKKRGIDDMDLVMVDPWCVGYYLEEDAPSRRLARPLIFCRTESDCPLENGYARPVEGIHVLVDMQKMEVVEFEDQKLIPLPPPDPLRNYTAGETRGGVDRSDVKPLQIIQPEGPSFRVNGYHVEWQKWNFRIGFTPREGLVIYSIAYDDGSRGRRSVAHRLSFVEMVVPYGDPNGPHYRKNAFDAGEDGLGKNAHSLKKGCDCLGYIKYFDAHFTNFTGGVDTIENCVCLHEEDHGILWKHQDWRTGLAEVRRSRRLTVSFICTVANYEYGFFWHFYQDGKIEAEVKLTGILSLGALQHGESRKYGTMIAPGLYAPVHQHFFVARMDMAVDCKPGEPVNQVVEVNVKVEEPGSDNIHNNAFYAEEELLRTESQAQRDCNSLSARHWIVRNTRTVNRTGQLTGYKLVPGSNCLPLAGSEAKFLRRAAFLQHNLWVTQYNKDEQYPGGEFPNQNPRVGEGLHTWVKQNRNLEEADVVLWYVFGITHVPRLEDWPVMPVERIGFMLSPHGFFNCSPAVDVPPSIGECEKESVGPKINQTGIISKL

SEQ ID NO: 10162 - protein, 816 aa, Manihot esculenta
MASTTKKTTPPSSCCASPSDSAPIRRGAAPAPSSVVPNAVLDWSDRRLEDQLGEKTAIASLIRPVDSLPEPSTNPATKAGMPVMLRAQTSHPLDPLSAAEISVAVATVRAAGATPEVRDSMRFIDVVLLEPDKHVVALADAYFFPPFQPSLLPRTKGGPVIPTKLPPRRARLVVYNKRSNETSIWIVELSEVHAVTRGGHHRGKVILSQVVPDVQPPMDAVEYAECEAVVKDFPPFREAMKKRGIEDMELVMVDAWCVGYHSEADAPSKRLAKPLIFCRTESDCPMENGYARPVEGIYVLVDMQNMKVIEFEDRKLVPLPPADPLRNYTPGETRGGVDRSDVKPLQIVQPEGPSFRVNGYFVEWQKWNFRIGFTPREGLVIHSVAYIDGSRGRRPVAHRLSFVEMVVPYGDPNDPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFFWHFYQASRKLHYFYSDGKIEAEVKLTGILSLGALQPGETRKYGTTIAPGLYAPVHQHFFVARMNMAVDCKPGEAFNQVVEVDVKVEKPGENNVHNNAFYAEETLLRSELQAMRECNPLTARHWIVRNTRTVNRMGQLAGYKLVPGSNCLPLAGPEAKVLRRAAFLKHNLWVTPYAYDEMFPGGEFPNQNPRVGEGLATWLFIIINTIIQIVSFFAFFGCSYSNVMMLNLLPCWYVFGITHVPRLEDWPVMPVERIGFMLMPHGFFNCSPAVDVPPNACELDTKETDVKDSGVAKPLQTVMLAKL

SEQ ID NO: 10163 - protein, 701 aa, Chrysanthemum coronarium
MVKAQTRHPMDPLAAAEISIAVATVRAAGATPEVRDSMRFIEVVLVEPCKNVVALADAYFFPPFQPSLLPRTKGGPIIPTKLPPRQARLIVYNKKSNETSIWIVELSEVHALTRGGHHRGKVISSKVVPDVQPPMDAVEYAECEAIVKEYPPFREAMKRRGIDDLDLVMVDPWCVGYHSEADAPNRRLAKPLIFCRTESDCPMENGYARPVEGIDVLVDMQNMVVIEFKDRKLVPLPPADPLRNYTAGETRGGVDRSDVKPLNIVQPDGPSFRVNGHFVQWQKWNFRIGFTPREGLVIYSVAYVDGNRGRRPVAHRLSFVEMVVPYGDPNDPHYRKNAFDAGEDGLGKNAHSLKKGCDCLGYIKYFDAHLTNFTGGVETIEDCICLHEEDHGILWKHQDWRTGLAEVRRSRRLVVSFICTVANYEYGFYWYFYQDGKIEAEVKLTGILSLGALQPGEVRKYGTMIAPGLYAPVHQHFFVARMDMSVDCKPGESHNQVVELDVKVEEPGDENVHNNAFYAEETLLKSELEAIRDCNSACARHWIIRNTRTVNRTGQLTGYKLVPGSNCLPLGGAEAKFLRRAAFLMHNLWVTQYDPEEMFPGGEFPNQNPRVGEGLATWVKKDRSLEETDLVLWYVFGVTHVPRLEDWPVMPVEHIGFRLMPHGFFNSSPAVDVPPSSMTDSELKENGLVDKSCHTGLVSKM

SEQ ID NO: 10164 - protein, 721 aa, Cucumis sativus
MLRAQSRHPLDPLSAAEISVAVATVRAAGATPEVRDSMRFIEVVLLEPEKHVVALADAYFFPPFQPSLLPKTKGGPVIPTKLPPRRARIVVYNKKSNETSIWVVELSEVHAVTRGGHHRGKVISSSVVPEVQPPMDAAEYAECEAIVKEYPPFIEAMKKRGIEDMDLVMVDPWCVGYHSEVDAPGRRLAKPLIFCRTESDCPMENGYARPVEGIHVLVDMQNMVIIEFEDRKLVPLPPADPLRNYTSGETRGGVDRSDVKPLQIVQPEGPSFRVNGYYVEWQKWNFRIGFTPREGLVIYSIAYVDGSRGRRPVAHRLSFVEMVVPYGDPNDPHYRKNAFDAGEDGLGKNAHSLKKGCDCLGYIKYFDAHFTNFTGGVETIENCVCMHEEDHGILWKHQDWRTGLAEVRRSRRLTVSFICTVANYEYGFFWHFFQASQIIPLFWIGADQDGKIEAEVKLTGILSLGALQPGEYRKYGTMIAPGLYAPVHQHFFVARMDMAVDCKPGEAFNQVVEVDLKVEGPGENNVHNNAFYAEETLLKSEMQAMRDCSPLSARHWIVRNTRTVNRTGQLTGFKLLPGSNCLPLAGSEAKFLRRASFLKHNLWVTQYSRDEMFPGGEFPNQNPRVGEGLSTWVKKDRPLEETDIVLWYVFGITHVPRLEDWPVMPVDRIGFTLLPHGFFNCSPAVDVPPSTCELDSKDSKDADPKENVVTKPIQTPIIAKL

SEQ ID NO: 10165 - protein, 792 aa, Oryza sativa
MAATQEKAPVVVCCGGGGAAAARRVDGGPGSSSRGAIVAAPAAAAAAGKVSMVSGDDPRVAAAAGGGGGAVMEEIAAAVQPTTAKVSSKGIPIMTRAQRSHPLDPLSAAEIAVAIATVRAAGKSPEERDGMRFVEVVLLEPEKNVVALADAYFFPPFQPSLLPRTKGSAVIPSRLPPRRAKLTVYNRQSNETSIWIVELSEVHAATRGGHHRGKVISSEVVPEVQPAMDAMEYAECEATVKSYPPFIEAMKRRGVDDMELVMVDAWCAGYYSDADAPSRRLGKPLIFCRTDSDSPMENGYARPVEGIHVIVDMQNNVVIEFEDRKLVPLPPPDHLRNYTPGETRGGVDRSDLKPLIINQPEGPSFRINGYFVEWQKWNFRIGFTPKEGLVIYSVAYVDGSRGRRPIAHRLSFVEMVVPYGDPNEPHYRKNAFDAGEDGLGKNAHSLKRGCDCLGFIKYFDAHFTNFTGGVETIENCVCLHEEDHGILWKHQDWRTGLAEVRRSRRLTVSFICTVANYEYGFYWHFYQDGKIEAEVKLTGILSLGALMPGESRKYGTTIAPGLYAPVHQHFFVARMDMAVDCKPNEAHNQVVEVNVKVENAGTHNVHNNAFYAEEKLLKSELQAMRDCDPSSARHWIVRNTRAVNRTGQPTGYRLVPGSNCLPLALPEAKFLRRAGFLKHNLWVTQYKSDEVFPGGEFPNQNPRIHEGLATWVKKDRPLEETDIVLWYVFGLTHIPRLEDWPVMPVERIGFMLMPHGFFNCSPAVDVPPGSSDADIKEAESPKVIQNGLISKL

SEQ ID NO: 10166 - protein, 788 aa, Pinus taeda
MASTSKETTICCQSGASSTDLVAKASSSSTPSLRREAASAEVPLAAEWNVNQDLGEEKRKRNSEARIPSAVLSSMDAIAEASKAAGPVMQMLRAHPRHPLDPLSAAEIAVAVATVRAAGTTPEVRDGMRFIEVVLKEPDKHVVALADAYFFPPFQPSLLPKTKGGPVIPRQLPPRQARIIVYNMRSNETSVWIVELLEVHAAARGGHHRGKVISSKVIEDVQPPMDAIEYADCESVVKDYPPFKEAMKKRGIDDMDLVMVDPWCVGYYKEEDAPSRRLARPLIFCRTESDCPMENGYARPVEGIHVLVDMQKMEVVEFEDQKLIPLPPPDPLRNYTAGETRGGVDRSDVKPLQIIQPEGPSFRVNGYHVEWQKWNFRVGFTPREGLVIYSIAYDDGSRGRRSVAHRLSFVEMVVPYGDPNGPHYRKNAFDAGEDGLGKNAHSLKKGCDCLGYIKYFDAHFTNFTGGVDTIENCVCLHEEDHGILWKHQDWRTGLAEVRRSRRLTVSFICTVANYEYGFFWHFYQDGKIEAEVKLTGILSLGALQHGESRKYGTMIAPGLYAPVHQHFFVARMDMAVDCKPGEPVNQVVELNVKVEEPGPNNIHSNAFYAEEQVLRTESQAQRDCNPLSARHWIVRNTRTVNRTGQLTGYKLVPGSNCLPLAGSEAMFLRRAAFLQHNLWVTQYHKDEQYPGGEFPNQNPRVGEGLPTWVKQNRNLEEADIVLWYVFGLTHVPRLEDWPVMPVERIGFMLMPHGFFNCSPAVDVPPSIGECEKESVGPKINQTGILSKL

SEQ ID NO: 10167 - protein, 701 aa, Chrysanthemum coronarium
MVKAQTRHPMDPLAAAEISIAVATVRAAGATPEVRDSMRFIEVVLVEPCKNVVALADAYFFPPFQPSLLPRTKGGPIIPTKLPPRQARLIVYNKKSNETSIWIVELSEVHALTRGGHHRGKVISSKVVPDVQPPMDAVEYAECEAIVKEYPPFREAMKRRGIDDLDLVMVDPWCVGYHSEADAPNRRLAKPLIFCHTESDCPMENGYARPVEGIDVLVDMQNMVVIEFKDRKLVPLPPADPLRNYTAGETRGGVDRSDVKPLNIVQPDGPSFRVNGHFVQWQKWNFRIGFTPREGLVINFVAYVDGNRGRRPVAHRLSFVEMVVPYGDPNDPHYRKNAFDAGEDGLGKNAHSLKKGCDCLGYIKYFDAHLTNFTGGVETIEDCICLHEEDHGILWKHQDWRTGLAEVRRSRRLVVSFICTVANYEYGFYWYFYQDGKIEAEVKLTGILSLGALQPGEVRKYGTMIAPGLYAPVHQHFFVARMDMSVDCKPGESHNQVVELDVKVEEPGDANVHNNAFYAEETLLKSELEAIRDCNSACARHWIIRNTRTVNRTGQLTGYKLVPGSNCLPLGGAEAKFLRRAAFLMHNLWVTQYDPEEMFPGGEFPNQNPRVGEGLATWVKKDRSLEETDLVLWYVFGVTHVPRLEDWPVMPVEHIGFRLMPHGFFNSSPAVDVPPSSMTDSELKENGLVDKSCHTGLVAKM

SEQ ID NO: 10168 - protein, 700 aa, Panicum virgatum
MTRAQRCHPLDPLSAAEIAVAVATVRAAGRSPEERDSMRFVEVVLLEPEKNVVALADAYFFPPFQPSLLPRSKGSAVIPSRLPPRRARLVVYNKQSNETSIWIVELSEVHAATRGGHHRGKVISSGVVPDVQPAMDAMEYAECEATVKSYPPFIEAMKRRGVDDMDLVMVDAWCAGYYGEADAPSRRLGKPLIFCRTESDSPMENGYARPVEGIHVVVDMQNNTVIEFEDRKLVPLPPPDHLRNYTPGETRGGVDRSDVKPLIINQPEGPSFRINGYFVEWQKWNFRIGFTPKEGLVIYSVAYVDGSRGRRPIAHRLSFVEMVVPYGDPNEPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFYWHFYQDGKIEAEVKLTGILSLGALMPGESRKYGTTIAPGLYAPVHQHFFVARMDMAIDCKPNEAYNQVVEVNVKVESAGTHNVHNNAFYAEEKLLKSELQAMRDCDPSSARHWIVRNTRTVNRTGQPTGYRLVPGSNCLPLALPEAKFLRRAGFLKHNLWVTQYKSDEIFPGGEFPNQNPRIHEGLATWVQKDRPLEETNIVLWYMFGLTHIPRLEDWPVMPVERIGFMLMPHGFFNCSPAVDVPPSSSDPDVKEAESPKAIQNGSLISKL

SEQ ID NO: 10169 - protein, 700 aa, Capsicum annuum
MPRAQTCHPLDPLSAAEISVAVAGETPEVRDGMRFIEVVLLEPDKSVVALADAYFFPPFQSSLMPKTKGGSLIPTKLPPRRSRLIIYNKKTNETSIWIVELTEVHAAARGGHHRGKVISSNVVPDVQPPIDAQEYAECEAVVKNYPPFREAMKRRGIDDMDLVMVDPWCVGYHSEADAPSCRLAKPLVFCRTESDCPMENGYARPVEGIYVLVDVQNMQIIEFEDRKLVPLPPVDPLRNYTAGETRGGVDRSDVKPLHIIQPEGPSFRISGNYVEWQKWNFRIGFTPREGLVIHSVAYLDGSRGRRPIAHRLSFVEMVVPYGDPNDPHYRKNAFDAGEDGLGKNAHSLKRGCDCLGYIKYFDAHFTNFMGGVETTENCVCLHEEDHGILWKHQDWRTGLTEVRRSRRLTVSFVCTVANYEYAFYWHFYQDGKIEAEVKLTGILSLGALQPGESRKYGTTIKPGLYAPVHQHFFVARMNMAVDSKPGDAHNQIVEVNVKVEEPGKENIHNNAFYAEETLLRSELQAMRDCDPLSARHWIVRNTRTSNRTGQLTGYKLVPGPNCLPLAGPEAKFLRRAAFLKHNLWVTQYAPGEDFPGGEFPNQNPRAGEGLASWVKQDRPLEESDVVLWYIFGITHIPRLEDWPVMPVEHIGFMLQPHGFFNCSPAVDVPPPLGCDLESRDSDVTENSVAKHTPTGLMAKL

SEQ ID NO: 10170 - protein, 705 aa, Trifolium pratense
CCSKVATVTATVAASATSSNVLQQKQQPPFISAVDSRLDPPPKSASSKGITVMAKAQTLHPLDPLTAAEISVAVATVRAAGATPEVRDSMRFIEVDLVEPEKQVVALADAYFFPPFQPSLLPRTKGGPVIPSKLPPRKARLVVYNKKSNETSIWIVELTEVHATTRGGHHRGKVISSTIVPDVQPPMDAVEYAECEAVVKDYPPFREAMKKRGIEDMDLVMVDPWCAGYHSEGDAPSRRLAKPLFFCRTESDCPMENGYARPVEGIHVLVDMQNMVVLEFEDRKLVPLPQADPLRNYTSGETRGGVDRSDVKPLQIIQPDGPSFRVNGNFVQWQKWNFRIGFTPREGLVVYSVAYIDGSRGRRPVAHRLSFVEMVVPYGDPNDPHYRKNAFDAGEDGLGKNAHSLKKGCDCLGYIKYFDAHFTNFYGSVETIENCVCMHEEDHGMLWKHQDWRTGLAEVRRSRRLTVSFICTVANYEYGFYWHFYQDGKIEAEVKLTGILSLGALQQGETRKYGTTIAPGLYAPVHQHFFVARMDMAVDCKPGEAFNQVVEVNVKVEEPGKNNVHNNAFYAEEKLLKSELEAMRDCDPLSARHWIVRNTRSVNRTGHLTGYKLVPGSNCLPLAGSEAKFLRRAAFLKHNLWVTPYARDELHPGGEFPNQNPRVGEGLATWVKQNRPLEEADIVLWYVFGVTHIPRLEDWPVMPVE

SEQ ID NO: 10171 - protein, 771 aa, Brachypodium distachyon
MASAQEKATDCCRPARDAPGARRVIAAPGKVSMAPRGERVAAAAGGGAVMEEIATAVQPTTAKASSKGIPIMTRAQRFHPLDPLSAAEIAVAVATVRAAGKSPEERDSMRFVEAVLLEPEKNVVALADAYFFPPFQPSLLPRTKGSAVIPSRLPPRRAKLVVYNRHSNETTIWIVELSEVHAATRGGHHRGKVISSAVVPDVQPAMDAMEYAECEATVKNYPPFIEAMKRRGVDDMELVMVDAWCAGYYTDADAPSRRLARPLIFCRTESDSPMENGYARPVEGIHVVVDMQNDVVIEFEDRKFVPLPPPDHLRNYTPGETRGGVDRSDVKPLIIDQPEGPSFRINGYFVEWQKWNFRIGFTPKEGLVIYSVAYVDGSRGRRPIAHRLSFVEMVVPYGDPNEPHYRKNAFDAGEDGLGKNAHSLKKGCDCLGYIKYFDAHFTNFTGHVETIENCVCLHEEDHGILWKHQDWRTGLAEVRRSRRLTVSFICTVANYEYGFYWHFYQDGKIESEVKLTGILSLGALMPGESRKYGTTIAPSLYAPVHQHFFIARMDMAVDCKPNEAHNQVVEINVKVESAGTHNVHNNAFFAEEKILKSELEAMRDCDPSSARHWIVRNTRTVNRTGQPTGYRLVPGSNCLPLALPEAKFLRRAGFLKHNLWVTPYNSDEKFPGGEFPNQNPRIHEGLATWVKKDRPLEETDIVLWYVFGLTHIPRLEDWPVMPVERIGFMLMPDGFFNCSPAVDVPPGSSDVDAKEAESPKAIQNGGLVSKL

SEQ ID NO: 10172 - protein, 775 aa, Avena sativa
MASAQEKATSCCLPARDAPGGRRAIAVAGKVSSMSAAGGGERVVSAAGGGAVMEDSAAAVQPTTAKASSKGIPIMTRAQRFHPLDPLSAAEIAVAVATVRAAGKSPEERDGMRFVEAVLLEPEKNVVALADAYFFPPFQPSLLPRTKGSPVIPSRLPPRRAKLVVYNRRSNETTIWIVELSEVHAATRGGHHRGKVISSEVVPDVQPAMDAMEYAECEATVKNYPPFIEAMKKRGVDDMELVMVDAWCAGYYSDADAPSRRLARPLIFCLTESDSPMENGYARPVEGIHVVVDMQNSVVIEFEDRKFVPLPPPDHLRNYTPGETRGGVDRSDLKPLIIEQPEGPSFRINGYFVEWQKWNFRIGFTPKEGLVIYSVAYVDGSRGRRPIAHRLSFVEMVVPYGDPSEPHYRKNAFDAGEDGLGKNAHSLKKGCDCLGYIKYFDAHFTNFTGHVETIENCVCLHEEDHGILWKHQDWRTGLAEVRRSRRLTVSFICTVANYEYGFYWHFYQDGKIEAEIKLTGILSLGALMPGETRKYGTTIAPSLYAPVHQHFFIARMDMAVDCKPNEAHNQVVEVNVKVENAGTHNVHNNAFYAEEKILKSELEAMRDCDPSSARHWIVRNTRAVNRTGQPTGYRLVPGSNCLPFALPEAKFLRRAGFLKHNLWVTPYKSDEKFPGGEFPNQNPRLHEGLPTWVKKDRPLEETDIVLWYVFGLTHIPRLEDWPVMPVERIGFMLMPHGFFNCSPAVDVPPGTSDAADVKEADSPKVIQNGSLVSKL

SEQ ID NO: 10173 - protein, 95 aa, Nicotiana benthamiana
MAATLHKVTPPPPITTASCCPSASGSVIRRESAAASVVEDDQQKQTPALTSSVNSQPPSSNPSGKGKQIMPRAHTCHPLDPLSAVCGCGDRQSCR

SEQ ID NO: 10174 - protein, 697 aa, Cephalotaxus harringtonia
MMRAETKHPLDPLSAAEIAVAVTTVRAAGATPEVRDGMRFIEVVLKEPDKHIVALADAYFFPPFQPSLLPKTKGGPVIPRQLPPRLARIVVYNKRSNETSVWSVELSEVHAAARGGHHRGKVISSKVVEDVQPPMDAMEYADCESVVKDYAPFKEAMKKRGIEDMDLVMVDPWCVGYHGEEDAPSRRLARPLIFCRTESDCPMENGYARPVEGIHVLVDMQKMMVIEFEDRKLIPLPPPDPLRNYTAGETRGGVDRSDVKPLLIMQPEGPSFRVNGYHVEWQKWNFRVGFTPREGLVIHSVAYDDGSRGRRSVAHRLSFVEMVVPYGDPNAPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFFWHFYQDGKLEAEVKLTGILSLGALQQGETRKYGTMIAPGLYAPVHQQLFVARMDMAVDCKPGEAVNQVVEVNVDVEEPGANNIHNNAFYAKEDLLRTELQAQRDCNPLSARHWIVRNTRTVNRTGQLTGYKLVPGSNCLPLAGSEAKFLRRAAFLQHNLWVTPYNKDEQFPGGEFPNQNPRVGEGLPTWVKQNRQLEDADIVLWYVFGITHVPRLEDWPVMPVERIGFMLMPHGFFNCSPGVDVPPNTGESDLKENGGPKQNGIISKL

SEQ ID NO: 10175 - protein, 791 aa, Pseudotsuga menziesii
MASTSKETTICCKSGAPSPDLAAKDSSSSSAPSLRREAASAEVPLVTEWDVNKDLPKDKRNRSSEARIPSAVLSSMDAIAEASKAAAKGTVMQMLRANPRHPLDPLSAAEIAVAVSTVRAAGATPEVRDGMRFIEVVLKEPEKHIVALADAYFFPPFQPSLLPKTKGGPVIPRQLPPRQARIIVYNMRSNETSVWLVELLEVHAAARGGHHRGKVISSKVIEDVQPPMDAMEYADCESVVKDYTPFKEAMKKRGIDDMDLVMVDPWCVGYYLEEDAPRRRLARPLIFCRTESDCPMENGYARPVEGIHVLVDMQKMEVVEFEDQKLIPLPPPDPLRNYTAGETRGGVDRSDVKPLQIIQPEGPSFRVTGYHIEWQKWNFRIGFTPREGLVIYSVAYDDGSRGRRSVAHRLSFVEMVVPYGDPNAPHYRKNAFDAGEDGLGKNAHSLKKGCDCLGYIKYFDAHFTNFTGGVETIENCVCLHEEDHGILWKHQDWRSGLAEVRRSRRLTVSFICTVANYEYGFFWHFYQDGKIEAEIKLTGILSLGALQHGESRKYGTMIAPGLYAPVHQHFFVARMDMAVDCKPGEPVNQVVEVNVKVEEPGPNNIHNNAFYAEEELLRNELQAQRDCNPLSARHWIVRNTRTVNRTGQLTGYKLVPGSNCLPLAGSEAKFLRRAAFLQHNLWVTQYNKDEQYPGGEFPNQNPRVGEGLHTWVKQNRNLEEADIVLWYVFGITHVPRLEDWPVMPVERIGFMLSPHGFFNCSPAVDVPPSIGECEKESAGSKINQTGIISKL

SEQ ID NO: 10176 - protein, 486 aa, Chrysanthemum coronarium
MVKAQTRHPMDPLAAAEISIAVATVRAAGATPEVRDSMRFIEVVLVEPDKNVVALADAYFFPPFQPSLLPRTKGGPIIPTKLPPRQARLIVYNKKSNETSIWIVELSEVHALTRGGHHRGKVISSKVVPDVQPPMDAVEYAECEAIVKEYPPFREAMKRRGIDDLDLVMVDPWCVGYHSEADAPNRRLAKPLIFCRTESDCPMENGYARPVEGIDVLVDMQNMVVIEFKDRKLVPLPPADPLRNYTAGETRGGVDRSDVKPLNIVQPDGPSFRVNGHFVQWQKWNFRIGFTPREGLVIYSVAYVDGNRGRRPVAHRLSFVEMVVPYGDPNDPHYRKNAFDAGEDGLGKNDHSLKKGCDCLGSIKYFDAHLTNFTGGIETMEDCICLHEEDHGILWKHQDWRTGLAEVRRSRRLVVSFICTVANYEYGFYWYFYQDGKIEAEVKLTGILSLGALQPGEVRKYGTMIAPGLYAPVHQHFFCCSYGYVC

SEQ ID NO: 10177 - protein, 700 aa, Pennisetum glaucum
MTRAQRCHPLDPLSAAEIAVAVATVRAAGRSPEERDSMRFVEAVLLEPNKNVVALADAYFFPPFQPSLLPRTKGSAVIPSRLPPRRARLVVYNKQSNETSIWIVELSEVHAATRGGHHRGKVISAEVVPDVQPAMDAMEYAECEATVKSYPPFIEAMKRRGVDDMDLVMVDAWCAGYYGEADAPSRRLGKPLIFCRTESDSPMENGYARPVEGIHVIVDMQNNTVIEFEDRKLVPLPPPDHLRNYTPGETRGGVDRSDVKPLIISQPEGPSFRINGYFVEWQKWNFRIGFTPKEGLVIYSVAYVDGSRGRRPIAHRLSFVEMVVPYGDPSEPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFYWHFYQDGKIESEVKLTGILSLGALMPGESRKYGTTIAPGLYAPVHQHFFVARMDMAVDCKPNEAHNQVVEVNVKVESAGTHNVHNNAFYAEEELLKSELQAMRDCDPSSARHWIVRNTRTVNRTGQPTGYRLVPGSNCLPLALPEAKFLRRAGFLKHNLWVTQYKSDEMFPGGEFPNQNPRIHEGLPTWVKKDRPLEETDIVLWYVFGLTHIPRLEDWPVMPVEHIGFMLMPHGFFNCSPAVDVPPSSSDADIKEAESPKAIQTGGLISKL

SEQ ID NO: 10178 - protein, 803 aa, Musa acuminata
MCCQCSCIKSTKNNDEKKRKSNIKTKNFSRKFALHYVSTVSTLDSEKTESCLFPSLSLSLSLSLSYVVLCHIFDKDVEPANKYGFGFAVHPPPPPNPIALPPIPIVMRAQNSHPLDPLSAAEILVAVATVRAAGATPEVRDGMRFIEVVLLEPEKNVVALADAYFFPPFQPSLLPRTKGGPVILGKLPPRRARLVVYNKRSNETSIWIVELSEVHAATRGGRHRGKVISSEVVPVVQPSMDAMEYAECEAAVKSHLPFIEAMRKRGVEDMDLVMVDSWCVGFYSDADGPNRRLARPLIFCRTESDCPMENGYARPVEGIHVLVDIQNNVIIEFEDRKLVPLPPADPLRNYTPGETRGGIDRSDVKPLQILQPEGPSFRVNGYFVQWQKWNFRIGFTPREGLVIHSLAYVDGSRGRRPIAHRLSFVEMVVPHGDPNEPHYRKNAFDAGEDGLGKNAHSLKKGCDCLGYIKYFDAHFTNYTGGVETIENCVCLHEEDHGILWKHQDWRTGLAEVRRSRRLSVSFICTVANYEYGFFWHFYQDGKIEAEVKITGILSLGALGPGESRKYGTTIAPGLYAPVHQHFFVARMDMAVDCKPNEAFNQVVEVNVKVEEPGLHNIHNNAFYAEEKLLRSELQAMRDCNPSSARHWIVRNTRTVNRTGQPAGYKLMPGPNCLPLAGPEAKFFRRAAFLKHNLWVTSYKHDEMYPGGEFPNQNPRINEGLATWVKKNRSLEETNIVLWYVFGVTHIPRLEDWPVMPVERIGFMLMPHGFFNCSPSVDVPPSPSGAEEESVAPKLVPSLLLAKL

SEQ ID NO: 10179 - protein, 691 aa, Chrysanthemum coronarium
DPLAAAEISIAVATVRAAGATPEVRDSMRFIEVVLVEPDKNVVALADAYFFPPFQPSLLPRTKGGPIIPTKLPPRQARLIVYNKKSNETSIWIVELSEVHALTRGGHHRGKVISSKVVPDVQPPMDAVEYAECEAIVKEYPPFREAMKRRGIDDLDLVMVDPWCVGYHSEADAPNRRLAKPLIFCHTESDCPMENGYARPVEGIDVLVDMQNMVVIEFKDRKLVPLPPADPLRNYTAGETRGGVDRSDVKPLNIVQPDGPSFRVNGHFVQWQKWNFRIGFTPREGLVIYSVAYVDGNRGRRPVAHRLSFVEMVVPYGDPNDPHYRKNAFDAGEDGLGKNAHSLKKGCDCLGYIKYFDAHLTNFTGGVETIEDCICLHEEDHGILWKHQDWRTGLAEVRRSRRLVVSFICTVANYEYGFYWYFYQDGKIEAEVKLTGILSLGALQPGEVRKYGTMIAPGLYAPVHQHFFVARMDMSVDCKPGESHNQVVELDVKVEEPGDENVHNNAFYAEETLLKSELEAIRDCNSACARHWIIRNTRTVNRTGQLTGYKLVPGSNCLPLGGAEAKFLRRAAFLMHNLWVTQYDPEEMFPGGEFPNQNPRVGEGLATWVKKDRSLEETDLVLWYVFGVTHVPRLEDWPVMPVEHIGFRLMPHGFFNSSPAVDVPPSSMTDSELKENGLVDKSCHTGLVAKM

SEQ ID NO: 10180 - protein, 644 aa, Triticum aestivum
MSRNLKSPVQTQMGVSALSSSLIGDYPAKTRSEGRAVGWKRVFVQTDTGFVLPVQLDRGDSVHTVKRKLQVALNVPTEESSLTLGDHVLKNDLSSIRNDSPLLLTKTFMHRSSSSPCLSPTSKDLQQQRDRGSPIEVLVCPTRCIQAKQLVKDVARAIRNGVDPKLVNSGLGGAYYFKNSKGENAAIVKPNDEEPFAPNNPKGFTGRALGQPGLKRSVRVGETGFREVAAYLLDYDNFANVPPTVLVKISHPVFNVNEGVGSTNKKASVGDPRTVSKIASFQQFAPHDFDASDLGTSSFPVAAIHRIGILDIRIFNTDRHAGNLLVRKVTGADQFGNLTELIPIDHGLCLPECLEDPYFEWIHWPQASIPFSEDELEYIGKLDPVKDAEMLRMELPMIREACLRVLVLSTIFLKEGTLFGLCLAEIGEMMSREFNGMDDQPSQLEVVCMEARRLATEREECSTEHDSADEDVTQFELDCEDHEMPKTPPAYHFEFKGGSSRNPLSKLEEAIEEEEDDIQEEEESNAEKLACPKPVNKWLPNISKLSTSLSSVSLMDKSQRQVPAIPKGADSVKTSENNQVGNWRTANEQLPTSASFVKLADMGVDAWGLFLEKFQELLPGAFRAHKLGATGQRGRLRMGTSCQF

SEQ ID NO: 10181 - protein, 644 aa, Hordeum vulgare
MSRNLESPVQTQMAVSALSSSLIGDYPTKTRSEGRAVGWKRVFVQTDTGFVLPVQLDRGDSVHTVKRKLQVALNVPTEESSLTLGDHVLKNDLSSIRNDSPLLLTKTFMHRSSSSPCLSPTSKDLQQQRDRGGPIEVLVCPSRCFRAKQLVKDVARGIRNGVDPTLVNSGLGGAYYFKNSKGENAAIVKPNDEEPFAPNNPKGFTGRALGQPGLKRSVRVGETGFREVAAYLLDYDSFANVPPTVLVKISHPVFNVNEGVSSSKKKAPVGDPRAVSKIASFQQFAPHDFDASDLGTSSFPVSAIHRIGILDIRIFNTDRHAGNLLVKKMTGTGQFGNQTELIPIDHGLCLPECLEDPYFEWIHWPQASIPFSEDELEYIGKLDPVKDADMLRMELPMIREACLRVLVLSTIFLKEGTLFGLCLAEIGEMMSREFNGMEDQPSQLEVVCMEARRLATEREECSTEHDSADEDVTQFELDCEDHEMAKTPPAYHLEFKGGSSRNPLSKLDEAIEEEEDDTQEEEESNAEKLACPKPVNKWLPNISKLSTSLSSVSLMEKSQRQLPAIPKGADSAKTSENNQVGNWRSANEQLPTSASFVKLADMGVETWGLFLEKFQELLPGAFRAHKLGATGQRGRLRLGTSCQF

SEQ ID NO: 10182 - protein, 454 aa, Secale cereale
MMRSHLHPTIQKVLLGEPLGSQASKDQFELVRPVLERLLHTFWTMITLLIVPPTVLVKISHPVFNVNEGVGSTNKKASVGDPRTVSKIASFQQFAPHDFDASDLGTSSFPVSAIHRIGILDIRIFNTDRHAGNLLVRKVTGADQFENLTELIPIDHGLCLPECLEDPYFEWIHWPQASIPFSEDELEYIGKLDPVKDAEMLRMELPMIREACLRVLVLSTIFLKEGTLFGLCLAEIGEMMSREFNGMDDQPSQLEVVCMEARRLATEREECSTEHDSADEDVTQFELDCEDHEMPKTPPAYHFEFKGGSSRNPLSKLDEAIEEEEDDIQGEEESNAEKLACPKPVNEWLPNISKLSTSLSSVSLMDKSQRQLPAIPKGVDSAKTSENNQVGNWRTANEQLPTSASFVKLADMGVETWGLFLEKFQELLPGAFRAHKLGATGQRGWLRMGTSCQF

SEQ ID NO: 10183 - protein, 622 aa, Lolium multiflorum
MSRNLEGPVQTQMAVSALSSSLIGDPSKTRSDVRAVGWKRVFVQTDTGFVLAVQLDRGDNAHTVKRKLQLALNVPTEESSLTFGDHVLKNDLSSVRNDSPLLLTKTFMHRSSSTPCLSPTSKDLQQQRDRSGPIEVLVCPSRCSRAKQLVKDVARAIRNGVDPTPVNSGLGGAYYFRNSKGENAAIVKPNDEEPFAPNNPKGFTGRALGQPGLKRSVRVGETGFREVAAYLLDYGNFANVPPTVLVKISHPVFNVNESVSSTNKKASLGAARAVSKIASLQQFAPHDFDASDLGTSSFPVSAVHRIGILDIRIFNTDRHGGNILVRKVTGAGKFGNETELIPIDHGLCLPECLEDPYFEWIHWPQASIPFSEDELEYIANLDPVKDADMLRAELPMIREACLRVLILSTIFLKEGASFGLCLAEIGEMMSREFTRVDDQPSELEVVCMEARRLAAEREECSTEHDSGDEDITQFELDSEDDHEIHKTPSAYHFEFKGGSSRNPLSKLNEAIEEEEDDIEEEESSAEKLACPKPVNKWLPNISKLSTSLSGVSLMEKSQRQLPAVPKGADSVKTSESNNRTGPQVGNWRSANEQLPTSASFVKLADMGVETWGMFLEKFQELL

SEQ ID NO: 10184 - protein, 637 aa, Brachypodium distachyon
MPRNLESPVQTQMAVSALKSSLIGDYSDKTRSEGRGGGWKRVFVQTDTGFVLAVQLDRGDNAHTVKRKLQLALNVPTGESSLTFGDHVLKNDLSNVRNDSPLLLTKNFMHRSSSTPCLSPTSKDLQQQRDKGGPIEVLVCPSRCFRTKQLVKDVGRAIRNGVDPIPVNSGLGGAYYFRNCKGENAAIVKPNDEEPFAPNNPKGFTGRALGQPGLKRSVRVGETGYREVAAYLLDYDNFANVPPTVLVKIAHPVFNVNEGVRSTKKKVSGGDPQAVSKIASFQQFAPHDFDASDLGTSGFPVSSVHRIGILDIRIFNTDRHAGNLLVRNLTGAGKFGNQTELIPIDHGLCLPECLEDPYFEWIHWPQASIPFSEDELKYIADLDPVKDADMLRMELPMIREACLRVLMLSTIFLKEATSFGLCLAEIGEMMSREFTGAEDQPSELEVVCMEARRLATEREECSTENESGDEDVTQFQLDYEDHHEMPKGPSAYHFGFKGGSCRNPLSKLDEAIEEEEDDTEAEEEESNAEKLACPKPVNKWQPNILKLSTSLSSFSLTDKSQRQLPAVPKGTDPGNWRSANEQLPTSASFVKLADMGMETWGLFLEKFHELLPGAFNSRKCGATGQRAKQRLGTSCQF

SEQ ID NO: 10185 - protein, 650 aa, Oryza sativa
MSRNLESPVQTQMAVSALNRALSSEYPSKSRSEGRASGWKRIFVQTDTGCVLAVQLDRGDNAHTVKRKLQLALNVPTEESSLTFGDRVLKNDLSTIRNDSPLLLTKTFMHRSSSTPCLSPTGKDIQQQRDRGGPIELLVCPSRCSRTKQLVKDVARAIRNGVDPIPVNSGLGGAYYFRNSKGENAAIVKPNDEEPFAPNNPKGFTGKALGQPGLKRSVRVGETGFREVAAYLLDYDNSANVPPTVLVKISHPVFNVNECVSSANMKASKDYPGAVSKIASFQQFIPHDFDASDHGTSSFPVSAVHRIGILDIRIFNTDRHAGNLLVRKLTGPGKFGNQTELIPIDHGLCLPECLEDPYFEWIHWPQASIPFSDDELDYIANLDPMKDADMLRMELPMIREACLRVLILSTIFLKEATSFGLCLAEIGEMMSREFTGMEDQPSELEVVCMEARRLAIEREESSTEIDSGDEDATQFELDCEDDHEMLKAQPAYHFELKGGSSRNPLSKLDEAIEEEEDDIEEEESNAEKLGYPKAINKWLPNISKLSTSLNGVRLGDKIQCQLPAAPKIMDPVKIFEGNSNHSGSQVGNWRSANEQLPTSASFVKLADMGSETWALFLEKFQELLPEAFRSRKCGAAGQRARQRLGTSCQF

SEQ ID NO: 10186 - protein, 515 aa, Sorghum bicolor
MAPPISADALVVEAASAIAASPAIAPNGMVSRKDVAAAAAPAISVVSKQTVRPAAGASAPVVGGDLRLSVSDMPMLSCHYIQKGLFFPPPPPSVLTTTASLVSSLVTALSRALGVFPALAGRLVTLHDDSIVIRCGGGGDDADAAVEFYHAVAPSLSLGDFLVPGADVPTSLTNALFPMDRTVSYGGHARPLSSFQLTELGDGAVFVGFVANHAVVDGTSFWHFFNTWAGLCRGGGAPIREPDFRRNFFGESTAVLRFPGGVGPAVTFDSEAPLRERILHFSAAAIRELKATANHSKRTGHQDAEANGKLAHDDSKLLHGRCSGEISSFQSLCAHIWRAVTRARRLLAADKTTTFRMAVNCRHRLRPAISPLYFGNAIQSVATTATVAELASNDLGWAAARLHATVTSHEDGAIRRAAAEWEAAPRCFPLGNPDGAALTMGSSPRFPMYDGNDFGWGRALAVRSGRANKFDGKMSAFPGQAGDGSVDVEVCLAPDTMARLLLDEEFLQYVSSPAP

SEQ ID NO: 10187 - protein, 490 aa, Setaria italica
MAPPIPAADAVVEAASAVGAAPAIAPNGMARKDVPAPPPISVVSKQTVRPAGTSAVGDLRLSVSDMPMLSCHYIQKGLFFRPPGVVMASLVPSLVAALSRALGVFPALAGRLVTLDDDSIVIRCGGDAAVEFYHAVAPALSLGDFLVPGADVPIRLTNGLFPMDRTVSYGGHGRPLTSFQLTVLGDGAVFVGFVANHAVVDGTSFWHFFNTWAGLCRGAPVREPDFRRNFFGDSTAVLRFPGGVGPAVTFDAEAPLRERILHFSAAAIRELKATANRWKRTGQDSEVNGKVTHDSKVQCGCREISSFQSLCAHVWRAVTRARRLLAADKTTTFRMAVNCRHRLRPAISPLYFGNAIQSVATKATVAELASNDLGWAAAKLHATVAAHEDGAIRLAAAEWEAAPRCFPLGNPDGAALTMGSSPRFPMYDGNDFGWGRALAVRSGRANKFDGKMSAFPGQAGDGSVDVEVCLAPDTMACLLRDEAFLQYVTE

SEQ ID NO: 10188 - protein, 487 aa, Panicum virgatum
MAPPVPADAVVQAASAVAENGMARKDAPAPAISVVSRQTVRPAAGASPVGDLRLSVSDMPMLSCHYIQKGLFFPPPGVAMAPLVAALAAALSRALGVFPALAGRLVTLDDGSIVIRCGGDGAAVEFHHAVAPALSLGDFLVPGADVPTRLTNGLFPMDRTVSYGGHARPLTSFQLTVLGDGAVFVGFVANHAVVDGTSFWHFFNTWAGLCRGAPVREPDFRRNFFGESTAVLRFPCGGGPAVTFDADAPLRERILHFSAAAIRELKATANRWKGTGQDSEVNGKATHDSKVQGGRGQISSFQSLCAHIWRAVTRARRLLAADKTTTFRLAVNCRHRLHPPISPLYFGNAIQSVATTATVAELASNDLGWAAAKLHATVAAHEDGAIRRAAAEWEAAPRCFPLGNPDGAALTMGSSPRFPMYDGNDFGWGRALAVRSGRANKFDGKMSAFPGQAGDGSVDVEVCLAPDTMACLLRDEAFLQFVSTPAP

SEQ ID NO: 10189 - protein, 503 aa, Panicum virgatum
MPIYNVLTPHRASPPHTAIAADKRGPRMAPPVPAENGMARKDALAPAISVVSKQTVRPAAGASAVGDLRLSVSDMPMLSCHYIQKGLFFPPPGVAMGPLVSSLAAALSRALGVFPALAGRLVTLDDGSIVIRCGGDGAAVEFCHAVAPALSLGDFLVPGADVPTRLTNALFPMDRTVSYGSHARPLTSFQLTVLRDGAVFVGFVANHAIVDGTSFWHFFNTWAGLCRGAPVREPDFRRNFFGESTAVLRFPGGGGPAVTFDADAPLRERILHFSAAAIRELKATANRWKGTGQDSEVNGKATHDSKVQGGRGQISSFQSLCAHIWRAVTRARRLLAADKMTTFRMAVNCRHRLHPPISPLYFGNAIQSVATTATVAELASNDLGWAAAKLHATVAAHEDGAIRRAAAEWEAAPRCFPLGNPDGAALTMGSSPRFPMYDGNDFGWGRALAVRSGRANKFDGKMSAFPGQAGDGSVDVEVCLAPDTMACLLRDEAFLQFVSTPAP

SEQ ID NO: 10190 - protein, 480 aa, Oryza sativa
MVEAASAAPATVVVPLTQTLCANAPATSVTVVSKQTVRPDGASAVGDVKLSVSDMPMLSCHYIQKGLFFPPPGVPIASLVSSLVCALSRALAVFPALAGRLVTLDDGRIVIRCDGVAVEFYHAVAPALSLGDFLVPNADVPTRLTKDLFPMDRTVSYDGHRRPLTSFQLTVLGDGAVFVGFVANHAVVDGTSFWHFFNTWAGLCRGTPVQPPDLRRNFFGDSTAVIRFPGGAGPAVTFDADAPLRERVLHFSAAAIRELKAKANQWKRSDKFAEANGKHVDETKAHGGYREISSFQSLCAHIWRAVTRSRRLLAADATTTFRMAVNCRHRLRPAISPLYFGNAIQSVATTATVAELASNDLRWAAARLNATVVAHEDGAIRRAAAEWEAAPRCFPLGNPDGAALTMGSSPRFPMYDGNDFGWGRAIAVRSGRANKFDGKMSAFPSQAGDGSVDVEFCLAPDTMARLLGDHEFLQYVSRAP

SEQ ID NO: 10191 - protein, 513 aa, Triticum aestivum
MGLSSAAEIDGAQLCIFDLRRGQQEGQELDKILFFHPADCPILLQLSVIGLCEGIITFTRIFSPEDDCEVIESDKHCHVFYQAEPDIWMVLVVQKIKDNESTLRFGALQGILKESHSLFAMFHGPIRTLLDRQPSAEFARGHLHTFVTDYLSDFSVGKKLQLPTYRDSLTERGTVQMLTVSREVALEVQSLTTVLGSCLRNVICQSIVLFEDLLVSTTLPLDDTLNLYTYAILRLTPSALSSNGNSWSYLRKGGYVNADTTLSSANGAAAAERYNSRSRDTSPGGQNQMHHNFRPLQREKLSKGKDGFVAADFVTTEIRGAVPLNPILWFHQAEERMYLCVYQHKNLTILLVIPASSLINGEEGIAHVKRHLLENASQNIVTVEQKLSRGWGGENAYHVGGYRYILSDPNRKVSRASPPGKVITLSKDSLLALNRLRGEIDLEKSRAKRSDPTHDKDYEVCIRAKNNAWIIAKISRGKELYMAIEKGGETLLYASTAVEKFSNRYCEGAFSAD

SEQ ID NO: 10192 - protein, 510 aa, Secale cereale
MGLSSAAEIDGAQLCIFDLRRGQQEGQELDKILFFHPADCPILLQLSVIGLCEGIITFTRIFSPEDDCEVIESDKHCHVFYQAEPDIWMVLVVQKIKDNESTLRFGALQGILKESHSLFTMFHGPIRTLLDRQPSAEFARSHLHTFVTDYLSDFSVGKKLQLPTYRDSLTERGTVQMLTVSREVALEVQSLTTVLGSCLQNVICQSIVLFEDLLVSTTLPLDDTLNLYTYAILRLTPSALSSNGNSWSYLRKGGYDTTLSSANGAAAAERYNSRSRDTSPGGQNQMHHNFRPLQREKLSKGKDGFVAADFATTEIRGAVPLNPILWFHQAEERMYLCVYQHKNLTILLVIPASSLINGEEGIAHVKRHLLENASQNIVTVEQKLSRGWGGENAYHVGGYRYILSDPNRKVSRASPPGKVITLSKDSLLALNRLRGEIDLEKSRAKRSDPTHDKDYEVCIRAKNNAWIIAKISRGKELYMAIEKGGETLLYASTAVEKFSNRYCEGAFSTD

SEQ ID NO: 10193 - protein, 501 aa, Triticum aestivum
QLCIFDLRRGQQEGQELDKILFFHPADCPILLQLSVIGLCEGIITFTRIFSPEDDCEVIESDKHCHVFYQAEPDIWMVLVVQKIKDNESTLRFGALQGILKESHSLFAMFHGPIRTLLDRQPSAEFARGHLHTFITDYLSDFSVGKKLQLPTYRDSLTERGTVQMLTVSREVALEVQSLTTVLGSCLRNVICQSIVLFEDLLVSTTLPMDDTLNLYTYAILRLTPSALSSNGNSWSYLRKGGYVNADTTLSSANGAAAAERYNSRSRDTSPGGQNQMHHNFRPLQREKLSKGKDGFVAADFVTTEIRGAVPLNPILWFHQAEERMYLCVYQHKNLTILLVIPASSLINGEEGIAHVKRHLLENASQNIVTVEQKLSRGWGGENAYHVGGYRYILSDPNRKVSRASPPGKVITLSKDSLLALNRLRGEIDLEKSRAKRSDPTHDKDYEVCIRAKNNAWIIAKISRGKELYMAIEKGGETLLYASTAVEKFSNRYCEGAFSTD

SEQ ID NO: 10194 - protein, 513 aa, Festuca arundinacea
MGLSSAAAIDGAQLCVFDLRRGQQEGQELDKILFFHPADCPILLQLSVIGLCEGIITFTRIFSPEDDCEVIESDRHSHVFYQAEPDIWMVLVVEKTKDSESTLRFGALQGILKESHSLFTMFHGPIRALLDRQPSAELARGHLNTFVTDYLSDFIVGKKLQLPTYRDSLTERGTVQMLTVSREVALEVQSLTAVLGSCLGNVICQSIGLFEDLWVSTTLPPDDTLNLYTYAILRLTPRALYSNANSWSYLRKGAYVNAGPASSSSNGAAAAERYHSRSRDTSPGGQNQMHHNFRPLQREKLSKGKDGFVAADFATTEVRAAVPLTPILWFQQAEERMYLCVYQHKNLTILLLIPASSVINGEEGIAHVKKHLLENASQNIVTVEQKLTRGWGGENAYHVAGYRYLLVDPDRKVSRASPPGKVTTLSKDSLLALNRLREEIDLEKSRAKRSDPTHDKDYEVCIRAKNNAWVIAKITRGRELYMALEKGGETLLYASTAVEKFSNRYCEGAFSTD

SEQ ID NO: 10195 - protein, 488 aa, Brachypodium distachyon
MGLSSTDGAQLCVFDLRRGQQEGQELDKILFFHPTDCPILLQLSVIGLCEGIITFTRIFSPEDDCEVIESDRHSHVFYQAETDIWMVLVVEKTKDSESTLRCAALQGILKESHSLFTMFHGPIRSLLDRKPSAELARGHLHTFITDYLSDFTVGKKLQLPTYRDSLKERGTVQMLTVSREVALEVQSLATVLGSCLGNVACQSIVLFEDLLVSTTLSPDDTLNLYTYAILRLTPRALSNANSWSYLRKGVYVNAGSTSSSSNGAATAERPLQREKLSKGKDGFVAAEFATTEVRGAVPLTPILWFQQAEERMYLCVYQHKSLTILLLIPASSLINGEEGIAHVKRHLLENASENIVMVEQKLARGWGGENAYHVGGYRYLLVDPDRKISRASPPGKVTTLSKDSLLALNRLREEMDLEKSRAKRSDPTRDKDFEVCIRAKNNAWVIAKITRGRELYMALEKGGETLLYASTAVEKFSNRYCEGAFSTD

SEQ ID NO: 10196 - protein, 425 aa, Triticum aestivum
MVLVVQKIKDNESTLRFGALQGILKESHSLFTMFHGPIRTLLDRQPSAEFARGHLHTFVTDYLSDFSVGKKLQLPTYRDSLTERGTVQMLTVSREVALEVQSLTTVLGSCLRNVICQSIVLFEDLLVSTTLPLDDTLNLYTYAILRLTPSALSSNGNSWSYLRKGGYVNADTTLSSANGAAAAERYNSRSRDTSPGGQNQMHHNFRPLQREKLSKGKDGFVAADFVTTEIRGAVPLNPILWFHQAEERMYLCVYQHKNLTILLVIPASSLINGEEGIAHVKRHLLENASQNIVTVEQKLSRGWGGENAYHVGGYRYILSDPNRKVSRASPPGKVITLSKDSLLALNRLRGEIDLEKSRAKRSDPTHDKDYEVCIRAKNNAWIIAKISRGKELYMAIEKGGETLLYASTAVEKFSNRYCEGAFSTD

SEQ ID NO: 10197 - protein, 492 aa, Setaria italica
MGLSTAAAGDGAQLCVFDLRRGQQEGQELDKILFFHPADCPILLQLSVIGLCEGIVTFTRIFSPVEDCEVIESEKHSHIFYQAEPDIWMVLVVEKTKDNELTWRCGALQGILKEAHSLFAMFHGPIRTLLDRQPSAELARGHLRTFLTDYLSDFHAGKKLQFPTYRDCLKERGTVQMLTVSREVALEVQSLTTVLGSCLGNTTCQSLVLFEDLLVSTTLPPDDTLNLYTYAVLRLTPRALSSNASSWSYLRKGTSVNAGPTSSSSNGTTAGERPLLREKLSKGKDGFVAADFATTEVRGAVPLTPILWFQQAEERMYLCIYQHKSLTILLLIPASSLINGEEGIAHVKKQMLENASQKIVTVEQKLTRGWGGENAYHVAGYRYLLVDPDRRISRASPPGKVTTLAKDSLLALNRLRQEVDLEKSRYKRSDPCHDNDFEVCIRTKSNAWVIAKITRGRELYMALEKGGETLLYASTAVEKFSNRYCEGAFSTD

SEQ ID NO: 10198 - protein, 487 aa, Echinochloa colona
AAAGDGAQLCVFDLRRGQQEGQELDKILFFHPADCPILLQLSVIGLCEGIVTFTRIFSPEEDCEVIESDKHSHVFYQAEPDIWMVLVVGKNKDNESTWRCGALQGILKEAHSLFAMFHGPIRMLLDRQPSAELARGHLRTFLTDYLSDFHVGKKLQFPTYRDSLKERGTVQMLTVSREVALEVQSLATVLGSCLGNVTCQSLILFEDLLVSTTLPPDDTLNLYTYAVLRLTPRALSSNASSWSYLRKGTSITAGPTSSSSNGTTAGERPLLREKLSKGKDGFVAADFTATDVRGAVPLTPILWFQQAEERMYLCIYQHKSLTVLLLIPASSLINGEEGITHVKKQMLENASQKVVTVEQKLSRGWGGENAYHVGGYRYLLVDPDRRVSRASPPGKVTTLAKDSLLALNRLRQEVDLEKSRYKRSDPCHDKDFELCIRTKNNAWVIAKITRGRELYMALEKGGETLLYASTAVEKFSNRYCEGAFSTD

SEQ ID NO: 10199 - protein, 488 aa, Echinochloa colona
AAAAGDGAQLCVFDLRRGQQEGQELDKILFFHPADCPILLQLSVIGLCEGIVTFTRIFSPEEDCEVIESEKHSHVFYQAEPDIWMVLVVGKNKDNESTWRCGALQGILKEAHSLFAMFHGPIRMLLDRQPSAELARGHLRTFLTDYLSDFHVGKKLQFPTYRDSLKERGTVQMLTVSREVALEVQSLATVLGSCLGNVTCQSLVLFEDLLVSTTLPPDDTLNLYTYAVLRLTPRALSSNASSWSYLRKGTSVNSGPTSSSSNGTTAGERPLLREKLSKGKDGFVAADFTATDVRGAVPLTPILWFQQAEERMYLCIYQHKSLTVLLLIPASSLINGEEGITHVKKQMLENASQKVITVEQKVSRGWGGENAYHVGGYRYLLVDPDRRVSRASPPGKVTTLAKDSLLALNRLRQEVDLEKSRYKRSDPCHDKDFELCIRTKNNAWVIAKITRGRELYMALEKGGETLLYASTAVEKFSNRYCEGAFSTD

SEQ ID NO: 10200 - protein, 492 aa, Sorghum bicolor
MGLSSAAAGDGTQLCVFDLRRGQQEGQELDKILFFHPADCPILLQLSVIGLCEGIVTFTRIFSPEEDCEVIESEKHSHVFYQAETDIWMVLVVEKNKENELAWRCNALHGILKEAHSLFAMFHGPIRTLLDRQPSAELARGHLRTFITDYLSDFNVGKKLQFPTYRDSLKERGTVQMLTVSREVALDVQSLTTVLGSCLGNVTCQSLVLFEDLLVSTTLPPDDTLNLYTYAVLRLTPRALYANASSWSYLRKGTSVSAGPTSSSSNGTTAGERPLLRDNLSKGKDGFVAADFAATEARGAVPLTPILWFQQAEERMYLCIYQHKSLTILLLVPASSLINGEEGIAHVKKQMLENASQKIVTVEQKLTRGWGGENAYHVSGYRYLLVDPERRISRASPPGKVTTLAKDSLLALNMLRQEVDLEKSRYKRGDPCHDKDFEACIRTKNNAWVIAKISRGRELYMALEKGGETLLYASTAVEKFSNRYCEGAFSTD

SEQ ID NO: 10201 - protein, 492 aa, Oryza sativa
MGLSSAAAGEGPQLCVFDLRRGQQEGQELDKILFFHPTDCPILLQLSVIGLCEGIITFARIFSPDDDCEVIESEKHSHVFYQAEADIWMVLVVEKNKDIESTWRCGALQGILKEVHSLFTMFHGPIRTLLDRQPSAELARGHLRTFFTDYLSDFNAGKKIQLPTFRDCLKERGTVQMLTISREVALEVQSLTTVLGSCLGNVMCQSLVLFEDLLVSTTLPPDDTLNLYTYAILRLTPRALLSNATSWSYLRKGTSVHAGPTSSSSNGTASVERPLQREKLYKGKDGFVAAGSTTSEVRGAVAWVPILWFQQAEDRMHLCVYQHKNITILLLIPASSLINGDDGIAHVKRHLLENASQNIVTLELKLSRGWGGENAYHVGGYRYLLVDPDRKVSRASPPGKVTTLSKDSLLSLNRLREEIDLEKSRAKRSDSCHDKDFEVCIRAKNNAWVIAKVTRGRELYMALEKAGETLLYASTAIEKFSNRYCEGAFSTD

SEQ ID NO: 10202 - protein, 77 aa, Vigna unguiculata
MGLWTLLEGFLLLANAMAILNEGRFLAPRGWGFADFSVGRTKSFKGQLIGLIYATQYLRVPLILLNSICIILKLVSG

SEQ ID NO: 10203 - protein, 77 aa, Arachis hypogaea
MGLWTLLEGFLLLANALAILNEDRFLAPRGWGLSDFSSGRTKSFKGQLIGLIYATQYLRVPLILLNSICIILKFVSG

SEQ ID NO: 10204 - protein, 77 aa, Cajanus cajan
MGLWTLLEGFLLLANALAILNEDRFLAPRGWGFSDFSGGRTKSFKGQLIGLIYATQYLRVPLILLNSICIIVKLVSG

SEQ ID NO: 10205 - protein, 77 aa, Glycine max
MGLWTLLEGFLLLANALAILNEDRFLAPRGWGFQDFSGGRTKSFKGQLIGLIYATQYLRVPLILLNSICIFLKLVSG

SEQ ID NO: 10206 - protein, 77 aa, Glycine max
MGLWTLLEGFLLLANALAILNEDRFLAPRGWGFQDFSGGRTKSFKGQLIGLIYATQYLRVPLILLNSICIFVKLVSG

SEQ ID NO: 10207 - protein, 77 aa, Lupinus angustifolius
MGLWTLIEGFLLLANALAILNEDRFLAPRGWGFSDFSGGRTKSFKGQLIGLIYATQYMRVPLILLNSICIIIKLVSG

SEQ ID NO: 10208 - protein, 77 aa, Lupinus angustifolius
MGLWTLLEGFLLLANALAILNEDRFLAPRGWGFSDFSSGRTKSFKGQLIGLIYATQYMRVPLIILNSICIIVKLVSG

SEQ ID NO: 10209 - protein, 148 aa, Glycyrrhiza uralensis
MPSPKSHRRGRLAERSSSYQGLNAMCAGQLRRPSTVPDLLSYRNNAGAAPEGLPRQPPKLLLKVTVLGSLGPVQVLLRPELTVGDLVEAAVRQYLKEGRRPILPSNVASDFDLHYSQFSLESLHREEKLIELGSRNFFLCLKKTAPAT

SEQ ID NO: 10210 - protein, 77 aa, Vitis vinifera
MGLWTLLEGCLLIANALAILNEDRFLAPRGWSFSEFSGGRTKSFKGQLIGLIYATQYLRVPLILLNSICIIIKLVSG

SEQ ID NO: 10211 - protein, 77 aa, Cajanus cajan
MGLWTLLEGFLLLANALAILNEDRFLAPRGWGLSDFSAGRTKSFKGQLIGLIYATQYLRFPLILLNTICIIVKLVSG

SEQ ID NO: 10212 - protein, 77 aa, Cicer arietinum
MGLWTLLEGFLLLANALAILNEDRFLVPRGWGLSDFSGGRTKSFKGQIIGLIYATQYLRVPLILLNSVFIIVKLVSG

SEQ ID NO: 10213 - protein, 77 aa, Castanea mollissima
MGLWTLLEGFLLLANALAILNEDRFLAPRGWSFSEFSGGRSKSFKGQLIGLIYATQYLRVPLILLNSIFVVVKLVSG

SEQ ID NO: 10214 - protein, 77 aa, Vigna unguiculata
MGLWTLLEGFLLLANALAILNEDRFLAPRGWGLSDFSAGQTKSFKGQVLGLIYATQYLRFPLILLNSICIIVKLVSG

SEQ ID NO: 10215 - protein, 77 aa, Ricinus communis
  Sequence also found in Organisms: Rhizophora mangle
MGLWTLLEGFLLLANALAILNEDRFLAPRGWSFSEFSGGRTKSFKGQLIGLIYATQYMRVPLMILNAICIVVKLVSG

SEQ ID NO: 10216 - protein, 77 aa, Trifolium pratense
MGLWTLLEGFLLLANALAILNEDRFLVPKGWGLSDFSGGRTKSFKGQIIGLIYATQYLRVPLILFNSVFIIVKLVSG

SEQ ID NO: 10217 - protein, 77 aa, Fagus grandifolia
MGLWTLLEGCLLLANALAILNEDRFLAPRGWSFSEFSGGKTKSFKGQLIGLIYATQYLRVPIILLNSICVVVKLVSG

SEQ ID NO: 10218 - protein, 77 aa, Cucumis sativus
  Sequence also found in Organisms: Citrullus lanatus
MGLWTLLEGCLLLANALAILNEDRFLAPRGLNFSEFSGGRTKSFKGQLIGLIYATQYLRVPLIMLNAICIFVKLVSG

SEQ ID NO: 10219 - protein, 77 aa, Cucurbita pepo
MGLWTLLEGCLLLANALAILNEDRFLAPRGWSFSDFSGGRTKSFRGQLIGLIYATQYLRVPLMMLNVICIFVKLVSG

SEQ ID NO: 10220 - protein, 77 aa, Medicago truncatula
MGLWTLLEGLLLLANALAILNEDRFLVPKGWGLSDFSGGRTKSFKGQIIGLIYATQYLRVPLILFNSIFIIVKLVSG

SEQ ID NO: 10221 - protein, 77 aa, Quercus alba
MGLWTLLEGFLLLANALAILNEDRFLAPRGWSFSEFSGGKSKSFKGQLIGLIYATQYLRVPLILLNSIFVVVKLVSG

SEQ ID NO: 10222 - protein, 77 aa, Carica papaya
MGLWTLLEGCLLLANALAILNEDRFLAPRGWSFSEFSAGQTKSFKGQLIGLIYATQYLRVPLILLNLICILVKLVSG

SEQ ID NO: 10223 - protein, 77 aa, Glycine max
MGLWTLLEGFLLLANALAILNEDRFLTPRGWGLSDFSAGQTKSFKGQLIGLIYATQYLRFPLILLNSVFIIVKLVSG

SEQ ID NO: 10224 - protein, 77 aa, Trifolium pratense
MGLWTLLEGLLLLANALAILNEDRFLVPKGWGLSDFSGGRTKSFKGQIIGLIYATQYLRVPLILFNSVFIIVKLVSG

SEQ ID NO: 10225 - protein, 77 aa, Vicia sativa
MGLWTLLEGLLLLANALAILNEDRFLVPKGWGMSDFAGGRTKSFKGQIIGLIYATQYLRLPLILFNSIFIIVKFVSG

SEQ ID NO: 10226 - protein, 77 aa, Phaseolus vulgaris
MGLWTLRAGFLLLANALAILNEDRFLAPRGWGLSDFSAGQTKSFKGQVLGLIYATQYLRFPLILLNSICIIVKLVSG

SEQ ID NO: 10227 - protein, 77 aa, Chelidonium majus
MGLWTLLEGFLLLANALAILNEDRFLAPRGWSFADVSGGRTKSLKGQLIGLIYATQYLRLPLIVLNTITIVVKLVSG

SEQ ID NO: 10228 - protein, 77 aa, Eucalyptus grandis
MGLWTLLEGLLLLANALAILNEDRFLAPRGWGFQEFPGGKAKSLKGQVIGLIYATQYLRVPLIILNSICIIIKLVSG

SEQ ID NO: 10229 - protein, 77 aa, Linum usitatissimum
MGLWTLLEGFLLLANALAILNEDRFLAPRGWSFSEFSGERTKSFKAQIIGLIYATQYMRVPLIILNSICIVVKLVSG

SEQ ID NO: 10230 - protein, 77 aa, Cucumis melo
MGLWTLLEGCLLLANALAILNEDRFLAPRGLNFSEFSGGRTKSFKGQLIGLIYATQYLRVPLIMLNAICIFVKLISG

SEQ ID NO: 10231 - protein, 77 aa, Populus trichocarpa
MGLWTLLEGFLLLANAFAILNEDRFLAPRGWSFSEFSVGRTKSLKGQLIGLIYATQYMRVPLIILNSICIFVKLVSG

SEQ ID NO: 10232 - protein, 77 aa, Rosa hybrid cultivar
MGLWTLLEGFLLLANALAILNEDRFLAPRGWSFSEFSVGRTKSLKGQIIGLIYATQYLRVPLVLLNSICIVVKLISG

SEQ ID NO: 10233 - protein, 77 aa, Glycine max
MGLWTLLEGFLLLANALAILNEDRFLTPRGWGLSDFSAGQTKSFKGQLIGLIYATQYLRFPLLLLNSVFIIVKLVSG

SEQ ID NO: 10234 - protein, 77 aa, Trigonella foenum-graecum
MGLWTLLEGFLLLANALAILNEDRFLVPKGWGLSDFSGGTKKSFKGQIIGLIYATQYLRVPLILFNSIFIIVKLVSG

SEQ ID NO: 10235 - protein, 77 aa, Citrus clementina
  Sequence also found in Organisms: Citrus sinensis
MGLWTLLEGFLLLANALAIINEDRFLAPRGWSFSEFSVGRTKSLKGQIIGLIYATQYMRVPLILLNAICIVVKLVSG

SEQ ID NO: 10236 - protein, 77 aa, Lupinus angustifolius
MGLWTLVEGFLLLANSLAILNDDRFLAPRGWGLSDFSGNRTKTFKGQVLGLIYAIQYLRVPLIILNSICIILKLVSG

SEQ ID NO: 10237 - protein, 77 aa, Momordica charantia
MGLWTLLEGCLLLANALVILNEDRFLAPRGLSFSEFSGGRTKSFKGQLIGFIYATQYLRVPLIMLNAICIFVKLVSG

SEQ ID NO: 10238 - protein, 77 aa, Arachis hypogaea
MGLWTLLEGFLLLANALAIINEDRFLAPRGWGFSDFSVRRTKSLKGQIIGLIHASQYLRVPLILLNTIFIIVKFLSG

SEQ ID NO: 10239 - protein, 77 aa, Populus trichocarpa
MGLWTLLEGFLLLANAFAILNEDRFLAPRGWSFSEFSVGRTKSLKGQLIGLIYATQYMRVPLVILNSICIFVKLVSG

SEQ ID NO: 10240 - protein, 77 aa, Papaver somniferum
MGLWTLLEGFLLLANALAILNEDRFLAPRGWSFAEVSGGRTKSLKGQLIGLIYATQYLRLPLIVLNAITIVVKLVSG

SEQ ID NO: 10241 - protein, 77 aa, Fragaria vesca
MGLWTLLEGFLLLANALAILNEDRFLAPRGWSFSEFSVGRTKSLKGQIIGLIYATQYLRVPLVLLNSIFIVVKLISG

SEQ ID NO: 10242 - protein, 77 aa, Valeriana officinalis
MGLWTLLEGCLLLANALAILNEDRFLVPRGWSFQEFSGVRRNSFKGQLIGLIYATQYLRVLLILLNSICIVVKLVSG

SEQ ID NO: 10243 - protein, 199 aa, Cocos nucifera
MGLVFGKITVETPKHEVLHSCPDYEIRRYSPSVVAEVTYDPSQLRGDRDGGFMILAQYIGALGQPQNAKPEKIAMTAPVITKSPSQSEKIAMTAPVITTGDNKATTMQFVLPAKYKTVEEAPKPLDERVVIKAEGGRKYGVARFSGVATDKVVEERVEKLRRSLERDGYKVVGDFLLARYNPPWTLPPLRTNEVMLPIE

SEQ ID NO: 10244 - protein, 77 aa, Cucurbita pepo
MGLWTLLEGFLLLANALAILNEDRFLARRGLSFSEFSGGRTKSLKGQLIGLVYATQYLRVPLIMLNALCIFVKLVSG

SEQ ID NO: 10245 - protein, 78 aa, Cocos nucifera
MGLWTLLEGFLLLANALAILNEDRFLAPRGWSFSEVSGNGRSKSLKGQLIGLIYATQYLRVPLIVLNAIIMVVKLVSG

SEQ ID NO: 10246 - protein, 78 aa, Elaeis guineensis
MGLWTLLEGFLLLANALAILNEDRFLGPRGWSFSEVSGTGRAKSLKGQLIGLIYATQYLRVPLIILNVITILVKLVSG

SEQ ID NO: 10247 - protein, 78 aa, Elaeis guineensis
MGLWTLLEGFLLLANALAILNEDRFLAPRRWSFSEVSGNGRSKSLKGQLIGLIYATQYLRVPLIVLNAIIIVVKLVSG

SEQ ID NO: 10248 - protein, 78 aa, Phalaenopsis aphrodite
MGLWTLLEGFLLLANALAILNEDRFLGPRGWSFSEVSAGGRTKSLKGQLIGLIYATQYLRVPLIILNLIIVVVKLVSG

SEQ ID NO: 10249 - protein, 649 aa, Malus domestica
MSKSTSDHNSCARSRRRHFEATEGQPGSSTKFDDANAHAVFFRRRVRKLSDFSSWRLCKWTSMVLMGLAFLSMLAKFALLNTFPELKVMEKISLIRPSLIEGTTTLKQNMVRLGDRVNVAKMLISSRNCDPIFYLISASQTLDIWTPSESYNYYQCINRAKKEFCTSRKLSSPTMNETATNGYILVRSNGGLNQMKLGISDMVAIAKLMNATLVLPSLDHISFWTDPSDFKDIFNWKNFMEVLRDDIMIVESLPSEFANMKPRHKAPVSWSGASYYKQQMATLLKKHKVVKFTFTDSRLANNVDSSIQRLRCRAFYKALRFAVEIEELAMNLIYRLKNNGGKYIALHLRYEKDMLSFTGCSHNLTREEDLELEMIREKTPHWKHKKINGTVQRHQGQCPMTPREIAVFLEAIGFPSDTKIYIAAGEVYGQDGLTSLQAKYPNLFFHSNLASEEELQPYKDKLNQLAALDYIIAVESDVFIYSYDGNMAKAVKGHRRFEGFRKTISPDKQRFVRLIDKLDKGMITWKTFSSRVKRLHKNRMGAPYPRVPRILPRLEENFYANPYPGCICERTNEPASSPAGRCPNEMIQQESKRARSTLFLESSLLEAFGFSIFHLQVSSSPEIRSSHSGKWVWVHYLKAFCFLQMQWRF

SEQ ID NO: 10250 - protein, 77 aa, Daucus carota
  Sequence also found in Organisms: Petroselinum crispum
MGLWTLLEGCLLLANALAILNEDRFLAPRGWSFQEFSGVKRNSFKGQLIGLIYATQYLRVLLIMLNSLCIVVKLVSG

SEQ ID NO: 10251 - protein, 77 aa, Manihot esculenta
MGLWTLLEGTLLLANGLAILNEDRFLAPRGWSFSEFSVGGTKSFKGQLMGLIYATQYMRVPLIILNAICIVVKLVSG

SEQ ID NO: 10252 - protein, 77 aa, Euonymus alatus
MGLWTLLEGFLLLANAFAVLNEDRFLAPKGWSFQEFSGGKTKSLKGQLIGLIYATQYLRVPLIILNCIFIVVKLVSG

SEQ ID NO: 10253 - protein, 77 aa, Fagopyrum esculentum
MGLWTLLEGMLLLANAFAILNEDRFLAPKGWSFQDFSVGRTKTIKGQIIGLIYAVQYMRVPLILLNSITIIVKLVSG

SEQ ID NO: 10254 - protein, 77 aa, Petroselinum crispum
MGLWTLLEGCLLLANALAILNEDRFLIPRGWSFQEFSGVRRNSFKGQLIGLIYATQYLRVLLIILNSLCIVVKLVSG

SEQ ID NO: 10255 - protein, 77 aa, Solanum lycopersicum
  Sequence also found in Organisms: Solanum tuberosum, Solanum phureja
MGLWTLLEGCLLLANALAILNEDRFLAPRGWSFQEYSGVRRNSFKGQLLGLIYATQYLRVLLILLNTLCIVVKFVSG

SEQ ID NO: 10256 - protein, 77 aa, Prunus persica
  Sequence also found in Organisms: Prunus mume
MGLMTLLEGFLLLANALAILNEDRFLAPRGWSLAEFSVGRTKSVKGQIIGLIYATQYLRVPLVLLNTVCIVLKLISG

SEQ ID NO: 10257 - protein, 187 aa, Gossypium raimondii
MRIPNLTKAFILLMAITLMSTQANGLIPYSRSLWDVMLAEDPFKILEQTPVTVPKGSEPVALARADWKETPRYHAITLDIPGMKKEDLKIEVEENRVLRISGERKEEAEIEGEKWHRAERTNGKFWRQFRLPANVDMDRIKAHMEDGVLRISVPKIVDENKKQAKVIDIVQSGGTGEDIKATSQGHH

SEQ ID NO: 10258 - protein, 554 aa, Gossypium hirsutum
MASQVSQMPSSSPLSSNKDEIRPKADFQPSIWGDFFLNCPDKNIDAGTEKRHQQLKEEVRKMIVAPMANSTQKLAFIDSVQRLGVSYHFTKEIEDELENIYHNNNDAENDLYTTSLRFRLLREHGYNVSCDVFNKFKDEQGNFKSSVTSDVRGLLELYQASYLRVHGEDILDEAISFTTNHLSLAVSSLDHPLSEEVSHALKQSIRRGLPRVEARHYLSVYQDIESHNKALLEFAKIDFNMLQFLHRKELSEICRWWKDLDFQRKLPYARDRVVEGYFWISGVYFEPQYSLGRKMLTKVIAMASIVDDTYDSYATYEELIPYTNAIERWDIKCIDELPEYMKPSYKALLDVYEEMEQLVAEHGRQYRVEYAKNAMIRLAQSYLVEARWTLQNYKPSFEEFKANALPTCGYAMLAITSFVGMGDIVTPETFKWAANDPKIIQASTIICRFMDDVAEHKFKHRREDDCSAIECYMEEYGVSAQEAYDVFNKHVESAWKDVNQEFLKPTEMPTEVLNRSLNLARVMDVLYREGDGYTYVGKAAKGGITSLLIEPIAL

SEQ ID NO: 10259 - protein, 554 aa, Gossypium raimondii
MASQVSQMPSSSPLSSNKDEIRPKADFQPSIWGDFFLNCPDKNIDAGTEKRHQQLKEEVRKMIVAPMANSTQKLAFIDSVQRLGVSYHFTKEIEDELENIYHNNNDAENDLYTTSLRFRLLREHGYNVSCDVFNKFKDEQGNFKSSVTSDVRGLLELYQASYLRVHGEDILDEAISFTTNHLSLAVASLDHPLSEEVSHALKQSIRRGLPRVEARHYLSVYQDIESHNKALLEFAKIDFNILQFLHRKELSEICRWWKDLDFQRKLPYARDRVVEGYFWISGVYFEPQYSLGRKMLTKVIAMASIVDDTYDSYATYEELIPYTNAIERWDIKCIDELPEYMKPSYKALLDVYEEMEQLVAEHGRQYRVEYAKNAMIRLAQSYLVEARWTLQNYKPSFEEFKANALPTCGYAMLAITSFVGMGDIVTPETFKWAANDPKIIQASTIICRFMDDVAEHKFKHRREDDCSAIECYMEEYGVSAQEAYDVFNKHVESAWKDVNQEFLKPTEMPTEVLNRSLNLARVMDVLYREGDGYTYVGKAAKGGITSLLIEPIAL

SEQ ID NO: 10260 - protein, 554 aa, Gossypium raimondii
MASQVSQMPSSSPLSSNKDEIRPKADFQPSIWGDLFLNCPDKNIDAGTEKRHQQLKEEVRKMIVAPMANATQKLAFIDSVQRLGVSYHFTKEIEDELENIYHNNNDAENDLYTTSLRFRLLREHGYNVSCDVFNKFKDEQGNFKSTVTSDVRGLLELYQASYLRVHGEDILDEAISFTTNHLSLAVASLDHPLSEEVSHALKQSIRRGLPRVEARHYLSVYQDIESHNKALLEFAKIDFNMLQFLHRKELSEICRWWKDLDFQRKLPYARDRVVEGYFWISGVYFEPQYSLGRKMLTKVIAMASIVDDTYDSYATYEELIPYTNAIERWDIKCIDELPEYMKPSYKALLDVYEEMEQLVAEHGRQYRVEYAKNAMIRLAQSYLVEARWTLQNYKPSFEEFKANALPTCGYAMLAITSFVGMGDIVTPETFKWAANDPKIIQASTIICRFMDDVAEHKFKHRREDDCSAIECYMEEYGVTAQEAYDVFTKHVESAWKDVNQELLKPTEMPTEVLNRSLNLARVMDVLYREGDGYTYVGKAAKGGITSLLIEPIAL

SEQ ID NO: 10261 - protein, 554 aa, Gossypium hirsutum
MASQVSQMPSSSPLSSNKDEIRPKADFQPSIWGDLFLNCPDKNIDAGTEKRHQQLKEEVRKMIVAPMANATQKLAFIDSVQRLGVSYHFTKEIEDELENIYHNNNDAENDLYTTSLRFRLLREHGYNVSCDVFNKFKDEQGNFKSTVTSDVRGLLELYQASYLRVHGEDILDEAISFTTNHLSLAVASLDHPLSEEVSHALKQSIRRGLPRVEARHYLSVYQDIESHNKALLEFAKIDFNMLQFLHRKELSEICRWWKDLDFQRKLPYARDRVVEGYFWISGVYFEPQYSLGRKMLTKVIAMASIVDDTYDSYATYDELIPYTNAIERWDIKCIDQLPEYMKPSYKALLDVYEEMEQLVAEHGRQYRVEYAKNAMIRLAQSYLVEARWTLQNYKPSFEEFKANALPTCGYAMLAITSFVGMGDIVTPETFKWAANDPKIIQASTIICRFMDDVAEHKFKHRREDDCSAIECYMEEYGVTAQEAYDVFTKHVESAWKDVNQELLKPTEMPTEVLNRSLNLARVMDVLYREGDGYTYVGKAAKGGITSLLIEPIAL

SEQ ID NO: 10262 - protein, 554 aa, Gossypium hirsutum
MASQVSQMPSSSPLSSNKDEIRPKADFQPSIWGDFFLNCPDKNIDAGTEKRHQQLKEEVRKMIVAPMANSTQKLAFIDSLQRLGVSYHFTKEIEDELENIYHNNNDAENDLYTTSLRFRLLREHGYNVSCDAFNKFNDEQGNFKSSVTNDVQGLLELYEASYLRVHGEDILDEAISFTTNHLSLAVASLDHPLSEEVSHALKQSIRRGLPRVEARHYLSVYQDIESHNKALLEFAKIDFNMLQFLHRKELSEICRWWKDLDFQRKLPYARDRVVEGYFWISGVYFEPQYSLGRKMLTKVIAMASIVDDTYDSYATYEELIPYTNAIERWDIKCIDELPEYMKPSYKALLDVYEEMKQLVAEHGRQYRVEYAKNAMIRLAQSYLVEARWTLQNYKPSFEEFKANALPTCGYAMLAITSFVGMGDIVTLETFKWAANDPKIIQASTIICRFMDDVAEHKFKHRREDDCSAIECYMEEYGVTAQEAYDVFNKHVESAWKDLNQEFLKPTEMPTEVLNRSLNLARVMDVLYREGDGYTYVGKAAKGGITSLLIEPIAL

SEQ ID NO: 10263 - protein, 554 aa, Gossypium hirsutum
MASQVSQMPSSSPLSSNKDEMRPKADFQPSIWGDFFLNCPDKNIDAETQKRHQQLKEEVRKMIVAPMANSTQKLAFIDSVQRLGVSYHFTKEIEDELENIYHNNNDAENDLYTTSLRFRLLREHGFNVSCDVFNKFKDEQGNFKSSVTSDVRGLLELYQASYLRVHGEDILDEAISFTSNHLSLAVASLDHPLSEEVSHALKQSIRRGLPRVEARHYLSVYQDIESHNKVLLEFAKIDFNMVQLLHRKELSEISRWWKDLDFQRKLPYARDRVVEGYFWISGVYFEPQYSLGRKMLTKVIAMASIVDDTYDSYATYEELIPYTNAIERWDIKCIDELPEYMKPSYKALLDVYEEMEQLVAEHGRQYRVEYAKNAMIRLAQSYLVEARWTLQNYKPSFEEFKANALPTCGYAMLAITSFVGMGDIVTPETFKWAANDPKIIQASTIICRFMDDVAEHKFKHRREDDCSAIECYMEEYGVTAQEAYDVFNKHVESAWKDVNQEFLKPTEMPTEVLNRSLNLARVMDVLYREGDGYTYVGKAAKGGITSLLIEPIAL

SEQ ID NO: 10264 - protein, 193 aa, Gossypium hirsutum
MPSSSPLLPIRMKSVPKPIFSLAFGEISSSIVPTRILMLELKKRHQQLKEEVRKMIVAPMANATQKLAFIDSVQRLGVSYHFTKEIEDELENIYHNNNDAENDLYATSLRFRLLREHGFNVSCDVFNKFKDEQGNFKSSVTSDVRGLLELYQASYLRVHGEDILDEAISFTSNHLSLAVASWTILYPKRFLML

SEQ ID NO: 10265 - protein, 564 aa, Gossypium hirsutum
MASQVSQMPSSSPLSSNKDEIRPKADFQPSIWGDFFLNCPDKNIDAGTEKRHQQLKEEVRKMIVAPMANSTQKLAFIDSLQRLGVSYHFTKEIEDELENIYHNNNDAENDLYTTSLRFRLLREHGYNVSCDVFNKFKDEQGNFKSSVTSDVRGLLELYQASYLRVHGEDILDEAISFTTNHLSLAVASLDHPLSEEVSHALKQSIRRGLSRVEARHYLSVYQDIESHIRLVEFAKIDFNMLQFLHRKELSEICRWWKDLDFQRKLPYARDRVVEGYFWISGVYFEPQYSLGRKMLTKVIAMASIVDDTYDSYATYEELIPYTNAIERWDIKCIDELPEYMKPSYKALLDVYEEMEQLVAEHGRQYRVEYAKNAMIRLAQSYLVEARWTLQNYKPSFEEVKANALPTCGYAMLAITSFVGMGDIVTPETFKWAANDPKIIQASTIICRFMDDVAEHKFKHRREDDCSAIECYMEEYGVTAQEAYDVFNKHVESAWKDVNQEFLKPTEMPTEVLNRSLNLARVMDVLYREGDGYTYVGKAAKGGITSLLIEPIALRNRIKFSSSVP

SEQ ID NO: 10266 - protein, 554 aa, Gossypium raimondii
MASQVSQMPSSSPLSSHKDEMRPKADFPPSIWRDFFHNCPDKNIDAETEKRHQQLKEEVRKMIVAPMANSTQKLTFIDSVQRLGVSYHFTKEIEDELVNIYHNNNDAENDLYTTSLRFRILREHGFHVSCSAFNKFNDEQGNFKSSVTNDVRGLLELYEASYLRVHGEDILDEAISFSANHLSLAVASLDYPLSEQVSHALKQSIRRGLPRVEARHYLSVYQDIESHNKALLEFAKIDFNMLQLLHRKELSEICRWWKDLDFQRKLPYTRDRVVECYFWILGVYFEPQYSLGRKMMTKVIIMTSVIDDTYDSYATYDELIPYTSAIERWEIKCIDQLPEYMKLSYKALLDVYEEMKQLVVEHGRQYRVEYAKNAMIRLSQSYFVEAKWTLQNYKPSFEEFKINALSSSGYAMLAITSFVGMGDIVTPETFKWAANEPKIIQASTIICRFTDDIAEHKFEHRREDDWSVIDYYMKEYNVTAQEAYDVFNKYIESAWKDTNQELLKPTEMPTEVMNRSLNLSRVMDVVYKEGDGYTYVRKAMKDVITSLLIEPVTL

SEQ ID NO: 10267 - protein, 554 aa, Gossypium raimondii
MASQVSQMPSSSPLSSNKDEMRPKADYPPSIWGDFFHNCPDKNIDAETEKRHQQLKEEVRKMIVAPMANSTQKLTFIDSVQRLGVSYHFTKEIEDELENIYHNDNDAENDLYTTSLRFRILREHGFNVSCNAFNKFKDEQGNFKSSVTNDVRGLLELYEASYLRVHGEDILDEAISFSANHLILAVASLDYPLSEQVSHALKQSIRRGLPRVEARHYLSVYQDIESHNKALLEFAKIDFNMLQLLHREELSEICRWRNDLDFQTKLPYTKDRVVECYFWILGVYFEPQYSLGRKMMTKVIIMTSVIDDTYDSYATYDELIPYTSAIERWEIKCIDQLPEYMKLSYKALLDIYEEMKQLVAEHGRQYRVEYAKNAMIQLLQFYFMEAKWALQNYKPSFEEFKANAVSSSGYAMLAITSFVGMGDMITPETFKWAASEPKIIQASTIICRFMDDIAEHKFKHRREDDWSVIDYYMKEYNVTAQETYDVFNKYIESAWKDMNQELLKPTEMPTEVMNRSLNLSRVMDVLYKEGDGYTYVGKAIKDAITSLLIEPITL

SEQ ID NO: 10268 - protein, 355 aa, Gossypium raimondii
MEGLMQVPYDVTVRFMLTSLERNLLPDAIIRRLTRLLLASRLRSGYKPSTELQLSDLLQFAHSLKEMPIAIKTDKPKTQHYELPTSFFKLVLGKNFKYSCCYFSDESKTLEDAEEAMLELYCERSQLKDGQTVLDVGCGWGSLSLYIARKYPNCRVTGICNSTTQKAFIEEQYQDRQLQNVEIIVADISTFEMEASYDRIYSIEMFEHMKNYHDLLKKISKWMKEDSLLFVHYFCHKAFAYHFEDINEDDWITRYFFTGGTMPSANLLLYFQDDVSVVNHWLVNGKHYAKTSEEWLKRMDRSLASIKPIMESTYGKDQAVKWTVYWRTFFIAVAELFGYNNGEEWMVALFLFKKK

SEQ ID NO: 10269 - protein, 355 aa, Lotus japonicus
MEGIMQRPYDATVKLMLASMERNLLPDAVIRRLTRLLLAARLRAGYKPSSEIQLSDLVYFVHSLQDMPIAISTDTAKSQHYELPTSFFKLVLGKNLKYSCCYFSSASETLEDAEEAMLKLYCERSNLKDGHTVLDVGCGWGSLALYIAKNYSNSRVTGICNSVTQKAFIEEKCQDLQLQNLEIIVADISTFEMEASYDRIISIEMFEHMKNYKDLLKKISKWMKEDSLLFVHHFCHKAFAYHFEDESEDDWITRYFFTGGTMPAANLLLYFQDDVSVVNHWLVNGKHYAQTSEEWLKRMDKNMSSIKPIMESTYGKDSAIKWTVYWRTFFIAVAELFGYNNGDEWMVAHFLFKKK

SEQ ID NO: 10270 - protein, 355 aa, Vitis vinifera
MEGMMQVPYDATVRLMLASLERNLLPDALVRRLTRLLLASRLRSGYKPSAELQLSSLLHFAHSLEEMPIAIKTEDPKSQHYELPTSFFKLVLGKNLKYSCCYFPDKSSTLEDAENAMLEMYCKRAQVEDGHTVLDIGCGWGSLSLYIAQKYTNCRITGICNSKTQKAYIEEQCQELQLQNVEIIVADISTLEMEATYDRIFSIEMFEHMKNYKDLLKKISGWMKQDSLLFVHHFCHKAFAYHFEDKSDDDWITRYFFSGGTMPAANLLLYFQEDVSVVDHWLVNGKHYAQTSEEWLKRMDKNLASIKPIMESTYGKDSAVKWTVYWRTFFISVAELFEYNDGEEWMVALFLFKKT

SEQ ID NO: 10271 - protein, 355 aa, Cucumis sativus
MAKLIQIPYDATVHLALASLERNLLPDAIIRTFTRLLLASRLRSGYKPSSQLQLSELLHFVHSLREMPIAIKTDKPKAQHYEVPTSFFKLVLGKNLKYSCCYFNDKSSTLEDAEDAMLQMYCERSQLKDGHTVLDVGCGWGSLSLYIAQKYKNCTVTGICNSITQKAYIEDRCQDLQLHNVNIIVADISTYEMEAEYDRIFSIEMFEHMKNYKDLLKKISGWMKQDSLLFVHYFCHKVFAYHFEDVNDDDWITRYFFEGGTMLSSNLLLYFQDDVSIVDHWLVNGKHYSQTSEEWLKRMDENIASIKPIMATTYGKDSAVKWTVYWRTFFIAVAELFGYNNGEEWMVSHFLFKKK

SEQ ID NO: 10272 - protein, 355 aa, Cucumis melo
MAKLIQMPYDVSVRLALASLERNLLPDAVVRTFTRLLLASRLRSGYKPSSQLQLSELLHFVHSLGEMPIAIKTDKPKAQHYEVPTSFFKLVLGKNLKYSCCYFNDKSSTLEDAEDAMLQMYCERSQLKDGHTVLDVGCGWGSLSLYIAQKYKNCTVTGICNSITQKAYIEDRCQDLQLHNVNIIVADISTYEMEAEYDRIFSIEMFEHMKNYKDLLKKISGWMKQDSLLFVHYFCHKVFAYHFEDVNEDDWITRYFFEGGTMPSSNLLLYFQEEVSIVDHWLVNGKHYSQTSEEWLKRMDKNIASIKPIMATTYGKDSAVKWTVYWRTFFIAVSELFGYNNGEEWMVSHFLFKKK

SEQ ID NO: 10273 - protein, 421 aa, Gossypium raimondii
MLNKLALPESSTFPGKPMPPTAECWFDDACILDMDYFVKTISGIKAKGVRPDLVGSIIAHYASKWLPDLSGNDTEKGPMSLQESSPESVTVSWMKKRFFVETLVGILPPERDSIPCNFLLRLLRTANMVGVEPSYRAELEKRISWQLDQASLKELMIPSFSHTCGTLLDVELVIRLVKRFASLDEGTRSGIAVVKVAKLVDSYLAEAALDTNLSLEDFIALGAALPSHARAMDDGLYRAIDTYLKAHPGVSKQDRKVLCRLIDSRKLSPEASLHAAQNERLPVRAVIQVLFCEQSKLNRHVDWSGSFNGTRSPNPAGLEAPVRCMSKREMNAQQMEIKKLKEELLRVQSQCVAMQMQMEKLVDKKKGFFRWKKLGIMPSLKSSVSVFEKIEEEREANFGRQTPIDIKQKPVRPPKWRKSMS

SEQ ID NO: 10274 - protein, 422 aa, Theobroma cacao
MKKLALQESITFPTQSAPDCWFDDACILDMDYFVKTISGIKAKGVRPDLIGSIIAHYASKWLPDLSSNNTEKGLTNFEESSPESVTASWMKKRFFVETLVGILPPERDSVPCNFLLRLLRTANMVGVEPSYRAELEKRISWQLDQASLKELMIPSFSHTCGTLLDVELVIRLVKRFASLDEGARSGAALVKAAKLVDCYLAEAALDTNLSLDEFIALGGALPSHARAMDDGLYRAIDTYLKAHPGVPKQDRKVLCRLIDSRKLSPEASLHAAQNERLPVRAVIQVLFSEQTKLSRHIDWSGSFSGTRSPNPGLEAPARCLSKREMNAQQMEIKKLKEDLLKVQSQCIAMQMQMEKMLDKKKGFFRWRKLGLKPSFKSSVSVFEKIEEGEGEGEVAFGLQTPMDMKAKLVRGRTPPKWRKSMP

SEQ ID NO: 10275 - protein, 232 aa, Gossypium raimondii
MGNSIGGRNKAKVMKIDGETIKLKTPIRVWDVLKDYPTGHVLLDSQTVKHYGIRAKPLEPQESLKPKKIYFLVELPKLADDEVHKAPRRVRSGGIHMSAKDRLECLMLSRRTVSDLSMVRPSSTSMVPDGVRLGGGGTSGGGMMTVKMRLPKSQMAKLMEESKDGVEVAEKILDLYTGNGGSGGDDAGNRIHREAPWKPGLGTVGENFKPKREKRVSFIPQEEGEIHLANQL

SEQ ID NO: 10276 - protein, 233 aa, Gossypium hirsutum
MGNSIGGRNKAKVMKIDGETIKLKTPIRVWDVLKDYPTGHVLLDSQTVKHYGIRAKPLEPQESLKPKKIYFLVELPKLADDEVHKAPRRVRSGGIHMSAKDRLECLMLSRRTVSDLSMVRPSSTSMVPDGVRLGGGGGTSGGGMMTVKMRLPKSQMAKLVEESKDGVEVAEKILDLYIGNGGSGGDDAGNRIHREAPWKPGLGTVGENFKPKREKRVSFIPQEEVEIHLANQL

SEQ ID NO: 10277 - protein, 217 aa, Gossypium hirsutum
GETIKLKTPIRVWDVLKDYPTGHVLLDSQTVKHYGIRAKPLEPQESLKPKKIYFLVELPKLADDEVHKAPRRVRSGGIHMSAKDRLECLMLSRRTVSDLSMVRPSSTSMVSDGVRLGGGGGGTSGGGMMTVKMRLPKSQMAKLVEESKDGVEVAEKILDLYIGNGGSGGDDAGNRIHREAPWKPGLGTAGENFKPKREKRVSFIPQEEGEIHLANQL

SEQ ID NO: 10278 - protein, 522 aa, Pennisetum glaucum
MSAAQHADPATTASSTPTAASNPTVIKNARHRPSALKLSYHLAISNLPYLLLAPFAAALLHRLSRHSPADLAAAAHSAVTSNPTLTTALLSLAAILTTVYLARRPRAVYLLDFACYKPGPEHVVTRETFMRQSEAAGVFTDDNLGFQRKILERSGLGQGTYFPRAVLNSPPNPCMAEARAEAEAVMFGAIDQVLAKTGVRARDIGVVVVNCSLFNPTPSLSAMIVNHYKLRGNVASYNLGGMGCSAGLISIDLAKQLLQVHRNTYALVVSMENITLNWYWGNNRSMLMSNCLFRMGGAAVLLTNRGGADRRRAKYQLVHTVRTHHGADDRAYRCVFQEEDETGRVGVALSKDLMAVAGEALKTNITTLGPLVLPMSEQILFLASLVGRKVFGLRSLKPYIPDFKMAFEHFCIHAGGRAVLDTIEKNLDLSAWHMEPSRMTLYRWGNTSSSSLWYELAYTEAQGRVRRGHHAWQIAFGSGFKCNSAVWRALRSVNPAEETNPWMDEIDRFPVDVPKVSKVSSG

SEQ ID NO: 10279 - protein, 522 aa, Sorghum bicolor
MSAAHQPEPTAPAAAASCGGGGDSTIKNARHRTSTLKQCYHLAISNALYLLLAPAVAYASHRFSHHTASDVTSAAAFASNPPFAVSLLVLSAVLATAYLMRRPRAVYLLDFACYKPGAGHVVTRETFMRQSEAAGVFTPDNLAFQRKILERSGLGQGTFFPAAVLNSPPNPCMAEARAEAEAVMFGAIDQVLAKTGVRARDIGVVVVNCSLFNPTPSLSAMIVNHYKLRGNVASYNLGGMGCSAGLISIDLAKQLLQVHRNTYALVVSMENITLNWYWGNNRSMLMSNCLFRMGGAAVLLTNRGSDRHRSKYHLLHTVRTHHGADDRAYRCVFQEEDETGRVGVALSKDLMAVAGEALKTNITTLGPLALPMSEQILFLASLVARKVFGVRGLRPYIPDFKMAFEHFCIHAGGRAVLDTIEKNLELSPWHMEPSRMTLYRWGNTSSSSLWYELAYTEAQGRVRRGHRAWQIAFGSGFKCNSAVWRALRTIDPKKESAVGNPWVEEIHRFPVEVPKVESVIVS

SEQ ID NO: 10280 - protein, 271 aa, Secale cereale
MSAAAQEPTAGGGGGKRPGPCRPGYLKLGYHIAVSNAVYVLLTPFAAALALRASRLAPSDLAAARAYLLANLQLAVSLASVAAALATVYLARRPRAVYLLDFACYKPGPDHVVTRETFMRQSSRAGVFTDDNLAFQRKILERSGLGQGTYFPAAVLNSPPNPCMAEARREAEAVMFGAVDGLLAKTGVRARDIGVVVVNCSLFNPTPSLSAMVVNHYKLRGNVASYNLGGMGCSAGRHLHRPGQAAAPGPPELVRAGGEHGEHHAELVLGQ

SEQ ID NO: 10281 - protein, 516 aa, Panicum virgatum
RRWRRRSGRGTFCRCCRGAWRGSSWARRPTAPWTCCRPSSAPSRRRAPAAWRGACFAENEAVLSLTPAAGGRSGTAGALSGNTSSSSSLGGAVLRLKTASPESWTCMDLYVFATPYRIAWDYYMRSNENHTFEIKAWEEAAELEYVKQHGIAVFLMPSGMLGTLLSLIDVIPLFSNTGWGQDANLAFLKKHMGTSFQKRSQPWSANIRKEDVHSGDFLALSKIRGRWGGFQTLEKWVTGAFAGHTAVFLKDENGTLWVAESGYENKKGDEIISMTPWDEWWGMALKDDSNPQIALLPLHPDVRARFNESAAWDFARSMYGKPYGYHNMIFSWIDTMSDNYPPPLDANLVMAIMSMWTRLQPHYASNMWNEALNKRLGTEKLDLHGIITETERRGLSFNQLLTIPERDDWEYSDGKSTTCVAFILSMYKAAGVFAPFTESIQVTEFTIRDAYMLKIFEDNQTRLPGWCNAAADGLPFCQILGEYKMDLPEYNTIEPYANMNENCPSAPPAYSRPARC

SEQ ID NO: 10282 - protein, 536 aa, Brachypodium distachyon
MAASVPRPRRRLPVPILLLHVLALCPPRCGAAGLSWAPFRTGGLLPRGLAWPLANTVHSAIDLLPTFVAFAAPGGRAAAWRGACFEENEAVLSLTPGPAGRNGTGAGAGLGGAVLQLKTASAQSWTCMDLYVFATPYRIGWDYYTRAHQHTFEIKSWEEAGEMEYVKQHGIAIFLMPSGMLGTLLSLIDVIPLFSNTIWGQDANLAFLQKHMGASFEKRSQPWSANIRKEDVHSGDFLALSKIRGRWGGFQTLEKWVTGAFAGHTAVCLKDENGTLWVAESGYENKKGEEVIAVVPWDEWWGMALKDDSNPQVAFLPLHPDVRARFNESAAWEFAQSMYGKPYGYHNMIFSWIDTMSENYPPPLDANLIMAVMSMWTRLQPQYASNMWNEALNKRLGTEKLDLHGIISETEKRGMSFNQLLTVPEQDEWEYSDGKSTTCVAFILSMYKAAGVFAPFTESIQVTEFTIRDAYMLRIFEDNATRLPGWCNGEADGLPFCQILGEYKMELPEYNTIEPYANMNENCPSSPPTYKRPVRC

SEQ ID NO: 10283 - protein, 536 aa, Brachypodium distachyon
MAASVPRPRRRLPVPILLLHVLALCPPRCGAAGLSWAPFRTGGLLPRGLAWPLANTVHSAIDLLPTFVAFAAPGGRAAAWRGACFEENEAVLSLTPGPAGRNGTGAGAGLGGAVLQLKTASAQSWTCMDLYVFATPYRIGWDYYTRAHQHTFEIKSWEEAGEMEYVKQHGIAIFLMPSGMLGTLLSLIDVIPLFSNTIWGQDANLAFLQKHMGASFEKRSQPWSANIRKEDVHSGDFLALSKIRGRWGGFQTLEKWVTGAFAGHTAVCLKDENGTLWVAESGYENKKGEEVIAVVPWDEWWGMALKDDSNPQVAFLPLHPDVRARFNESAAWEFALSMYGKPYGYHNMIFSWIDTMSENYPPPLDANLIMAVMSMWTRLQPQYASNMWNEALNKRLGTEKLDLHGIISETEKRGMSFNQLLTVPEQDEWEYSDGKSTTCVAFILSMYKAAGVFAPFTESIQVTEFTIRDAYMLRIFEDNATRLPGWCNGEADGLPFCQILGEYKMELPEYNTIEPYANMNENCPSSPPTYKRPVRC

SEQ ID NO: 10284 - protein, 531 aa, Hordeum vulgare
MAASAPRPRQRRLAVAVPILLALLHLFLSPPRCHAAARGLLPRRLAWSLMGSTIHSAVDLLPTFVAFAAPGGPAAAWRGACFAENEAVLSLTPGPRGSNSTAAGLGGAVLRLKTASAQSWTCMDLYVFATPYRIGWDYYTRAHQHTFEIKSWEEAGEMEYVKLHGVAIFLMPSGMLGTLLSLIDVIPLFSNTIWGQDANLAFLHKHMGASFEKRSQPWAANIRKEDVHSGDFLALSKIRGRWGGFQTLEKWVTGAFAGHTAVCLKDENGTLWVAESGYENKKGEEVIAIVPWDEWWGVALKDDSNPQVALLPLHPDVRARFNESAAWEFARSMYGKPYGYHNMIFSWIDTMSENYPPPLDANLVMAAMSMWTRLQPHYASNMWNEALNKRLGTEQLDLHGIISETERRGMSFNQLLTIPEQDEWEYSDGKSTTCVAFILAMYKAAGVFAPFTESIQVTEFTIRDAYMLRIFEDNRTRLPGWCNGDADRLPFCQVLGEYKMELPEYNTIQPYANMNENCPSSPPTYDRPLRC

SEQ ID NO: 10285 - protein, 167 aa, Triticum aestivum
MHGPVVFATPYRIGWDYYTRAHQHTFEIKSWEEAGEMEYVKLHGVAIFLMPSGMLGTLLSLIDVIPLFSNTIWGQDANLAFLQKHMGASFEKRSQPWAANIRKEDVNSGDFLALSKIRGRWGGFQTLEKWVTGAFAGHTAVCLKDENGTLWVAESGYENKKGEEVIA

SEQ ID NO: 10286 - protein, 547 aa, Oryza sativa
MAPPPPRRPVVQRSLISLLLLPVVLLALPTAAAAGAGWAPFRARDLLPLLPRGLAWPAVGSVHSAVDLLPRFVAHVAPEASSAVAWRATCFADNEAVLTLTHSSSAAAAGRNATTAGAAALGGALLRLKTASAQSWTCMDLYVFATPYRIGWDYYITAQEHTFEIKAWEEPGEMEYVKQHGIAIFLMPSGMLGTLLSLIDVIPLFSNTIWGQDANLAFLQKHMGASFEKRTQPWSANIRKEDVHSGDFLALSKIRGRWGGFQTLEKWVTGAFAGHTAVCLKDENGTLWVAESGYENKKGEEVIAIVPWDEWWGMALKDDSNPQVAFLPLHPDVRARFNETAAWEFARSMYGKPYGYHNMIFSWIDTMSDNYPPPLDANLVMAVMSMWTRLQPLYASNMWNEALNKRLGTEKLDLHGIITETGKRGMSFNQLLTIPEQDDWEYSDGKSTTCVAFILSMYKKAGVFAPFTESIQVTEFTIRDAYMLKIFEDNQTRLPSWCNSGADRLPFCQILGEYKMELPEYNTIEPYANMNENCPSSPPTYTRPLGC

SEQ ID NO: 10287 - protein, 507 aa, Gossypium hirsutum
MAGGEKKKSGGGGKKKEVKKETGLGLSFTKDENFGEWYSEVVVNGEMIEYYDISGCYILRPWAMSIWENMQTFFDAEIKKMKVKNCYFPLFVSPGVLQKEKDHIEGFAPEVAWVTKSGESDLEVPIAIRPTSETVMYPYYSKWIRGHRDLPLKLNQWCNVVRWEFSNPTPFIRSREFLWQEGHTAFATKEEADTEVLQILELYRRIYEEFLAIPVTKGRKSELEKFAGGLYTTSVEAFIPNTGRGIQGATSHCLGQNFAKMFEINFENEKGEKSMVWQNSWAYSTRTIGVMVMVHGDNKGLVLPPKVAALQVIVIPVPYKDADTQGIFDACAATVAILSDAGIRAEADLRENYSPGWKYSNWEMKGVPLRIEIGPRDLANNQVRAVRRDNGEKTDISRVFLVEQVKGMLEKIQQNLFDVAKQKRDACIEVVKTWDEFIKALGQKKLILAPWCNEEEVEKDVKARTKGEMGAAKSLCTPFEQPELPEGTKCFASGKPATKWTYWGRSY

SEQ ID NO: 10288 - protein, 545 aa, Papaver somniferum
MKDVNIYVDAMEDLNICVNRMEDVKVTNKKEKRTPKVKAPNTTGGGSGSGVGKKEVKKETGLGLSNKKDENFGDWYSEVVVSGEMIEYYDISGCYIIRPWSMAIWEIMQKFFDAEIKKMKIENCYFPLFVSSTVLQKEKDHIEGFAPEVAWVTKSGDTELEVPIAIRPTSETAMYPYFRKWIRGHRDLPLRLNQWCNVVRWEFSNPTPFIRSREFLWQEGHTAFATKDEADKEVLEVLELYRRIYEEFLAIPVVKGKKSENEKFAGGLYTTSVEAFVPNTGRGVQGATSHCLGQNFAKMFEINFENEKGEKGMVWQNSWAYSTRTIGVMVMVHGDDKGLVLPPKVASVQVIVIPVPYKDADIQAIWDACSETAEELNKAGFRAETDLRDNYSPGWKYSHWELKGVPLRIEIGPKDMAKNQVRVVRRDNGAKEDISRITLVDKIKDVLDNVQQSLFDAAKQKRDACVVVAKTWEEFTKALNEKRMILAPWCNEEEVERDVKARTKGDMGACKTLCTPFDQPELPEGTLCFASGKPAKKWTYWGRSY

SEQ ID NO: 10289 - protein, 510 aa, Chrysanthemum coronarium
MAGGGGKGKGGDKPTKSAKGRKKETGLGLTNTKDGNFGEWYSEVVTNGEMIEYYEISGCYILRPWTMAIWETMQNFFDPEIKKMNIKTCYFPLFVSNTVLQKEKDHIEGFAPEVAWVTRSGSSDLEVPIAIRPTSETVMYPYFSKWIRGHRDLPLRLNQWCNVVRWEFSNPTPFIRSREFLWQEGHTAFATKEEADTEVLEILELYRRLYEDYLAVPVVKGKKSELEKFAGGLYTTSVEAFIPNTGRGVQGATSHCLGQNFAKMFEINFEDEKGEKAMVWQNSWAYSTRTIGVMVMVHGDDKGLVLPPKVSQVQVIVIHVPFKDADTKELKKACLETVKTLKGLDIRVEADLRENYSPGWKYSHWELKGVPLRIEIGPKDLANNQVRAVCRDNGSKVDLPMADLGEKVKVMLDDIQQRMFDIAKQKRDACIQVAKTWDEFIEALGQKKMILAPWCNEEEVEKDVKAKTKGEVGAAKTLCSPFDQPELPQGTLCFASGKPAKIWTYWGRSY

SEQ ID NO: 10290 - protein, 421 aa, Gossypium hirsutum
MTAEQTSAFKSVTEWVYLDRHQNPNSSSTAGLSSWVVDDFGVQKSLGRGTEKMVFELHSHSKHSDGFLSPSKLVERAHGNGVKVLALTDHDTMSGITEAVEAARRFGIKIIPGVEISTIFSPRNPEMEEPVHILAYYSSCGPTRYEELDKLLANIREGRYVRAKDMVLKLNKLKLPLKWEHVTKIAGKGVAPGRLHVARAMVEAGYVENLKQAFARYLYDGGPAYSTGSEPLAEEAVQLICETGGLAVLAHPWALKNPIPIIRRLKDAGLHGMEVYRSDGRLAAYNDLADTYNLLKLGGSDYHGRGGHGESELGSVNLPVVVLHDFLKVARPIWCSAIKDILEGYAKEPSDTNFAKIARFTRMGSFKGSTPLSCGKDLIDRCLASWLTAEEQQNDEFEAIRLKLSHATINLSGVQVPIETK

SEQ ID NO: 10291 - protein, 254 aa, Gossypium raimondii
MVSHLVRTIRNVVGITGNVISLFLFLSPVPTFVRIWKKGSVEQYSPVPYLATLINCMVWVIYGLPMVHPDSTLVITINGAGTAIELVYLTLFLIFCHDKKKRLKVLLIALVEVVFMALVAALVLTLAHTTERRSMVVGIIAILFNIMMYASPLSVMKLVISTKSVEYMPFFLSLASFANGVAWTTYAFLPFDPFIAVPNGLGTLFSLAQLLLYATYYESTKRIIAARKETKMEVNLSEVVVNGNHDPKKTTRAT

SEQ ID NO: 10292 - protein, 254 aa, Gossypium hirsutum
MVSHLVSTIRNVVGITGNVISLFLFLSPVPTFVRIWKKGSVEQYSPVPYLATLINCMVWVIYGLPMVHPDSTLVITINGAGTAIELVYLTLFLIFCHDKKKRLKVLLIALVEVVFMALVAALVLTLAHTTERRSMVVGIIAILFNIMMYASPLSVMKLVISTKSVEYMPFFLSLASFANGVAWTTYAFLPFDPFIAVPNGLGTLFSLAQLLLYATYYESTKRIIAARKETKMEVNLSEVVVNGNHVPKKTTRAT

SEQ ID NO: 10293 - protein, 258 aa, Gossypium hirsutum
MVSHLVNTIRNVVGITGNVIALFLFLSPVPTFIRIWKKGSVEQFSPVPYLATLINCIVWVIYGLPMVHPNSILVITINAAGTAIEVVFLTLFLIFCHDKKKRLKVLLIIMVELIFMAALATLILTVLHTTQRRSIIVGIIAILFNVMMYAAPLSVMKLVITTKSVEYMPFFLSLASFANGVAWTTYAFLPFDPFIAVPNGVGTIFSLAQLLLYATYYKSTKRIIAARKEAKMEMHLSLSEVAVANGDVDPKKTAGATP

SEQ ID NO: 10294 - protein, 258 aa, Gossypium raimondii
MVSHLVNTIRNVVGITGNVIALFLFLSPVPTFIRIWKKGSVEQFSPVPYLATLINCIVWVIYGLPMVHPNSILVITINAAGTAIEVVFLTLFLIFCHDKKKRLKVLLIIMVELIFMAALATLILTVLHTTQRRSIIVGIIAILFNVMMYAAPLSVMKLVITTKSVEYMPFFLSLASFANGVAWTTYAFLPFDPFIAVPNGVGTIFSLAQLLLYATYYKSTKRIIAARKEAKMEMHLSLSEVTVANGDVDPKKTAGATP

SEQ ID NO: 10295 - protein, 255 aa, Theobroma cacao
MVSHLVNTIRNVVGITGNVISLFLFLSPVPTFVRIWKKGSVEQFSPTPYLATLINCMVWVIYGLPMVHPNSTLVMTINGTGTAIEFAYISLFLIFCPDKKKGLKVLLIVLVELIFIALVTTLVLTLVHTTERRSMVVGIIAVLFNITMYASPLSVMRLVISTKSVEYMPFFLSLASFGNGVIWTTYAFLPFDPFIAVPNGLGTLFSLAQLLLYAIYYKSTKRIIATRKETKMELNLSEVVVVSGDIDHKKTGGVP

SEQ ID NO: 10296 - protein, 410 aa, Setaria italica
MPAADPPAAADAASDEGAPHHAPPPRPRPPPPPRPLSLASALPFWFYLAAAVSLLAILLPRISPSSSAPAPLPPLLRGHLASGSVLKLDPAPGLFAVTSRPAAAAAGGGSPAHRVLILPGLAAGSFSFRRVLSSLSSRGVLAAALDLPGQGLSPVPPSAAAPARTSALREIMDRGIFHAFEHLVQTGEVPYQEETAAPLAQSPHAPAEAAAAVARAVEALGVAPVHLVLHDSSLAAGAAFASANPGAVRSVTLIDATASVPAFPAAVFDVPVLGRLVLRVPALFRGLVRLCCVRGMGAEEVEAHRETMRGEGRTHEVIEAWKAMNHSFQLGEWRGSSDEVRRLPMMVLWSGTWSDMWIDEGKKVAAALPDARFVYHSGGRWPQEDASEEISRLIAEFVTSSEEASDDRIE

SEQ ID NO: 10297 - protein, 131 aa, Saccharum officinarum
MASIAGSSALSFARPVKAINTNSLAFSTVRKGNAFLRLQPMTMRSVSCAAKKDTVDKVCEIVKKQLALPDHTEVCGESKFSELGADSLDTVEIVMGLEEHFDISVEESSAQTIATVEDAADLIDKLVAGKA

SEQ ID NO: 10298 - protein, 131 aa, Zea mays
MASIAGSSALSFAMPVKAINSNSLAFSPVRKGNTFLRLQPVPMRSVSCAAKKDTVDKVCEIVKKQLALPDHTEVCGESKFSELGADSLDTVEIVMGLEEHFDISVEESSAQTIATVEDAADLIDKLVAVKA

SEQ ID NO: 10299 - protein, 131 aa, Sorghum bicolor
MASIAGSSALSFARPVKAINTNSLAFSPVKKGNTFLRLQPVPMRSVSCAAKKDTVDKVCEIVKKQLALPDNTDVCGESKFSELGADSLDTVEIVMGLEEHFDISVEESSAQTIATVEDAADLIDKLVAGKA

SEQ ID NO: 10300 - protein, 135 aa, Echinochloa colona
MASIAGSALSFARPVKAVNTSSISFSAPRKGNAFLRLQSVPKRFAVCCAAKKDTVDKVCEIVKKQLAVPDGTEVCGASKFSDLGADSLDTVEIVMGLEEEFKISVEESSAQSIATVEDAAELIDKLVAAKPTESQ

SEQ ID NO: 10301 - protein, 764 aa, Zea mays
MVTEMAARGGEAAAFGAETDRGDFEVFRSGSAPPTVEGALGAAGADGGLLVDDDLRADPAYQSYYYSSAHLNPRLPPPLLSKEDWRSSHHRLRSAGFGGIGDGRRQQQQASAAEGTVGLPGIDLGRQRSFSTIFQEDSYQRDMDRHTASHNSNDLLGSSGIQYGLNRGSGTIGGLHSSNSLRSLDEIQNNDLPSNTFASILGSSLSRSASPDPELVRRAPSPSLPPIGVKVGNTDKKINGGSTSFRRSSSAIGESDDLVAALSGMNLSSRAMSGQTMDQSQLYQDVDNVQKFLFDRQGDQTTGNQQHYMRRPEQGQSKLPDGYSANLANSSTMRNQINAGSFTSFDSLSLGSGFASPRIGSRSPGGTVSSRQNLAGMSNMLNYNGIGSPTASPSLQTSIDPAYIQYLAQLAATCDDPLMDRGHLGNSYMDLLGTHKANIGPLLQSQKQYGYYGNLGFNLGYPGSPLASPVLPSSPIAPGSPLRHGERNMRFPSGMRNFGNSFGSWNSGMGGKMDANLMPSLLEEFKSNKSKSYELSEIAGHVVEFSADQYGSRFIQQKLETASTEEKDMVFSEIMPQALTLMTDVFGNYVVQKFFEHGSTAQIKELAGQLIGRVLALSLQMYGCRVIQKAIEVVDLELQTKMVAELEGHVMRCVRDQNGNHVIQKCIECIPQHAIEFIISTFYGQVVMLSTHPYGCRVIQRVLEHCDDPKTQQIMMDEILQSVCLLAQDQYGNYVVQYFCLSNLAMCHAAMWNMKQQERQGVDA

SEQ ID NO: 10302 - protein, 756 aa, Cicer arietinum
MAVADGTGGGTIIIDETYEFSAPRFFDFTKGESDDEIRRAELWFHTALSYAPSPFMPKIKAGRSITVGTLCDFSEADDMPKTSANVEESSVLESKTQPQSMASKIKEEDEDNKENLTTPSHVISTNKKDDAPCCEVKEESNSTTSVEDSVGKKESDHKGDSLKVLPSVEVGKDACTPNPALRKNVTSSSTISKKLQNSKKVTTNTKTRLQSAAKKSTAGTPHLAQENQAIKKQKLEGGQSRQILNVKPQTYPHNKSKLGYSSSTSKTLKEDRKTYVRETPKTPASAPFVSMAEMMKRFQSSTRDLPMHTLSHIKPKLTLTRPKEPEFETTQRVRPARVKSAAELEEEMMAKMPKFKARPLNKKIMQTPTLPPLPRSAPQPPEFKEFHLETLARAHQNTDSASRASTEVSHKENSSKVHYSEPKTPVLQTLLRARPTTVKSSLEIEEEELEKIPKFKARPLNKKIFESKGDIGISCHTKKHVTEPQEFHFATNERFPPPAAVADLFDKLSLKSEPARNHNTIPRTTTPNPFHLHTEERGAEKEKKLLMDILQKQFEEEVARVPKANPYPYTTDYPVIPPKPEPKHCTKPEPFQLESLVRHEEEMQREQEERLRMEREEAKMRKFKAQPIIKEDPIPVPEKVRKPLTQVQEFDLHLNIRAVDRAQFDGRIKEKEMMYKRYREESEAARMIEEEKAVKQMRRTMVPHARPVPNFDNPFCPQKSSKTTKPKSPNLRVFQRKERRKIFNGPAFSSPATNMR

SEQ ID NO: 10303 - protein, 451 aa, Solanum phureja
MSQSLNPNPTYDVIILGASGFTGKYVIREALKFLNVPSSPLKNLAIAGRNTSKLSQALQWASRPNPPPEIPILTANTTDPSSLRDLASQTKIILNCVGPFRLYGEPVVEACADSGCDYLDISGEPEFMERIEMKYHDKAVENGSLVVSACGFDSIPAELGLMFNSRQWLPPAVPNSVEAYLSLESDKRIVGNLGTYESAVLGVANVDKLQELRRSRPKRPRPVIPGPPPPKGPLMDHLKEVGVWAVKLPSADAIVVRRTLSCLAENPHGLPGVNESTEQVERRETFWSSIKPAHFGVKIASKSPLGIVRFIIVGLFIGLFGKTGLWRWLLLKFPSLFSLGWFRKKGPTEDEVASATFKMWFVGHGFSDGSLASQGNMKPDTEIITRVMGPEVGYLTTPIILVQCALILLKERNNLPKGGVFPPGVVFGPTDLQNRLQHNGISFDVISKKTI

SEQ ID NO: 10304 - protein, 452 aa, Nicotiana benthamiana
MSQNLNTNPTYDVIILGASGFTGKYVIREALKFLNVPSSPLKSLAIAGRNSSKLSHALQWASRSNPQPQIPILTADTTDPSSLRHLASQAKLIFNCVGPFRLYGEPVVKACADSGCDYLDICGEPEFMERMEMKYHDKALETGSLIVSACGFDSIPAELGWMFNSRQWLPPAICNRIEGYISLESDKRIVGNLGTYESAVLSVANADKLQELRRSRPKRPRPVISGPPPSKGPMVHHLKEIGLWAVKLPSADATIVRRTLLCLAEAPRGLPGVSESIEQIERREAFWSSIKPAHFGMKIASKSLLGVVRFIIVGWFLGHFGQTSIGRWLLLNFPSVFSLGYFRKKGPTEDEVASANFKMWFVGQGYSDSKLASQGNKKPDTEIITRVMGPEIGYMTTPIILVQCALVLLKERDNLPKGGVFPPGIVFGPTDLQDRLPQNGISFDVISKKTIN

SEQ ID NO: 10305 - protein, 367 aa, Solanum phureja
MVLKVSVLLLFSFLFTASAVRSAPPLEGLLPNGNFEELPKPKDLKKKTVLQGKYALPKWEINGLVEYISGGPQPGGMYFAVAHGVHAVRLGNEASISQTIPVKKGSLYALTFGASRTCAQEEVLRVSVPPQTGDLPLQTLYSSNGGDTYAWGFYATSNVVKVTFHNPGVQEDPACGPLLDAVAIKELFPPRPTRVNLVKNAGFEEGPHLLINSSHGVLLPPKQEDLTSPLPGWIIESLKAVKFLDSAHFNVPFGQAAVELLAGRESALAQIIRTVPKKVYAFTFSVGDAKNGCHGDMMVEAFAAKETFKVPFKSQGKGSFKTVSFKFTAIADRTRITFYSSFYHTKINDYGALCGPVVDEVKVTPVA

SEQ ID NO: 10306 - protein, 367 aa, Solanum lycopersicum
MVFKVSVLLLFSFLFTASAVRPAPPLEGLLPNGNFEELPKAKDLNKKTVLQGKYALPKWEINGLVEYISGGPQPGGMYFAVAHGVHAVRLGNEASISQTIPVKKGSLYALTFGASRTCAQEEVLRVSVPPQTGDLPLQTLYSSNGGDTYAWGFYATSNVVKITFHNPGVQEDPACGPLLDAVAIKELFPPRPTRVNLVKNAGFEEGPHLLINSSHGVLLPPKQEDLTSPLPGWIIESLKAVKFLDSAHFNVPFGQAAVELLAGRESALAQIIRTVPKKVYAFTFSVGDAKNGCHGDMMVEAFAAKETFKVPFKSQGKGSFKTVSFKFTAIADRTRITFYSSFYHTKINDYGALCGPVVDEVKVTPVA

SEQ ID NO: 10307 - protein, 367 aa, Capsicum annuum
MVVKVSVLLLFSLLFTASALRPAPTLEGLLPNGNFEEPPKPKDIKKKTVLQGKYSLPKWEISGLVEYISGGPQPGGMYFPVAHGVHAVRLGNEASVSQTIPVKKGSLYALTFGASRTCAQDEVLRVSVPPQTGDLPLQTLYSTNGGDTYAWGFYATSNLVKVTFHNPGVQEDPACGPLLDAVAIKELFPPRPTRVNLVKNPGFEEGPHLLINSSHGVLLPPKQEDLTSPLPGWIIESLKAVKFLDSAHFNVPFGRAAVELLAGRESALAQIIRTVPKKVYAFTFTIGDAKNGCHGDMMVEAFAAQETFKVPFKSQGKGSFKTVSFKFTAIADRTRITFYSSFYHTKINDYGALCGPVVDEVKVTPVA

SEQ ID NO: 10308 - protein, 363 aa, Nicotiana benthamiana
MVVKVSILLLFSLLFTVSAVRPAPPLEGLLPNGNFEEQPKPKDLKKKTVLVGKYALPKWEINGLVEYISGGPQPGGMYFPVAHGVHAVRLGNDASISQTIPVKKGSLYALTFGASRTCAQDEVLRVSAPPQTGDLPLQTLYSSNGGDTYAWGFYATSNLVKVTFHNPGVQEDPACGPLLDAVAIKELFTDLNLVKNPGFEEGPDLLINSSHGVLLPPKQEDLTSPLPGWIIESLKAVKFLDSAHFNVPFGRAAVELLAGRESAIAQIIRTVPKKVYAFAFTVGDAKNGCHGDMMVEAFAAKETFKVPFKSQGKGSFKTVSFKFTAIADRTRITFYSSYYHTKINDYGSLCGPVVDEVKVIPVA

SEQ ID NO: 10309 - protein, 371 aa, Sesamum indicum
MEVKKKICLLVYCVWFVYAVSGVAPPPAPLEGLLPNGNFEEKPKPTDLKKTVLQGKRALPKWEIDGLVEYISGGPQPGGMYFAVAHGVHAVRLGNEASVSQTIPVKNGSLYALTFGASRTCAQDEVLRVSVPPQTGDLPLQTLYSSNGGDTYAWGFRANSDSVKVIFHNPGRQEDPACGPLLDAVAIKELFPPRPTRVNLVKNNGFEEGPHLLINSSHGVLLPPKQEDLTSPLPGWIIESLKAVKFIDSANFNVPFGKAAVELLAGRESAIAQVIRTVPNKAYNLTFVVGDAKNDCHGSMMIEAFAAKSVMKAPFKSEGKGKFSTYSFKFTATLYRTRLTFFSSFYHTKVHDYGALCGPVLDEVRVFPAKA

SEQ ID NO: 10310 - protein, 368 aa, Mimulus guttatus
MKMKISFMLSLCFLYTVSALAPPPPFEGLLPNGNFEEKPSPKDIKKTVLQGKHALPKWEINGFVEYISGGPQPGGMYFAVAHGVHAVRLGNEASISQTIPVKNGSLYALTFGASRTCAQDEVLRVSVPPQTGDLPLATLYSSNGGDTYAWGFRANSNYVKVIFHNTGMQEDPACGPLLDAVAIKELFPPKPSRVNLVKNEGFEEGPHLLMNSSHGVLLPPKQEDLTSPLPGWIIESLKAVKFIDAKHFNVPFGKSAVELVAGRESAIAQIIRTVPNKVYNLSFVVGDAKNGCHGSMLVEAFAAKTTAKAPFKSEGKGKFSTYSFQFTAVSDRTRLTFFSSFYHTRIDDFGSLCGPVLDEVRVFPAAKM

SEQ ID NO: 10311 - protein, 157 aa, Mimulus guttatus
MKNHLHVIRISPKSPSISVATVATIKCSQREVPCLRRHRNPQNLILCTSSRCTECECVQRAVFHGDGLGNRGLVSEANCVDPVCHGEVHATWLGPTGDVLNEAVDFPFGEGVFALEHCFLDVFRARFLFEIPIRGEALQKEVVVQEQTQCRESTEKA

SEQ ID NO: 10312 - protein, 365 aa, Manihot esculenta
MAMGVFPLLAFFLLFNGSALAANYMEGFLKNGNFEQKPKPSDLNKTVLKGKYALPGWITNGLVEYISAGPQPGGMYFAVAHGVHAVRLGNEASISQTIPVKPGSLYALTFGASRTCAQDEVLRVSVPPLSGDLPLQTLYSSNGGDTYAWGFRAKSNVATVTFHNPGVQEDPACGPLIDAVAIKELFPPRPTRDNLVKNPGFEEGPHRLLNSSNGVLLPPKQEDLTSPLPGWIIESLKAVKFIDSKHFNVPFGLAAVELLAGRESAIAQILRTIPNKIYNLTFTVGDAKNGCHGSMMVEAFADKETFKVPFESQGKGISKTVSFKFKAISARTRITFYSSFYHTRVDDFGSLCGPVLDQVRVFPVA

SEQ ID NO: 10313 - protein, 368 aa, Mimulus guttatus
MKMKISFMLSLCFLYTVSALAPPPPFEGLLPNGNFEEKPSPKDIKKTVLQGKHSLPKWEINGFVEYISGGPQPGGMYFAVAHGVHAVRLGNEASISQTIPVKNGSLYALTFGASRTCAQDEVLRVSVPPQTGDLPLATLYSSNGGDTYAWGFRANSNYVKVIFHNTGMQEDPACGPLLDAVAIKELFPPKPSRVNLVKNEGFEEGPHLLMNSSHGVLLPPKQEDLTSPLPGWIIESLKAVKFIDSKHFNVPFGKSAVELVAGRESAIAQIIRTVPNKVYNLSFVVGDAKNGCHGSMLVEAFAAKTTSKAQFKSEGKGKFSTYNFQFTAVSDRTRLTFFSSFYHTRIDDFGSLCGPVLDEVRVFPAAKM

SEQ ID NO: 10314 - protein, 554 aa, Hordeum vulgare
MSVAPSARSGCGAAKAARRHQAGRAGGGRRRAAVVLLLLALAYATGLLMFVLGGGGSVDIGGRAGVTVASLRRPAPSPPPPGSVYRSHIVFKRLWPDIRDDAASASTATSASASTSSPWRRSMLMTSRYPNSGELWMPCVKRTLIPSDVPPSNGYLIVEANGGLNQQRLSICDAVAVASLLNATLVIPIFHLNSVWRDPSKFSDIFDEDRFIGTLRQHVRVVKELPKDVVLRFNHNISSIPNMRTKAYSSPDHYVQKVLPKLLELGVVRIAPFSNRLAQSVPSNIQALRCLVNYQALRFAEPIRVLADDMVVRMMKKSSLAGGRYVSVHLRFEEDMVAFSCCTYDGGRKEKIEMENARERSWRGKFHRPGRVINPEANRRDGKCPLTPLEVGMMLRGMGFDNTTFLYVASGKIYNAAKYMAPLRQMFPLLQTKDTLALPEELAEFEGYSSRLAALDYTVCVQSEVFVTTQGGNFPHFLMGHRRYLLGGNAKTIKPDKRKLVLSFDDPNIRWSRFKHHMQEILHNSDIRGIAFRKPNDSIYTFPMPDCMCQQDGT

SEQ ID NO: 10315 - protein, 557 aa, Secale cereale
MSVAPSARGGCGVAKAARRHQAGRAGGGRRRTAVVLLLLALAYAAGLLMFVLGGGGSVDGGGHAGVTVASLRRRRAPAPSQPPPGSVYRSHIVFKRLWPDIRDDAASASTATSASVSTSSPWRRSMLMTSRYPNSGELWMPCVKRRLIPSDVPPSNGYLIVEANGGLNQQRLSICDAVAVASLLNATLVIPILHLNSVWRDPSKFSDIFDEDRFIGTLRQHVRVVKELPKDVLLRFNHNISSIPNMRTKAYSSPDHYVQKVLPKLLELGVVRIAPFSNRLAHSVPSNIQALRCLVNYQALRFAEPIRVLADDMVVRMMKKSSLAGGKYVSVHLRFEEDMVAFSCCTYDGGRKERMEMENARERSWRGKFHRPGRVINPEANRRDGKCPLTPLEVGMMLRGMGFDNTTFLYVASDKIYNAAKYMAPLRQMFPLLQTKDTLALPEELAEFEGYSSRLAALDYTVCVQSEVFVTTQGGNFPHFLMGHRRYLLGGNAKTIKPDKRKLVLSFDDPNIRWSRFKQHMLEILHHSDIRGIAFRKPNDSIYTFPIPDCMCQQDGI

SEQ ID NO: 10316 - protein, 558 aa, Brachypodium distachyon
MSVAASARGGGGGAAKAARGGRFSAGRGVWGRRRAAVVLFLALAYAAALLVFVFGGGGGGGSAGGGAGLTVASLRRRRHGEPAPSTPPPPGSVYRSHIVFDRLLPEIRDDAAPSASVSTPSSWRRSMLMTSHHQNSGEVWMPCVNRRLIRSELPPSNGYLIVEANGGLNQQRLSICDAVAVASLLNATLVIPIFHLNSVWRDPSKFSDIFDENRFIETVGKHVRVVKELPEDVLLRFNYNISSIPNMRTKAYSSPHHYLHKVLPKLLELGAVRIAPFSNRLAQSVPSNIQALRCLVNYQALRFAEPVRLLAEDMVVRMMKKSSSTGGKYVSVHLRFEEDMVAFSCCTYDGGWKEKIEMENARERSWRGKFHRPGRVINPEANRRDGKCPLTPLEVGMMLRGMGFDHSTFLYVASGKIYNAAKYMAPLRQMFPLLETKESLALPEELAEFEGYSSRLAAIDYTVCVQSEVFVTTQGGNFPHFLMGHRRYLFGGNAKTIKPDKRKLVLSFDDPNIRWSQFKRHMQEILHHSDIKSIAFRKPNDSIYTFPMPDCMCQQDGI

SEQ ID NO: 10317 - protein, 794 aa, Brachypodium distachyon
MATLEDLGVSAFINIVGAFVFLLLFAFLRIQPINDRVYFPKLYLARKRTHDQRGVRGVINLNLCTYLRFLSWVPGALRMNQTELIHHAGLDSAVYLRIYTLGLKIFLPIMVVALLVLIPVNVAGGTLLNIRKEVVFSDIDKLSISNVSPGSNRFFIHLLMAYVFTFWTCFMLYKEYSNVAFMRLHFLASQKRCADQFTVIVRNIPRVSSHSTSETVDEFFRRNHPDHYLGQQAVYNANRYAKLVKRKERLQNWLDYYQLKFERHPEKRPTGRTGCFGFCGRKVDQIDYYRARISELDKRMASERQRVLNDPKAVMPVSFVTFDSRWGAAVCAQTQQSKNPTQWLTDWAPEPRDVYWQNLAIPFFSLSIRKFLISIAVFALVFFYMIPIAFVQSLANLEGIEKVAPFVRPVIEVKVVKSFLQGFLPGLTLKLFLYILPTVLMIMSKVEGYVSLSSLERRTASKYYYFMLVNVFLGSIIAGTAFEQLYSFFHDPPSQIPRTIGVAVPMKATFFMTYIMVDGWAGIANEILRVKPLIIYHLKNMFIVKTERDRERAMDPGSIGLGENLPSLQLYFLLGLVYAVVTPILLPFIIVFFAFAFLVYRHQIINVYNQEYESAAAFWPQVHSRIIASLLISQVTLFGLLSTMKAAYSTPLLIFLPLLTIWFHKYCKSRFEPAFRKYPLEEAMEKDRLEHASEPSLNLKTYLANAYLHPIFHMFEQEDQKEETTVEVRIDKAQQQQQHHVRSSHSQYHEEESSITETHYNHQEERTSQVQYQYHYQHHHEENMGSQQSPPHFV

SEQ ID NO: 10318 - protein, 505 aa, Triticum aestivum
MATLQDLGVSAFINILGAFVFLLLFAVLRIQPINDRVYFPKLYIAGKRAADHRGARRAINLNLCTYFKFLSWVPGALRMTQTELIHHAGLDSAVYLRIYTLGLKIFLPVMVVALLVLIPVNVSGGTLLNLRKDVMFSDIDKLSISNVSPGSNRFFIHLLMAYVFTFWTCFMLYKEYSNVAFMRLHFLASQKRCADQFTVIVRNIPRVSSHSTSETVDEFFRRNHPDHYLGQQAVYNANRYAKLVKQKERLQNWLDYYQLKFERHPEKRPTGRTGCFGFCGRQVDQIDYYRARISELDKRIASERQRVLNDPKAIMPVSFVTFDSRWGAAVCAQTQQSKNPTQWLTNWAPEPRDVYWQNLAIPFFSLSIRKFLISIAVFALVFFYMIPIAFVQSLANLEGIERVAPFLRPVIEVKVVKSFLQGFLPGLALKLFLYILPTVLMIMSKVEGYVSLSSLERRTASKYYYFMLVNVFLGSIIAGTAFEQLDSFFTILLHKYQGPLEWLYQ

SEQ ID NO: 10319 - protein, 635 aa, Zea mays
MEPKGELAQKRILPSRFAHPYAIEEAINSLEIDASTKASNVNLPAKKDASSSDAVSCISSGDAASTAKESEMNRETSFGDQGMYYYGYYYPGSYGGWDENGYFVGYNGVEVHPAVVQTDNGSYLCHLPGYENGYASYSQVVPGGIASVDGQYVSKEPYYSTALPIQDPRTPGIFAQPIAYRTELASAYSWDPSFVLLDGVQGHPVGVHQTNYAARPKYSFNKHVIPSSKATRSAKSAADTVKGSSSALETVTNAVNSSPPSKSANKTPGASITKGYLPYSKSVMHTNNQEKNSVYQSKGINVKESGRSWNSREKLGRSKLNGQGDSESNENNHTDNLKHSLSHRSDVVGLSSAGDANASIPSPVAISKNACNLSDFVTKYEQALFFVIKSYSEDDIHKSVKYNVWASTPNGNKRLDNAYRVAQERIAEKGTKCPVFLFFSVNASGQFCGVAEMVGPVDFNRNMNFWQQDKWNGFFSVKWHIIKDVPNPQFRHIILENNENKPVTNSRDTQEVNFSQGTEMLNIFKNFTCKTSILDDFDFYENRQKVMQDRRGKLLTTSFDHPLPKAEKSPEIKSQTQLISGPEVGRAKSDEGQGNNVGMVLDTTKKNEEQSSNVPEILDAACSNKEQPNKIAIEG

SEQ ID NO: 10320 - protein, 610 aa, Setaria italica
MEPKGELGQKPIEEAMDSLKIDASTKASNVNLPAKKDASSSDAVSCISSGDAASTVKESEMNQEASIGDQGMYYYGYYYPGSYGGWDENGYFVGYNGLEMHPAVVQGDNGSYLCYLPGYESGYASYSPVVPGGITSADGQYVSKEPYYSTAIPMQDPSTPGIFAQPIAYGPELVPAYSWDPSFVLLDGVQGHPVGVHQTNYAARPKYSSNKHGVPSSKAARSAKSAPETIKGSSSALETLPNAANSIPLSKGANKASGASTTKGYLPSSKFVTHSNNQGKSSVYQNKGINVKENGRSWINNEKLKTRSKLNGHGDSDISNENSHTDNSKHSLSPRGDVVGLSSAGDANETILSPVTISKNAYNLPDFVTKYEQALFFVIKSYSEDDIHKSIKYSVWASTPNGNKRLDNAYRLAQERMAEKGTKCPVFLFFSVNASGQFCGVAEMVGPVDFNRNMNFWQQDKWNGFFSVKWHIIKDVPNPQFRHIILENNENKPVTNSRDTQEVKFPQGTEMLNIFKNFSCKTSILDDFDFYENRQKVMQDRRGKPLTTSFDHPLPKAEKPAEIKKQTQLISGAQLDTTKKSEEQSNNVAEVLDVAQSNKELPSKVATEGR

SEQ ID NO: 10321 - protein, 609 aa, Zea mays
MEPKGESGQKPIEEAIDSLKTDASMKANNVNLPAKKDASSSDAVSCISSGDAASTVKDREMNQETSFGDQGMHYYGYYYPGAYGGWDENGYFVGYNGLEVHPAVVQADNGSYLCYPLGYENGYASYIPVVPGGIASVDGQYVSKEPYYSSALPIQDPSTPGIFAQPIAYGTELVPAYSWDPFVLLDGVQGHPVGVHHTNYAPRPKYSSNKHVVPSLKASHSAKSTADTVKGSSSALETVPNAANSSTSSKGANKAPGASITKGYLPSSKFVMHSNNQAKSSVYQSKGINLKESGRSWHSSEKLKARSKLNGHGDSESNENNHTDNSKYSLSSQSDVVGLSSVGDANASIPSPVVIRKTAYNLSDFVTKYEQALFFVIKSYSEDDIHKSIKYNVWASTPNGNKRLDNAYRLAQERMAEKGTKCPVFLFFSVNASGQFCGVAEMVGPVDFNRNMNFWQQDKWNGFFSVKWHIIKDVPNPQFRHIILENNENKPVTNSRDTQEVKFSQGTEMLNIFKNFTCKASILDDFDFYENRQKVMQDRRGKPLTSFGHPLPKAEKTAEVKRQTQLISATEVGRADTTKENEEKSSSVPEILNAACSNKEKPNKIATDG

SEQ ID NO: 10322 - protein, 611 aa, Panicum virgatum
MDSLKIDASTKASNVNLPAKKDASSSDAVSCISSGDAASTVKESEMNQEASTGDQGMYYYGYYYPGSYGGWDENGYFVGYNGLEMHPAVVQGDNGSYLCYLPGYENGYASYSPVVPGGVTSADGQYVSKEPYYPTAIPMPDPSTPGIFAQPIAYGPELVPAYSWDPSFVLLDGVQGHPVGVHQTNYAARPKYSSNKHGVPSSKAARSAKAAPETIKGSSSALEPLPNSANSNPLSKGANKASGASITKGYLPSSKFVTHNNNQGKSSVYQNKGINVKESGRSWTNSDKLKTRSKLNGHGDSDISNENSHTDDSRHSLSPRGDAVGLSSTGDANNTIPSPVAISKNTYNLPDFVTKYEQALFFVIKSYSEDDIHKSIKYNVWASTPNGNKRLDNAYRLAQERMAEKGTKCPVFLFFSVNASGQFCGVAEMVGAVDFNRNMNFWQQDKWNGFFSVKWHIIKDVPNPQFRHIILENNENKPVTNSRDTQEVKFPQGTEMLNIFKNFSCKTSILDDFDFYENRQKVMQDRRGKPLASSFDHPLAKAEISAEIKKQTQLISGTQLDRTKSNEGQGSTVGMAPDTTKKNEEQSNNVAEVLDVVQSNKELPSKVATEG

SEQ ID NO: 10323 - protein, 391 aa, Zea mays
MLLLPGRPVLSPALQYSSSPSPSRLRPLPCTSNAPTSASTAADAATPSSFSVEDYLVNRCNLYANVAARVAPELSAIRSPSKPDAVLAFLANTLELSPPLIAVAVARDPTILTCSVPRTLAPRAEELRALGFTAFQMGLIVARCGAAAFRSRALVPSVQFWLPYLRGRVDKLVAALKGNPGLLTADLRTVKSTVALLQEEGTLTDGDVGWFAISYCSKLLVASPDEVDSVLARADEFGVPRKTRAFKDAIIAAFSVTPERLAWKVAFFRDELGWTEAQVKTAAAKMPTLMTVSAERIRRNWEFLTTEVGMDAERVASFPALLRYDLEGRLVPRFQVMRVLQARRLWRGRDFNNIAAITEEDFVAKFIRPFLVKVPSLAKIYEAAVIEKEEQ

SEQ ID NO: 10324 - protein, 392 aa, Setaria italica
MLLLPRHPVLSSPALPSSPSPSPSRFRPLPCTNASTSASTAAPAGAFSVEDYLVTRCNLYPNVAARVAPELSAIKSPSNPDAVLAFLASALELSPPLVAVAVARDPAVLTCSVPRTLAPRAAELRALGFTTFQMGLLIARCGAAAFRSPDLVPRVQFWLPYLRGRVDKLVAALKGNPGLLAADLRTVRHTVALLQEEGTLTDDDVGWFAISYCSKLLTASPDEVDAVLARADGFGVLRRTRAFKDAIIAAFSATPERLAWKAAFFRDELGWTEAQVKTAAAKMPTLMTVSAERLRRNWEFLNTEVGMDAERVASFPALLRYDLEGRLVPRFRVMRVLQARRLWRGRDFNNIAAITEEDFVAKFIRPFLVNVPDLAKVYEAAIVKKEAVKHSS

SEQ ID NO: 10325 - protein, 401 aa, Panicum virgatum
MLLLPRQPVLSAPALPSFPSPSLPPSRFRPLPCTDSRTCASTTASADATSASSAASAGAFSVEDYLVTRCNLYPNVAARVATELYAIKSPSKPDAVLAFLASALELSTPLIAIAVARDPTILTCSVSRTLAPRADELRALGFTTFQMGLLVARCGAAAFRSRELISRVRFWLPYLRGRVDKLVGALKVNPGLLSADLRTARSTIALLQEEGTLTDDDVGWFALSYCSKLLTASPDEVDAILARADEFGVPRRTRAFKDAIIAAFSAKPERLAWKAAFFRDELGWTEAQVKTAAAKMPTLLTVSAERLRRNWEFLTTEVGMDAERVANFPALLRYDLQGRLVPRFQVMRVLQARRLWRGRDFNNIAAITEEDFVAKFIRPFLVEVPNLAKVYEAAVVKKEAQ

SEQ ID NO: 10326 - protein, 413 aa, Panicum virgatum
PLSHLLSDYIRRVISRPSRRCCCDAPPPEESSPHRPGAAILPLPLALSIPPPPLPCTDSRTCASTTASADATSASPAASAGAFSVEDYLVSRCNLYPNVAARVAPELSAIRSPSKPDAVLAFLASALEFSTPLIACSVLRTLAPRADELRALGFTTFQMGLLVARCGAAVFRSRELISTVQFWLPYLRGRVDKLVAALKGNPGLLSADLRTVRSTIALLLEEGTLSDDDVGWFAISYCSKLLIASPEEVDDVLARADEFGVPRKTRAFKDAIIAAFSAKPERLAWKAAFFRDELGWTEAQVKTAAAKMPTLLTVSAERLRRNWEFLTTEVGMDAERVANFPALLRYDLEGRLVPRFQVMRVLQARRLWRGRDFNNIAAITEEDFVAKFIRPFLVKVPNLAKVYEAAIVKKEAQ

SEQ ID NO: 10327 - protein, 648 aa, Pennisetum glaucum
MATYYSSPGSERDSQNMYSRDPGNASYPMPSALGNLLYLNNSTSGPYTEFSGILQPQQNFMEMPDPGHPSVMSQDSSARESDMLGSHQGQSSFGPVKDMKNEMLMHMMDGSQSSTADLIHDDAHNGAQLDFGVLNNHSSSNIPSVQGQGLSLSLNTQILAPSLPYWSVKPDMLSPHSYHDSLRVDDIRMKSMQSEASRAIRNSRYLKAAQELLDEVVNVWKNIKQKAQKEQVEAGKTDGKETEGGAKSEGSNPQESAANAAPELSTAEKQELQNKMAKLMAMLDEVDRKYKHYYHQMQSVVSSFDVVAGPGAAKPYTAVALQTISRHFRCLKDAINDQINVIRKKLGEEENSSGKEGKLTRLRYIDQQLRQQRAFQQYGMIPQNAWRPQRGLPENSVTILRAWLFEHFLHPYPKDSEKMMLARQTGLTRSQISNWFINARVRLWKPMIEDMYKEEIGDIEQDSNSSSDNAPRSKGKMASSEDKEDLKSSTPRVCDSSQLSESRASIGTMNIGGAPVGFHNEPNPDDSFMNLMLKDQRSNEADGGLLLHNAVAHHQDENARFMAYHLAELGRYGNGNVSLTLGLQHSSSSLSVPNAHHQQSFPGVGDDDIYNATAPLGVSIASSDYDSMNQMDQRQRFEQSPLLHDFVA

SEQ ID NO: 10328 - protein, 650 aa, Triticum aestivum
MATYYSSPGSERESQDMYSRDPGGASYPMSSALGNLLYLNNPSSGPYTEFSGILQTQQNFMEMPAHGHHSAMSQDSSARESQDMLASHHGQRSFGHVKDMKNEMLMHMMDGAQSGGAELIHDDPHNGAQFEFGVLNNHDSSDVPVGQGQGQGQGLSLSLNTQILAPSLPYWSIKPDMLTPNSYQESLRIDDIRMKNMQSEASRAIRHSRYLKAAQEVLDEVVNVWKNIKQKAQKEQAEPGKADGKETDGGPKSEGASQESGANAAPELSTAEKQELQNKMAKLMAMLDEVDRKYKHYYHQMQNVVASFDMVAGPGSAKPYTAVALQTISRHFRCLKDAINDQINAIRKKLGEEENPSSKEGKLTRLRYIDQQLRQQRAFQQYGMIPQNAWRPQRGLPENSVTVLRAWLFEHFLHPYPKDSEKLMLARQTGLTRSQISNWFINARVRLWKPMIEDMYKEETGDLEQDSNSSSDNVPRSKSKVASSEENEDLKNARARVCETSQLSESRASMGTMNVGGAPVSFQNEPNPDDSFMNLMMKDQRSGEADGGLLLHNAVAQHSDESARFMAYHLAELGRYGNGNVSLTLGLQHSGSGLSVPNAQANFAGVGDDDIYNAGAPLGVSIASSDYESLNQMDQRQRFEQSPLLHDFVA

SEQ ID NO: 10329 - protein, 653 aa, Secale cereale
MATYYSSPGSERESQDMYSRDPGGASYPMSSALGNLLYLNNPSSGPYTEFSGILQSQQNFMEMPASHGHHSAMSHDSSARESHDMLASHHGQRSFGHVKDMKNEMLMHMMDGAQSGGGAQLIHDDPHNGAHFEFGVLNNHDSSDVPVGQGQGQGQGLSLSLNTQILAPSLPYWSIKPDMLTPNSSYQESLRIDDIRMKNMQSEASRAIRHSRYLKAAQEVLDEVVNVWKNIKQKAQKEQAEPGKADGKETDGGPKSEGASQESGANAAPELSTAEKQELQNKMAKLMAMLDEVDRKYKHYYHQMQNVVASFDMVAGPGSAKPYTAVALQTISRHFRCLKDAINDQINVIRKKLGEEENSSSKEGKLTRLRYIDQQLRQQRAFQQYGMIPQNAWRPQRGLPENSVTVLRAWLFEHFLHPYPKDSEKLMLARQTGLTRSQISNWFINARVRLWKPMIEDMYKEETGDLEQDSNSSSDNMSRSKNKVASSEENEDLKNARARVCETSQLSESRASIGTMNVGGAPVSFQNEANPDDSFMNLMMKDQRSGEADGGLLLHNAVAQHSDENARFMAYHLAELGRYGNGNVSLTLGLQHSGSGLSVPNAQANFPGVSDDDIYNAGAPLGVSIASSDYESLNQMDQRQRFEQSPLLHDFVA

SEQ ID NO: 10330 - protein, 644 aa, Avena sativa
MATYYSSPGNERESHDMYSRDPGSGSYPMSSALGNLLYLNNPSPGPYTEFSGILQSQQNCMEMPGHHGHHSGMSHDSSARESDMLARSFGHVKDMKNEMLMHMMDGAQQSGTGAELIHDDAHNGGQFEFGVLNNHGSPNVPSGQGQGLSLSLNTQILAPSLPYWSIKPDMLTPSSYHDSLRVDDIRMKNMQSEASRAIRHSRYLKAAQEVLDEVVNVWKNIKQKAQKEQAEPGKADGKETDGGPKSEGPQESGANAVPELSTAEKQELQNKMAKLMAMLDEVDRKYKHYYHQMQNVVSSFDVVAGPGSAKPYTAVALQTISRHFRCLKDAINDQINVIRKKLGEEENSSGKEGKLTRLRYIDQQLRQQRAFQQYGMIPQNAWRPQRGLPENSVTVLRAWLFEHFLHPYPKDSEKLMLARQTGLTRSQISNWFINARVRLWKPMIEDMYKEETGDLEQDSNSSSDNVPRSKNKVATSEENEDLKNARARVCETSQLSDSRASIGAMNVGGAPLRFQNEANHDDSFMNLMMKEQRSGEADGGLLLHNAAVAQHSDENARFMAYHLAGFGGRYGNGNVSLTLGLQHPGSGLSVPNAQANFPGVGDDDIYNAGAPLGVSIASSDYESLNQMDQRQRFEQSPLLHDFVA

SEQ ID NO: 10331 - protein, 646 aa, Avena sativa
MATYYSSPGNERESHDMYSRDPGSASYPMSSALGNLLYLNNPSPGPYTEFSGILQSQQNCMEMPGHHHGHHSAMSHDSSARESDMLARSFGHVKDMKNEMLMHMMDGAQQSGTGAELIHDDAHNGGQFEFGVLNNHGSPNVPSGQGQGLSLSLNTQILAPSLPYWSIKPDMLTPSSYHDSLRVDDIRMKNMQSEASRAIRHSRYLKAAQEVLDEVVNVWKNIKQKAQKEQAEPGKADGKETDGGPKSEGPQESGANAVPELSTAEKQELQNKMAKLMAMLDEVDRKYKHYYHQMQNVVSSFDVVAGPGSAKPYTAVALQTISRHFRCLKDAINDQINVIRKKLGEEENSCGKEGKLTRLRYIDQQLRQQRAFQQYGMIPQNAWRPQRGLPENSVTVLRAWLFEHFLHPYPKDSEKLMLARQTGLTRSQISNWFINARVRLWKPMIEDMYKEETGDLEQDSNSSSDNVPRSKNKVATSEENEDLKNARARVCETSQLSDSRASIGTMNVGGVPLGYQNEANHDDSFMNLMMKEQRSGEADGGLLLHNAAVAQHSDENARFMAYHLAGFGGRYGNGNVSLTLGLQHPGSGLTVPNAQASFPGVGDDDDIYNAGAPLGVSIASSDYESLNQMDQRQRFEQSPLLHDFVA

SEQ ID NO: 10332 - protein, 653 aa, Secale cereale
MATYYSSPGSERESQDMYSRDPGGASYPMSSALGNLLYLNNPSSGPYTEFSGILQSQQNFMEMPASHGHHSAMSHDSSARESHDMLASHHGQRSFGHVKDMKNEMLMHMMDGAQSGGGAQLIHDDPHNGAHFEFGVLNNHDSSDVPVGQGQGQGQGLSLSLNTQILAPSLPYWSIKPDMLTPNSSYQESLRIDDIRIKNMQSEASRAIRHSRYLKAAQEVLDEVVNVWKNIKHKAQKEQAEPGKADGKETDGGPKSEGASQESGANAAPELSTAEKQELQNKMAKLMAMLDEVDRKYKHYYHQMQNVVASFDMVAGPGSAKPYTAVALQTISRHFRCLKDAINDQINVIRKKLGEEENSSSKEGKLTRLRYIDQQLRQQRAFQQYGMIPQNAWRPQRGLPENSVTVLRAWLFEHFLHPYPKDSEKLMLARQTGLTRSQISNWFINARVRLWKPMIEDMYKEETGDLEQDSNSSSDNMSRSKNKVASSEENEDLKNARARVCETSQLSESRASIGTMNVGGAPVSFQNEANPDDSFMNLMMKDQRSGEADGGLLLHNAVAQHSDENARFMAYHLAELGRYGNGNVSLTLGLQHSGGGLSVPNAQANFPGVSDDDIYNAGAPLGVSIASSDYESLNQMDQRQRFEQSPLLHDFVA

SEQ ID NO: 10333 - protein, 649 aa, Hordeum vulgare
MATYYSSPGSERESQDMYSRDPGNASYPMSSALGNLLYLNNNPSSGPYTAEFGGILQTQQNFMEMPGHGHHPAMSQDSSARESHDMLASHHGQRPFGHVKDMKDEMLMHMMDGARSGGGELIHDDPHNGAQFEFGVLNNHDSSDVPVGQGQGLSLSLNTQILAPSLPYWSIKPDMLTPNSYQESLRIDDIRMKNMQSEASRAIRHSRYLKAAQEVLDEVVNVWKNIKRKAQKEQAEPGKADGKESDGGPKSEGASQESGANAAPELSTAEKQELQNKMAKLMAMLDEVDRKYKHYYHQMQNVVASFDMVAGPGSAKPYTAVALQTISRHFRCLKDAINDQINVIRKKLGEEENSSGKEGKLTRLRYIDQQLRQQRAFQQYGMIPQNAWRPQRGLPENSVTVLRAWLFEHFLHPYPKDSEKLMLARQTGLTRSQISNWFINARVRLWKPMIEDMYKEETGDLEQDSNSSSDNVPRSKNKVASSEENEDLKNARARVCETSQLSESRASIGTMIVGAAPVGFQHAEANPDDSFMNLMMKEQRSGEADGGLLLHNAVAQHSDENARFMAYHLAELGRYGNGNVSLTLGLQHPGSGLSVPNAQAHFPGVGDDDIYNAGAPLGVGIASSDYESLNQMDQRQRFEQSPLLHDFVA

SEQ ID NO: 10334 - protein, 646 aa, Avena sativa
MATYYSSPGNERESHDMYSRDPGSASYPMSSALGNLLYLNNPSPGPYTEFSGILQSQQNCMEMPGHHHGHHSAMSHDSSARESDMLARSFGHVKDMKNEMLMHMMDGAQQSGTGAELIHDDAHNGGQFEFGVLNNHGSPNVPSGQGQGLSLSLNTQILAPSLPYWSIKPDMLTPSSYHDSLRVDDIRMKNMQSEASRAIRHSRYLKAAQEVLDEVVNVWKNIKQKAQKEQAEPGKADGKETDGGPKSEGPQESGANAVPELSTAEKQELQNKMAKLMAMLDEVDRKYKHYYHQMQNVVSSFDVVAGPGSAKPYTAVALQTISRHFRCLKDAINDQINVIRKKLGEEENSCGKEGKLTRLRYIDQQLRQQRAFQQYGMIPQNAWRPQRGLPENSVTVLRAWLFEHFLHPYPKDSEKLMLARQTGLTRSQISNWFINARVRLWKPMIEDMYKEETGDLEQDSNSSSDNVPRSKNKVATSEENEDLKNARARVCETSQLSDSRASIGTMNVGGVPLGYQNEANHDDSFMNLMMKEQRSGEADGSLLLHNAAVAQHSDENARFMAYHLAGFGGRYGNGNVSLTLGLQHPGSGLTVPNAQASFPGVGDDDDIYNAGAPLGVSIASSDYESLNQMDQRQRFEQSPLLHDFVA

SEQ ID NO: 10335 - protein, 644 aa, Lolium multiflorum
MATYYSSPGNERESHDMYSRDPGSSSYPMSSALGNLLYLNNQSPGPYTEFSGILQSQQNCMEMPGHGHHSAMSHDSSARESDMLASHLGQRSFGHVKDMKNEMLMHMMDGAQGGGAELIHDGGHNGAQFEFGVMNNHNSPNVPSGQGQGLSLSLNTQILAPSLPYWSIKPDMLTPSSYHDSLRVDDIRMKNMQSEASRAIRHSRYLKAAQEVLDEVVNVWKNIKQKAQKEQAETGKTDGKEADGGPKSEDQQESGANAVPELSTAEKQELQNKMAKLMAMLDEVDRKYKHYYHQMQNVVSSFDVVAGPGSAKPYTAVALQTISRHFRCLKDAINDQINVIRKKLGEEENSSGKEGKLTRLRYIDQQLRQQRAFQQYGMIPQNAWRPQRGLPENSVTVLRAWLFEHFLHPYPKDSEKLMLARQTGLTRSQISNWFINARVRLWKPMIEDMYKEETGDLEQESNSSSDNVPGSKNKVASSEENEDLKSARIRVCETSQLSDSRASIGTMNIVGAPVGFHNEANHDDSFMNLMMKEQRSSEADGDLLLHSTVSQHSDENARFMAYHLAGLGRYGNGNVSLTLGLQHPGSGLSVPNAQTNFPGVGDDDIYNTGAPLGVSIASSDYESMNQMDQRQRFEQSPLLHDFVA

SEQ ID NO: 10336 - protein, 668 aa, Zea mays
MATYYSSQGSEREPSQNMYSRDPGNGTASYPPLPSALGNLLYLNSPASGGPYTDFGGVQQDCIEMPEPGHPSVMSHDSSAREIEPDMLGQQRRSFGLARGMKDEVLMRMMDGSGSHSSAADAIHDDAPNGIQLDFGVLGSHGPPAQGGQGSLSLSLNTHIMAPALPYWPVVKADMLSPHSYDHGCGGGSGGLGSEPSRAIRNSRYLKAAQELLDEVVNVWNSIKQKAQKEQVEAGKTEGKENEGGGPKSEGPQESGANAAPELSTAEKQELQNKMAKLMAMLDEVDRKYKHYYHQMQSVVSSFDMVAGAGAAKPYTAVALQTISRHFRCLKDAINDQISVIRKKLGEEESSSGREGRLTRLRYIDQQLRQQRAFQQYGMIPQNAWRPQRGLPENSVTILRAWLFEHFLHPYPKDSEKLMLARQTGLTRSQISNWFINARVRLWKPMIEDMYKEETGDIEQDSNSSSDNAPAGSKAKTASSRDKEDHLARSCCTPRAVCESSSQLSEPPGGASMRAMSVAAAAAGAPMGLFQNEPGHDHDHDDSFMSLMLKEQRPNDGGGGLLLHHSAVAQHQDENARFMAYHLAELGRYGNGNVSLTLGLQRSSSSLSVPHAQQSFPGVGIGVGDDDIYNATAAPLGVSVASPDYESMSQMDQRQRFEQSPLLHDFVA

SEQ ID NO: 10337 - protein, 1354 aa, Setaria italica
MEMEAAAAAASDETLAAVFAQLKPHTVALLDLLRSRRAASSSASSLREMAAFLRSAPAPALQLCFDYTVFPLLMLLDAAVQCRKQGNAPGQGAGDIGIADAVAEAGLACLEVLLTKCRLTSVNQMVAMLKKLTSGAMLLPLEASEEFRIGIIRCFRAMVLQLQPCLERSCSCKQATVLPTSSTNTSLEARSVVHSKLPAQPEECLLAFLQSQNASAAVGHWLSLLLQASELEASRGHRGSADVRKEALHALRILIAKVGSADALAFFLPGIVSRLGKVLYRSKTMISGAAGSSLSIEQAILGLTEALMIVLNDKENFSALDMAINEDWAHSSGGDGSTEHVLQMLRQLPTKSLSEQIGHDETTDDSTSDANNPSADRKALHVKRTKKWLEETTSNVDKLLSATFPHLSIHSSEKVRRSVVSGVRGLLSSCGSTLKRSKMLLVECLCVLACDDAAAVSEAAQDALLYLFNQGHNFITENEISDIFTRLVERLPQVVLGSEETTALSHAKRLLALTFYAGPQFLINHLHHSPVIATRFFDCLGLCISHSSQFSGSMDKLIVSKPLSVGYLYSVAELKGGAYSKDMTNSSLQATYTPAASKISVIHDNGLSNAILGTVEYELPHVPPWFVHAGSQKLYLVLAGIIRLVGLSTVSGKETAASLSPFVDILLDHFRRLSTVVRSKNIYRDGHRWYMNGEAGHTLRQASSAVCMLNELIYGLSDRSLGMFLQLFQKRSAQMVRTACQNDQLIASVKHNGVTNEREVWGCNEQKGTKDNIIHCIGSILHEYICPEVWDLPTEKDVELCLTELNLPLHFYRDTTALHTVTLEGIGVLGAVLGQDFARSGFMHSSLYLLLRELISSSAQIRIASDAVLRALAAAGGHCSVGQFVVANADYIVDSLCRQLRHLDMNPHVPDVLASMLCYIGASHDILPFLEEPMRAVSSELEVLGRHDHPHLTVPFLKAVSEIAKACKHESTSLPDDAQSFYLKVSSEGQEVKNMIEKRMESSATSERMNADAQLDFMSLEYWEDLLCKLNEMRRYRRIVGSLTGSCLSAATPLLSSTKETACLVALDVVENAIISITKVEEAYKCENQSKGIIEESIQFLSFDELLDGTDASEDADENRLLPAMNKLWPYLIICLRNKISVPVVRKCTEVLSRAISMSGGDFYVRRFHKDGHIVWRLLALSPFRRKRMSMMDEKAIILPYRDTSLTSEEPMAEISSQKIQIAVLDMIATISSSKRSAIALESVLKKVCGLVVGIAYSSLTGLQEAAIRALAGLACMDADLVWLLLADVYYSLNQRDIPLPPNQDVAEISDLLPPPMSAREYLFVQYGGDGVRCDVDPSSVHEVFKRMQDVVLT

SEQ ID NO: 10338 - protein, 1337 aa, Setaria italica
MEMEAAAAAASDETLAAVFAQLKPHTVALLDLLRSRRAASSSASSLREMAAFLRSAPAPALQLCFEKQGNAPGQGAGDIGIADAVAEAGLACLEVLLTKCRLTSVNQMVAMLKKLTSGAMLLPLEASEEFRIGIIRCFRAMVLQLQPCLERSCSCKQATVLPTSSTNTSLEARSVVHSKLPAQPEECLLAFLQSQNASAAVGHWLSLLLQASELEASRGHRGSADVRKEALHALRILIAKVGSADALAFFLPGIVSRLGKVLYRSKTMISGAAGSSLSIEQAILGLTEALMIVLNDKENFSALDMAINEDWAHSSGGDGSTEHVLQMLRQLPTKSLSEQIGHDETTDDSTSDANNPSADRKALHVKRTKKWLEETTSNVDKLLSATFPHLSIHSSEKVRRSVVSGVRGLLSSCGSTLKRSKMLLVECLCVLACDDAAAVSEAAQDALLYLFNQGHNFITENEISDIFTRLVERLPQVVLGSEETTALSHAKRLLALTFYAGPQFLINHLHHSPVIATRFFDCLGLCISHSSQFSGSMDKLIVSKPLSVGYLYSVAELKGGAYSKDMTNSSLQATYTPAASKISVIHDNGLSNAILGTVEYELPHVPPWFVHAGSQKLYLVLAGIIRLVGLSTVSGKETAASLSPFVDILLDHFRRLSTVVRSKNIYRDGHRWYMNGEAGHTLRQASSAVCMLNELIYGLSDRSLGMFLQLFQKRSAQMVRTACQNDQLIASVKHNGVTNEREVWGCNEQKGTKDNIIHCIGSILHEYICPEVWDLPTEKDVELCLTELNLPLHFYRDTTALHTVTLEGIGVLGAVLGQDFARSGFMHSSLYLLLRELISSSAQIRIASDAVLRALAAAGGHCSVGQFVVANADYIVDSLCRQLRHLDMNPHVPDVLASMLCYIGASHDILPFLEEPMRAVSSELEVLGRHDHPHLTVPFLKAVSEIAKACKHESTSLPDDAQSFYLKVSSEGQEVKNMIEKRMESSATSERMNADAQLDFMSLEYWEDLLCKLNEMRRYRRIVGSLTGSCLSAATPLLSSTKETACLVALDVVENAIISITKVEEAYKCENQSKGIIEESIQFLSFDELLDGTDASEDADENRLLPAMNKLWPYLIICLRNKISVPVVRKCTEVLSRAISMSGGDFYVRRFHKDGHIVWRLLALSPFRRKRMSMMDEKAIILPYRDTSLTSEEPMAEISSQKIQIAVLDMIATISSSKRSAIALESVLKKVCGLVVGIAYSSLTGLQEAAIRALAGLACMDADLVWLLLADVYYSLNQRDIPLPPNQDVAEISDLLPPPMSAREYLFVQYGGDGVRCDVDPSSVHEVFKRMQDVVLT

SEQ ID NO: 10339 - protein, 295 aa, Saccharum officinarum
MSKNGIQYAVVDAFTAEPFKGNPAAVCLLEDAAKAADERWMQSVAAEFNLSETAFLLRDSSASGAAPRFQLRWFTPAAEVELCGHATLASAHFLFTSVLAEHEALIEFSTKSGILTAKKVPAPESTGVSGEGKLFIELDFPMIDLVDCHPSELPSIPETLNGASIVSVHKSTTAGDLIVELSSGKEVADIIPNIHEIKMCSGRGIIVTGPAPAGSGYDFFTRFFCPKFGIPEDPVCGSAHCVLAPYWGGKLGKHKLTAFQASPRSGILYLELEAAGRRVQIQGEAVTVMTGTLLA

SEQ ID NO: 10340 - protein, 296 aa, Zea mays
MGKDGIQYAVVDAFTAEPFKGNPAAVCLLEDAAKAADERWMQSVAAEFNISETAFLLREKSSAAGAVPLFQLRWFTPVAEVELCGHATLASAHFLFTSVLAEHEKLVEFSTKSGILTAKKVPAPQSTGVSGEGKLFIELDFPTIDLVDCHPSELPAIPDTLNGASIVSVHKSTTAGDLIVELSSGKEVADIIPNIHEIEKCSGRGIIVTGPAPAGSGYDFFTRFFCPKFGIDEDPVCGSAHCVLAPYWGGKLGKHKLIAFQASPRSGILYLELEATGRRVRIQGEAVSVMTGTLLA

SEQ ID NO: 10341 - protein, 295 aa, Sorghum bicolor
MGKDGTKYAVVDAFTAEPFKGNPAAVCLLEDASKAADERWMQSVAAEFNLSETAFLLRDDSSAAGAVPRFQLRWFTPATEVDLCGHATLASAHFLFTSVLAEHEALIEFSTKSGILTAKRVPAPESTGVSGEGKLFIELDFPVIDLVDCHPSELPSIPETLNGASIVSVHKSTGDLIVVELSSGKEVADITPNIHEIKMCSGSGIIVTGPAAAGSGYDFFTRFFCPKFGIDEDPVCGSAHCVLAPYWGGKLGKHKLTAFQASSRSGTLYLELEAARRRVRIQGEAVSVMTGTLLA

SEQ ID NO: 10342 - protein, 294 aa, Saccharum officinarum
MGKNGIQYAVVDAFTAEPFKGNPAAVCLLEDAAKAADERWMQSVAAEFNLSQTAFLLRDSSAAGAVPRFQLRWFTPATEVDLCGHATLASAHFLFTSVLAEHEALIEFSTKSGILTAKRVPAPESTGVSGEGKLFIELDFPMIDIVDCHPSELPSIPETLNGASIVSVHKSTGDLIIVELSSGKEVADITPNIHEIKMCPGSGIIVTGPAPAGSGFDFLTRFFCPKFGIDEDPVCGSAHCVLAPYWGGKLGKHKLTAFQASTRSGTLYLELEAAHKRVRIQGEAVSVMTGTLLA

SEQ ID NO: 10343 - protein, 296 aa, Panicum virgatum
MAKGGIEYAVVDAFTAEPFKGNPAAVCLLQDAAKAADERWMQSVAAEFNLSETAFLLRDSSPAAAAAPRFQLRWFTPAAEVELCGHATLASVHFLFTSVLAEHETLVEFATKSGVLTAKKVAAPASAAVSGEGKLFIELDFPMIDLVDCHPAELPSIPETLNGASVVSVHKSATAGDLIVELSSGKEVADIIPNIHEIKVCSGRGVIVTGPAPAGSGFDFFTRFFNPKFGVDEDPVCGSAHCVLAPYWGGELGKQRLMAFQASPRSGILHLELEPASRRVRIQGEAVTVMTGTLLA

SEQ ID NO: 10344 - protein, 294 aa, Setaria italica
MAKSGIQYAVVDAFTAEPFKGNPAAVCLLEDAAKAADERWMQSVAAEFNLAETAFLLRDSSAAAAPRFQLRWFTPAAEVELCGHATLASAHFLFTSVLAEHETLIEFATKSGILTAEKVPAPASAAASGEGKLFIELDFPMIDLVDCHPAELPSIPQTLNGASVVSVQKSATAGDLIVELSSGKEVADIIPNIHEIKNCSGRGVVFTGPAPEGSGYDFFTRFFCPKLNIDEDPVCGSAHCVLAPFWGAKLGKQKLTAFQASRRSGILHLELEPAGRRVRIQGEAVAVMTGTLLA

SEQ ID NO: 10345 - protein, 322 aa, Zea mays
MRSLRAAQTLVSRSLFSARHLSGAASPATAAAAGARWCAAPAPPPRSPLPSSRVMPAGVAGAVSFSLTFATVAAAEAKAKERPQPDLLPQNVVLYQYQACPFCNKVRAFLDYHDIPYKVVEVNPLSKKELKWSDYKKVPILTVDGEQLVDSSDIINILQSRINPNEELTSDEEAKWRRWVDEHLVHVLSPNIYRTTSEALESFDYIAKHGNFSFTERFAVKYAGAAAMYMVSKKLKKKYNITDERASLYDAANTWIDALNGRDFLGGSKPNLADLAVFGVLRPIRYLRAGKDMVENTEIGDWYRRMEDAVGEPSRIQDAEGN

SEQ ID NO: 10346 - protein, 318 aa, Setaria italica
MRSLRAAQTLAFRSLLSARALHGAASPAAAAAAGARWSAPLVPPPRSPPPSSRAVPAGVAGAVSFSLTFATVAAAEAKAKERPPADLLPQNVVLYQYQACPFCNKVRAFLDYHDIPYKVVEVNPLSKKEIKWSDYKKVPILTVDGEQLVDSSDIINILQGRIRPDDELTNEDEAKWRRWVDEHLVHVLSPNIYRTTSEALESFDYIAKHGNFSFTERFAVKYAGAAAMYMVSKKLKKKYNITDERASLYDAANTWVEALNGRDFLGGSKPNLADLAVFGVLRPIRYLRAGKDMVENTQIGEWYQRMEDAVGEPSRIEE

SEQ ID NO: 10347 - protein, 319 aa, Oryza sativa
MRSIRAAQALASRSLLLSSRALHGDAASTAAAAAGGGRLGVQPSPPSQASSSSSSRAMPAGIAGAVSFSLTFATMAAAEAKERPPMDLLPQNVVLYQYQACPFCNKVRAFLDYHDIPYKVVEVNPLSKKEIKWSEYKKVPILTVDGEQLVDSSDIINILQQRVRPDDKATNEEEEKWRRWVDEHLVHVLSPNIYRTTSEALESFDYISKHGNFSFTERFAVKYAGAAAMYMVSKKLKKKYNITDARASLYDAANTWMEALDGRDFLGGSKPNLADLAVFGVLRPIRYLTAGKDMVEHTQIGDWYQRMEDAIGEPSRIQE

SEQ ID NO: 10348 - protein, 358 aa, Setaria italica
MRSLRAAQTLAFRSLLSARALHGAASPAAAAAAGARWSAPLVPPPRSPPPSSRAVPAGVAGAVSFSLTFATVAAAEAKAKERPPADLLPQNVVLYQYQACPFCNKVRAFLDYHDIPYKVVEVNPLSKKEIKWSDYKKVPILTVDGEQLVDSSGHSFFLFCPFCIVVIANPMFFFPYGLNNVFLLHFCDLLLADIINILQGRIRPDDELTNEDEAKWRRWVDEHLVHVLSPNIYRTTSEALESFDYIAKHGNFSFTERFAVKYAGAAAMYMVSKKLKKKYNITDERASLYDAANTWVEALNGRDFLGGSKPNLADLAVFGVLRPIRYLRAGKDMVENTQIGEWYQRMEDAVGEPSRIEE

SEQ ID NO: 10349 - protein, 1050 aa, Avena sativa
PGDDPFDIPAKRAPVERLRRWRQAALVLNASRRFRYTLDLKKEEEKEHIRRKIRAHAQVIRAALLFKEAGEKQNGDRELPEIPPRGFGIGEEQLTSMTRDHNFSTLQEYGGVKGLLNLLKTNSEKGIHGDEEDLSCRANAFGANRYPRKKGRSFWVFLWEACQDLTLVILIVAAAISLALGIATEGIKEGWYDGASIAFAVFLVIFVTAVSDYKQSLQFQHLNEEKQNIQVEVIRGGRRIQVSIFDIVVGDVVALKIGDQVPADGILISGHSLAIDESSMTGESKIVFKDQKSPFLMGGCKVADGYGSMLVTAVGLNTEWGLLMASISEDNNEETPLQVRLNGVATFIGIVGLVVAALVLVVLFARYFTGHTTNSDGTVQFVKGQTSVKNIIFGSIKILTVAVTIVVVAVPEGLPLAVTLTLAYSMRKMMADKALVRRLSACETMGSATTICSDKTGTLTLNQMTVVRSIVAGIELQPQATIEKLSPTVTSFVLEGIAQNTSGSVFEPEDGSTVEVTGSPTEKAILSWGVELHMKFAVERSKSSIIHVSPFNSEKKRGGVAVTGRDSDVHVHWKGAAEIVLALCTNWLDVDGSTHEMTPDEANQFKKYIEDMAEQSLRCVAFAYRNLDLKDIPSEEQRISWQLPDNDLTLIGIVGMKDPCRPGVRDAVELCTNSGVKVRMVTGDNLQTARAIALECGILTDPQASTPVIIEGRVFRAFSDAQREEVADKISVMGRSSPNDKLLLVKALKKNGHVVAVTGDGTNDAPALHEADIGLSMGIQGTEVAKESSDIIILDDNFASVVKVVRWGRSVYANIQKFIQFQLTVNVAALIINVVAAISSGNVPLNAVQLLWVNLIMDTLGALALATEPPTDQLMKRTPVGRREPLVTNIMWRNLFIQAVYQVAVLLTLNFGGRNLLHLTQDTLEHSSKVKNSFIFNTFVLCQVFNEFNSRKPEELNIFEGVSRNHLFLAVVSITVVLQVIIIEFLGKFTSTVRLSWELWLVSVGIAFVSWPLAFVGKFIPVPQTPLKNLILKCWPKRKKQGAEGPTPPV

SEQ ID NO: 10350 - protein, 1919 aa, Brachypodium distachyon
MSMSSGGGPSGPQRQRSTTLGPRGMSRAITMRTDGLSGEEGGDPIIVETELVPSSLAPIVPILRAANEIEEENPRVAYLCRFTAFEKAHTMDPNSSWRGVRQFKTYLLHRLEKDEQETTRRLASTDATEIQRFYEQYCKKNLEEGLHMRKPEEMSRYYQIASVLYDVLKTVKPEKSKFDQYAKGVEKEKASYSHYNILPLNISGPTQPVMNIPEIRAAVHLLRRMENLPMPRPDLPAVPEEIDEPNVHDLLDWLWQTFGFQKGNVENQKEHLILLLANIDMRKGGERHMIDNDTVEHLMKKIFQNYISWCRYLHLESNIKIPNNASTQQPELLYIGLYLLIWGEASNVRFMPECLCYIFHHMARDLYDIISDKSEGSFDPPFRREGSDDAFLQLVIQPIYSIIQKEAAMNKVGTVSHSKWRNYDDLNEYFWSKKCFKQLGWPMDPTADFFADPTKTKNEIERHDHSLSRRRMPKTNFVEVRTFLHLFRSFDRMWSFFILAFQAMVIIAWSPSGSLSAIFDPAVFRNVMTIFITAAFLNFLQATLEIVLNWKAWRSLVCSQMIRHILKFVVAIGWLIILPSTYSSSIQNPTGLVKFFSNWIGNLQSQSIYNFAVAIYMLPNIFSALFFIFLPIRRALERSNSRFVRFLLWWTQPKLYVARGMYEDTCSLLKYTTFWILLLICKLAFSFYVEISPLVVPTRIIMFLGRGKYVWHEFFPYLQHNLGVVFTVWAPIVMVYFMDTQIWYAIFSTICGGVNGAFSRLGEIRTLGMLRSRFEAIPRAFGKKLVPGDGIKSKRREQEEEKNPHIDKFSEIWNAFINSLREEDLISNREKDLLIVPSSVGDTSVFQWPPFLLASKIPIAIDMAKGVKKKDEELRKRINQDPYTYYAVVECYETLLIILYSLITEASDRKVIDRISDSITASIHNQSLVKDFRLDELPHLSAKFEKLLKLLLSPKAESGEHDTPEKTQIANLLQDTMEIITQDIMKNGQGILKDENKGNQLFANLNLDSIKSQAWREKCVRLQLLLTTKESAIYVPINLEARRRITFFANSLFMKMPRAPPVRSMMSFSVLTPYFKEEVLFSKDDLYEKNEDGISILFYLRKIYPDEWKNFLERIQFKPKDEDSLKSEMDRIAPWASYRGQTLTRTVRGMMYYRRALEIQSIHDRTDIAKLERQKTTASYQEGGSIVDTAALAIADIKFTYVVSCQVYGMHKISKDAKEKVCYLNILNLMITYPSLRIAYIDEVEAPTRNGTTEKTYYSVLVKGVGEKYDEEIYRIKLPGKPTEIGEGKPENQNHAIIFTRGEALQAIDMNQDNYLEEAFKMRNVLEEFASDDYGKSKPTILGLREHIFTGSVSSLAWFMSNQENSFVTIGQRVLANPLKVRFHYGHPDIFDRLFHITRGGISKASKTINLSEDIFSGFNSTMREGNITHHEYMQVGKGRDVGMNQISSFEAKVANGNGEQTLSRDIYRLGRRFDFYRMLSFYFTTVGFYFSSMVTVLTVYVFLYGRLYLVMSGLEKSILLDPRIQADIRPLENALASQSVFQLGLLLVLPMVMEVGLEKGFRTALGEFVIMQLQLASVFFTFQLGTKTHHYGRTILHGGAKYRPTGRGFVVCHAKFADNYRVYSRSHFVKGLELLILLVVYLVYGKSYRGSKLYLFVTFSIWFLVASWLFAPFIFNPSCFEWQKTVDDWTDWRKWMGNRGGIGMLGEQSWEAWWTTEQEHLRKTSIRALLLEIILSLRFLIYQYGIVYQLNIARHNTSILVYGLSWLVMLTVLVVLKMVSIGRQKFGTDLQLTFRILKGLLFLGFVSVMAVLFVVCELTISDVFASILGFLPTGWCILLIGQACYPVIKKTTLWESIMELGRAYDNIMGLVLFLPIGFLSWFPFVSEFQTRLLFNQAFSRGLQISRILAGQKDMGEFE

SEQ ID NO: 10351 - protein, 1906 aa, Brachypodium distachyon
MSMSSGGGPSGPQRQRSTTLGPRGMSRAITMRTDGLSGEEGGDPIIVETELVPSSLAPIVPILRAANEIEEENPRVAYLCRFTAFEKAHTMDPNSSWRGVRQFKTYLLHRLEKDEQETTRRLASTDATEIQRFYEQYCKKNLEEGLHMRKPEEMSRYYQIASVLYDVLKTVKPEKSKFDQYAKGVEKEKASYSHYNILPLNISGPTQPVMNIPEIRAAVHLLRRMENLPMPRPDLPAVPEEIDEPNVHDLLDWLWQTFGFQKGNVENQKEHLILLLANIDMRKGGERHMIDNDTVEHLMKKIFQNYISWCRYLHLESNIKIPNNASTQQPELLYIGLYLLIWGEASNVRFMPECLCYIFHHMARDLYDIISDKSEGSFDPPFRREGSDDAFLQLVIQPIYSIIQKEAAMNKVGTVSHSKWRNYDDLNEYFWSKKCFKQLGWPMDPTADFFADPTKTRRMPKTNFVEVRTFLHLFRSFDRMWSFFILAFQAMVIIAWSPSGSLSAIFDPAVFRNVMTIFITAAFLNFLQATLEIVLNWKAWRSLVCSQMIRHILKFVVAIGWLIILPSTYSSSIQNPTGLVKFFSNWIGNLQSQSIYNFAVAIYMLPNIFSALFFIFLPIRRALERSNSRFVRFLLWWTQPKLYVARGMYEDTCSLLKYTTFWILLLICKLAFSFYVEISPLVVPTRIIMFLGRGKYVWHEFFPYLQHNLGVVFTVWAPIVMVYFMDTQIWYAIFSTICGGVNGAFSRLGEIRTLGMLRSRFEAIPRAFGKKLVPGDGIKSKRREQEEEKNPHIDKFSEIWNAFINSLREEDLISNREKDLLIVPSSVGDTSVFQWPPFLLASKIPIAIDMAKGVKKKDEELRKRINQDPYTYYAVVECYETLLIILYSLITEASDRKVIDRISDSITASIHNQSLVKDFRLDELPHLSAKFEKLLKLLLSPKAESGEHDTPEKTQIANLLQDTMEIITQDIMKNGQGILKDENKGNQLFANLNLDSIKSQAWREKCVRLQLLLTTKESAIYVPINLEARRRITFFANSLFMKMPRAPPVRSMMSFSVLTPYFKEEVLFSKDDLYEKNEDGISILFYLRKIYPDEWKNFLERIQFKPKDEDSLKSEMDRIAPWASYRGQTLTRTVRGMMYYRRALEIQSIHDRTDIAKLERQKTTASYQEGGSIVDTAALAIADIKFTYVVSCQVYGMHKISKDAKEKVCYLNILNLMITYPSLRIAYIDEVEAPTRNGTTEKTYYSVLVKGVGEKYDEEIYRIKLPGKPTEIGEGKPENQNHAIIFTRGEALQAIDMNQDNYLEEAFKMRNVLEEFASDDYGKSKPTILGLREHIFTGSVSSLAWFMSNQENSFVTIGQRVLANPLKVRFHYGHPDIFDRLFHITRGGISKASKTINLSEDIFSGFNSTMREGNITHHEYMQVGKGRDVGMNQISSFEAKVANGNGEQTLSRDIYRLGRRFDFYRMLSFYFTTVGFYFSSMVTVLTVYVFLYGRLYLVMSGLEKSILLDPRIQADIRPLENALASQSVFQLGLLLVLPMVMEVGLEKGFRTALGEFVIMQLQLASVFFTFQLGTKTHHYGRTILHGGAKYRPTGRGFVVCHAKFADNYRVYSRSHFVKGLELLILLVVYLVYGKSYRGSKLYLFVTFSIWFLVASWLFAPFIFNPSCFEWQKTVDDWTDWRKWMGNRGGIGMLGEQSWEAWWTTEQEHLRKTSIRALLLEIILSLRFLIYQYGIVYQLNIARHNTSILVYGLSWLVMLTVLVVLKMVSIGRQKFGTDLQLTFRILKGLLFLGFVSVMAVLFVVCELTISDVFASILGFLPTGWCILLIGQACYPVIKKTTLWESIMELGRAYDNIMGLVLFLPIGFLSWFPFVSEFQTRLLFNQAFSRGLQISRILAGQKDMGEFE

SEQ ID NO: 10352 - protein, 307 aa, Phaseolus vulgaris
MATTVLPPPPPPPAAVETVVDFFNLPCPIPFEELHREAMMSLKPDLFEGMRFDFTKMLNQKFTLNHSVLMGPTEIPSQSTETIKIPTAQYEFGSTFIDHPRLLLWGRILTDGRLNARVKCDLSENLTFKANAQLTNEPHMSHGMFNFDYKGKDYRSQFQLGNGALLGASYIQSVTQHLSLGGEVFWAGQHRKSGIGYAARYNTEKMVATGQVASTGMVLLSYVQKVSEKVSLASEFMCNYLSRDVTASFGYDYILRQCRLRGKVDSNGCVAAFLEERLNMGLNFILSAELDHRKKDYKFGFGLTVGE

SEQ ID NO: 10353 - protein, 303 aa, Vigna unguiculata
MATPVPPPPAAADTAVDYLNLPCPIPFEELHREAFMSLKPDLFEGMRFDFTKMLNQKFTLNHSVLMGPTEIPSQSTETIKIPTAHYEFGSTFIDHPRLLLWGRILTDGRLNARVKWDLAENLTFKANAQLTNEPHMSHGVFNFEYKGKDYRSQFQLGNGALLGANYIQSVTQHLSLGGEVFWAGQHRKSGVGYGARYNTDKMVATGQVASTGMVVLSYVQKVSEKVSLASEFMCNYLSRDATASFGYDYILRQCRLRGKIDSNGCVAAFLEERLNMGLNFILSAELDHKKKDYKFGFGLTVGE

SEQ ID NO: 10354 - protein, 305 aa, Cicer arietinum
MASPIPPPTGDTKVDDKVDYFNLPCPIPFEELHREAMMSLKPDLFEGMRFDFTKMLNQKFSLNHSVSMGPTEVPSQSTETIKIPTANYEFGATFIDHPKLLLWGRAMTDGRLNARVKCDVSENLTFKANAQLTSEPHMSHGMGNFDYKGKDYRTQFQFGNGALLGASYIQSVTNHLSLGGEVFWAGQHRKSGIGYAARYNTDKMVATGQVASTGMVLLSYVQKVSEKVSLASELMCNYLSRDVTASFGYDYILRQCRLRGKVDSNGVVAAFLEERLNMGLNFILSAELDHKKKDYKFGFGLTVGE

SEQ ID NO: 10355 - protein, 303 aa, Lotus japonicus
MATVPPPTATKPDEKTDYFNLPCPIPFEELHREAMMSLKPDLFEGMRFDFTKMLNQKFSLNHSVLMGPTEIPSQSTETIKIPTAHYEFGSTFIDHPKLLLWGRVMTDGRLNARVKCDLSENVTFKANAQLSNEPHMSHGMMNFDYKGSDYRSQFQFGNGALLGASYIQSVTRNLSLGGEVFWAGQHRKSGVGFATRYNTDQMVATGQVASTGMVLLSYVQKVSEKVSLASELMCNYLSRDVTASFGYDYILRQCRLRGKVDSNGCVGALLEERLNMGLNFILSAELDHKKKDYKFGFGLTVGE

SEQ ID NO: 10356 - protein, 302 aa, Arachis hypogaea
MAQAPPTDTKLDEKVDYFNLPCPIPFEELHREAIISLKPELFEGMRFDFTKMLNQKFSLNHSVSMGPTEIPSQSTETIKIPTANYEFGATFIDHPKLMLLGRILTDGRLNARVKYEVSENLTLKANAQLTNEPHMSQGMVNFDYKGKDYRSQFQLGNGALLGASYIQSVTRNLSLGAEVFWAGQHRKSGVGYAARYNTDKWVATAQVASTGMVLASYVQKVSEKVSLATELLCNYLSRDVTASFGYDYILRQCRLRGKIDSNGCCAAFLEERLNMGLNFILSAELDHKKKDYKFGFGLTVGE

SEQ ID NO: 10357 - protein, 307 aa, Trigonella foenum-graecum
MATMVPPIPTADDKKVDQKTDYSNLPCPIPFEELHREAMMSLKPELFEGMRFDFTKMLNQKFSLNHSVSMGPTEIPSQSAEVIKIPTANYEFGANFIDHPKLLLLGRAMTDGRVTARVKYDVFDNLTLKANAQLTSEPHMSQGMINFDYKGKDYRTQFQMGNGALLGASYIQSVTNHLSLGGEVFWAGQHRKSGVGYAARYNTDKMVATGQVASTGMVLLSYVQKVSEKVSLAADLMCNYMSRDVTASFGYDYILRQCRLRGKVDSNGVCAAFLEERLNMGLNFILSAELDHKKKDYKFGFGLTVGE

SEQ ID NO: 10358 - protein, 307 aa, Medicago truncatula
MATMVPPIPTADDKKVDQKVDYSNLSCPIAFEELHREAMMSLKPELFEGLRFDFTKMLNQKFSLNHSVSMGPTEIPSQSAEVIKIPTANYEFGANFIDHPKLLLLGRAMTDGRVTARVKYDVFDNLTLKANAQLTSEPHMSQGMINFDYKGKDYRTQFQMGNGALLGASYIQSVTNHLSLGGEVFWAGQHRKSGVGYAARYNTDKMVATGQVASTGMVLLSYVQKVSEKVSLAADLMCNYLSRDVTASFGYDYILRQCRLRGKVDSNGVCAAFLEERLNMGLNFILSAELDHKKKDYKFGFGLTVGE

SEQ ID NO: 10359 - protein, 96 aa, Nicotiana tabacum
MATLVPPTTTVPPACSKPAAVEPEKVDYSNLPCPIPYEEIHREALMSLKPELFEGLRFDFTKGLNQRFSLSHSVLMGPTELPSQSTEIDQNSNSSL

SEQ ID NO: 10360 - protein, 312 aa, Malus domestica
MAGLVPPPPPTAAADTIPKPKEDEKVDYLNLPCPIPYEEIHREALMSLKPELFEGMRFDFTKGLNQRFSLSHSVFMGPTEVPSQSPETIKIPTAHYEFGANFIDPKLMLFGRIMTDGRLNARVKCDLSENLTLKANSQLTNEPHMSHGMVNFDYKGKDYRSQFQLGNGALFGANYIQSVTPHLALGGEVFWAGQHRKSGIGYAARYNTEKMVATGQVASTGMVALSYVQKVSDKVSLASDFMYNYMSRDVTASFGYDYILRQCRLRGKIDSNGTVAAFLEERLNMGLNFVLSAEIDHRKKDYKFGFGLTVGE

SEQ ID NO: 10361 - protein, 312 aa, Prunus persica
  Sequence also found in Organisms: Prunus mume
MAALVPPPPPTTAADTTQKPKEDEKVDYFNLPCPIPYEEIHREALMSLKPELFEGMRFDFTKGLNQRFSLSHSVFMGPMEVPSQSPETIKIPTAHYEFGANFIDPKLMLFGRIMTDGRLNARVKCDLSENLTLKANSQLTNEPHMSHGMVNFDYKGKDYRSQFQLGNGALFGANYIQSVTPHLSLGGEVFWAGQHRKSGIGYAARYNTDKMVATGQVASTGMVALSYVQKVSEKVSLASDFMYNYMSRDVTASFGYDYILRQCRLRGKIDSNGTVAAFLEERLNMGLNFVLSAEIDHRKKDYKFGFGLTVGE

SEQ ID NO: 10362 - protein, 312 aa, Nicotiana benthamiana
MATLVPPTTTVLPAGSKPAAVEPEKVDYSNLPCPIPYEEIHREALMSLKPELFEGLRFDFTKGLNQRFSLSHSVLMGPTELPSQSTETIKIPTAHYEFGANFIDPKLMLFGRVLTDGRVNARVKCDLSENLTLKANGQLTGEPHMSHGMVNFDYKGKDHRSQFQLGNGALFGASYIQSVTPHLSLGGEIFWAGQHRKSGIGYAARYNTDKMVATGQVASTGMVALSYVQKVSEKVSLASDFMYNYMSRDVTASFGYDYILRQCRLRGKIDSNGCVAAFLEERLNMGLNFILSAEVDHKKKDYKFGFGLTVGE

SEQ ID NO: 10363 - protein, 290 aa, Humulus lupulus
DEKADYFNLPCPIPYEEIHREALMSLKPELFEGMRFDFTKGLNQKFSLSHSVFMGPTEVPSQSAETIKIPTAHYEFGANFIDPKLMLFGRILTDGRLNARVKCDLTENLILKANAQLTNEPHMSHGMLNFDYKGSDFRTQFQLGNGALFGASYIQSVTPHFSLGGEVFWAGQHRKSGIGYAARYNTDKMVATGQVASTGMVALSYVQKVSEKVSLASDFMYNYMSRDVTASFGYDYILRQCRLRGKIDSNGCAAAFLEERLNMGLNFILSAELDHKKKDYKFGFGLTVGE

SEQ ID NO: 10364 - protein, 307 aa, Vaccinium corymbosum
MATLVPPTAAPPPAVIQPEKVDYLNLPCPIPYEEIQREALMSLKPELFEGMRFDFTKGLSPRFSLSHSVFMGPTEIPSQSPETIKIPTAHYEFGANFIDPKLMLFGRIMTDGRLNARVKCDLSENLTLKANAQLTNEPHMSHGMFNFDYKGKDYRTQVQLGNGALFGASYIQSVTPHLSLGGEVFWTGQHRKSGIGYAARYNTDKMVSTAQVASTGMIALSYVQKVSEKVSLASEFMYNYLSRDVTSSFGYDYILRQCRLRGKIDSNGCTSALLEERLSMGLNFILSAEIDHRKKDYKFGFGLTVGE

SEQ ID NO: 10365 - protein, 268 aa, Ambrosia trifida
MMSLKPEHFEGMRFDFTKGLNQKFSLSHSVVMGPTEVPSQSAETIKIPTANYEFGANFIDPKLMLFGRILTDGRLSARVKCDLSENLTLKANAQLTNEPHMSHGMFNFDYKGSDYRTQLQLGNGGLIGASYIQSVTPHLSLGGEVFWAGQHRKSGLGYAARYNTDKMVASGQIASTGMVVLGYVQKVSEKVSLATDMMYNYMSRDVTASFGYDYILRQCRLRGKIDSNGCTSAFLEERLNMGLNFILSAEIDHKKKDYKFGFGMTVGE

SEQ ID NO: 10366 - protein, 306 aa, Ambrosia trifida
MATHIPPPAPAAEPTKPEKVDYFDLPCPIPYEEIHREAMMSLKPEHFEGMRFDFTKGLNQKFSLSHSVVMGPTEVPSQSAETIKIPTANYEFGANFIDPKLMLFGRILTDGRLSARVKCDLSENLTLKANAQLTNEPHMSHGMFNFDYKGSDYRTQLQLGNGGLIGASYIQSVTPHLSLGGEVFWAGQHRKSGLGYAARYNTDKMVASGQIASTGMVVLGYVQKVSEKVSLATDMMYNYISRDVTASFGYDYILRQCRLRGKIDSNGCTSAFLEERLNMGLNFILSAEIDHKKKDYKFGFGMTVGE

SEQ ID NO: 10367 - protein, 309 aa, Carthamus tinctorius
MATIVPPPTTPSPAAEAIKPEKVDYMDLPCPIPYEEIHREAMMSLKPDHFEGMRIDFTKGLNQRFSLSHSIAMGPTEVPSQSAETIKIPTANYEFGANFIDPKLMLIGRIHTDGRLTARVKCDLSENLTMKANAQLTNEPHMSHGMFNFDYKGTDYRTQFQLGNGGLLGASYIQSLTPHLSLGGEVFWAGQHRKSGIGYAARYNTDKMVASGQIASTGMLALSYVQKVSEKVSLASDLMYNYMSRDVTASFGYDYILRQCRLRGKIDSNGCTSAFLEERLNMGLNFILSAEIDHKKKDYKFGFGLTVGE

SEQ ID NO: 10368 - protein, 317 aa, Mimulus guttatus
MATLIPPSPATATTHPAAGPTNPTATEQPKVDYLNLPCPIPYEEIHREALMSLKPELFEGLRFDFTKGLNQKFSLSHSVMMGPTEVPSQSTETIKIPTANYEFGANFIDPKLMLFGRVMTDGRLNARLKCDLTENLTLKGNAQLTNEPHMSHGMFNFDYKGSDYRTQFQLGNGALFGASYIQSVSPHLSLGGEVFWAGQHRKSGIGYAARYNTDKMVTTGQVASTGMVALSYVQKVSEKVSLASDFMYNYMSRDVTASFGYDYILRQCRLRGKIDSNGVVAAFLEERFNMGLNFLLSAEIDHKKKDYKFGFGLTVGE

SEQ ID NO: 10369 - protein, 309 aa, Echinacea purpurea
MATHIPPPATPSPAAEPLKPEKVDYMNLPCPIPYEEIHREAMMSLKPEHFEGMRFDFTKGLNQKFSLSHSVVMGPTEVPSQSAETIKIPTANYEFGANFIDPKLMLFGRVLTDGRLSARVKCDLSENLTMKANAQLTNEPHMSHGMFNFDYKGSDYRTQLQLGNGGLIGASYIQSVTPNLSLGGEVFWAGQHRKSGLGYAARYNTDKMVASGQIASTGMVVLGYVQKVSEKVSLATDMMYNYMSRDVTASFGYDYILRQCRLRGKIDSNGCTSAFLEERLNMGLNFILSAEIDHKKKDYKFGFGLTVGE

SEQ ID NO: 10370 - protein, 309 aa, Helianthus annuus
MATHIPPPVAPSPAAEPVKPEKVDYMDLPCPIPYEEIHREAMMSLKPEHFEGMRFDFTKGLNQKFSLSHSIVMGPTEVPSQSAETIKIPTANYEFGANFIDPKLMLFGRILTDGRLSARVKCDLSENLTMKANAQLTNEPHMSHGMFNFDYKGSDYRTQLQLGNGGLIGASYIQSVTPHLSLGGEVFWAGQHRKSGLGYAARYNTDKMVASGQIASTGMVVLGYVQKVSEKVSLATDMMYNYMSRDVTASFGYDYILRQCRLRGKIDSNGCTSAFLEERLNMGLNFILSAEIDHKKKDYKFGFGLTVGE

SEQ ID NO: 10371 - protein, 309 aa, Helianthus annuus
MATHIPPPAAPSPAAEPVKPEKVDYMDLPCPIPYEEIHREAMMSLKPEHFEGMRFDFTKGLNQKFSLSHSIVMGPTEVPSQSAETIKIPTANYEFGANFIDPKLMLFGRILTDGRLSARVKCDLSENLTMKANAQLTNEPHMSHGMFNFDYKGSDYRTQLQLGNGGLIGASYIQSVTPHLSLGGEVFWAGQHRKSGLGYAARYNTDKMVASGQIASTGMVVLGYVQKVSEKVSLATDMMYNYMSRDVTASFGYDYILRQCRLRGKIDSNGCTSAFLEERLNMGLNFILSAEIDHKKKDYKFGFGLTVGE

SEQ ID NO: 10372 - protein, 306 aa, Panax ginseng
MATLVPPATSKPTVIEPEKVDYMDLPCPIPYEEIHREALMSLKPELFEGLRFDFTKGLNQKFSLSHSVFMGPTEVPSQSAETIKIPTATYEFGANFIDPKLMLIGRILTDGRLSARVKCDLSDNLTLKANAQLTNEPHMSHGMVNFDYKGKDFRSQVQLGNGALFGASYIQSVTPHFSLGGEVFWAGQHRKSGIGYAARYNTDKMVATGQVASTGMVALSYVQKLSDKVSLASDFMYNYMSRDVTASVGYDYILRQCRLRGKIDSNGCTAAFLEERLNMGLNFILSAEIDHKKKDYKFGFGLTVGE

SEQ ID NO: 10373 - protein, 284 aa, Flaveria ramosissima
MDLPCPIPYEEIHREAMMSLKPDHFEGMRVDFTKGLNQKFSLSHSIVMGPTEVPSQSAETIKIPTANYEFGANFIDPKLMLFGRILTDGRLSARVKCDLSENLTMKANAQLTNEPHMSHGMFNFDYKGSDYRTQLQLGNGGLIGASYIQSVTPHLSLGGEVFWAGQHRKSGIGYAARYSTDKMVASGQIASTGMVVLGYVQKVSEKVSLATDMMYNYMSRDATASFGYDYILRQCRLRGKIDSNGCTSAFLEERLNMGLNFILSAEIDHKKKDYKFGFGLTVGE

SEQ ID NO: 10374 - protein, 299 aa, Helianthus annuus
MATHIPPPEPEKVDYMDLPCPIPYEEIHREALMSLKPEHFEGLRFDFTKGLNQKFSLSHSIVMGPTEVPSQSAETIKIPTANYEFGANFIDPKVMLFGRILTDGRLSARVKCDLSENLTMKANAQLTNEPHMSHGMFNFDYKGTDYRTQFQLGNGGLLGANYIQSVTPHLSLGGEVFWAGQHRKSGLGYAARYNTDKMVASGQIASTGMVALSYVQKVSEKVSLATDMMYNYMSRDVTASVGYDYILRQCRLRGKIDSNGCTSAFLEERLNMGLNFILSAEIDHKKKDYKFGFGLTVGE

SEQ ID NO: 10375 - protein, 299 aa, Helianthus annuus
MATHIPPPEPEKVDYMDLPCPIPYEEIHREALMSLKPEHFEGLRFDFTKGLNQKFSLSHSIVMGPTEVPSQSAETIKIPTANYEFGANFIDPKVMLFGRILTDGRLSARVKCDLSENLTLKANAQLTNEPHMSHGMFNFDYKGTDYRTQFQLGNGGLLGANYIQSVTPHLSLGGEVFWAGQHRKSGLGYAARYNTDKMVASGQIASTGMVALSYVQKVSEKVSLATDMMYNYMSRDVTASVGYDYILRQCRLRGKIDSNGCTSAFLEERLNMGLNFILSAEIDHKKKDYKFGFGLTVGE

SEQ ID NO: 10376 - protein, 308 aa, Centaurea maculosa
MATIVPPPISPPAAEAIKPEKVDYMDLPTPIPYEEIHREALMSLKPEHFEGMRVDFTKGLNQRFSLSHSIMMGPTEVPSQSAETIKIPTAHYEFGANFIDPKLMLFGRVLTDGRVNARVKCDLSENLSMKANAQLTGEPHMSHGMVNFDYKGTDYRTQFQLGNGALLGASYIQSVTRNLSLGGEVFWAGQHRKSGLGYAARYNTDKMVASGQIASTGMVALSYVQKVSEKVSLASDLMYNYMSRDVSASFGYDYILRQCRLRGKIDSNGCTSAFLEERLNMGLNFILSAELDHMKKDYKFGFGLTVGE

SEQ ID NO: 10377 - protein, 308 aa, Cirsium arvense
MAALVPPPISPAAAEAIKPEKVDYMDLPTPIPYEEIHREALMSLKPEHFEGMRVDFTKGLNQRFSLSHSIIMGPTEVPSQSAETIKIPTAHYEFGANFIDPKLMLFGRVLTDGRVNARVKCDLSENLSMKANAQLTSEPHMSHGMVNFDYKGTDYRTQFQLGNGALLGASYIQSVTPHLSLGGEVFWAGQHRKSGLGYAARYSTDKMVAAGQIASTGMVALSYVQKVSEKVSLASDLMYNYMSRDVTASFGYDYILRQCRLRGKIDSNGCTSAFLEERLNMGLNFILSAEIDHMKKDYKFGFGLTVGE

SEQ ID NO: 10378 - protein, 96 aa, Panax ginseng
MATLVPPATSKPTVIEPEKVDYMDLPCPIPYEEIHREALMSLKPELFEGLRFDFTKGLNQKFSLSHSVFMGPTEVPSQSAEQLRYPLLPTSLVPTL

SEQ ID NO: 10379 - protein, 284 aa, Primula obconica
MNLPSPIPYEEIHREAFMSLKPELFEGMRFDFTRALNQKFALSHSVSMGPTEIPSQGSEAFKIPTANYEFGANFLDPKLMLVGRILTDGRLNARVKCDLSENLTLKANAQLTSEPHMSQGMANFDYKGKDFRTQFQLGSGALLGASYIQNVTPHLSLGGEVFWAGQHRKSGIGYAARYNNDKMVATGQVASTGLVVLSYVQKVSEKVSLASDLMYNYMSRDVTASFGYDYILRQSRLRGKIDSNGCTAAFLEERLNMGLNFILSAEIDHKKKDYKFGFGLTVGE

SEQ ID NO: 10380 - protein, 312 aa, Centaurea maculosa
MATIVPPPATPPPPAAAAEAIKPEKVDYMDLPCPIPYEEIHREAMMSLKPDHFEGMRVDFTKGLNQRFSLSHSIAMGPTEVPAQSAETIKIPTATYDFGANFIDPKLMLIGRIHTDGRLTARVKCDLSENLTMKANAQLTNEPHMSHGMFNFDYKGTDYRTQFQLGNGGLLGASYIQSVTPRLSLGGEVFWAGQHRKSGTGFAARYNTDKMVASGQIASTGMLALSYVQKVSEKVSLASDLMYNYMSRDVTASFGYDYILRQCRLRGKIDSNGCTSAFLEERLNMGLNFILSAEIDHKKKDYKFGFGLTVGE

SEQ ID NO: 10381 - protein, 311 aa, Taraxacum officinale
MAALFPPPPATASPAAAEAIKPEKVDYMDLPCPIPYEEIHREAMMSLKPEHFEGMRVDFTKGLNQRFSLSHSIVMGPTEVPSQSPDTIKIPTANYEFGANFIDPKLMLFGRILTDGRLSARVKCDISENLTMKANAQLTNEPHMSHGMFNFDYKGSDYRTQFQLGNGGLIGTSYIQSVTPHLSLGGEVFWAGQHRKSGLGYAARYNTDKMVMSGQIASTGMVALSYVQKVSEKVSLASDLMYNYMSRDVTASFGYDYILRQCRLRGKIDSNGCTSAFLEERLNMGLNFILSAEIDHRKKDYKFGFGLTVGE

SEQ ID NO: 10382 - protein, 100 aa, Sarracenia psittacina
MATLVPPAASSPPASKPTVIQPEKVDYLNLPCPIPYEEIHREALMSLKPELFEGMRFDFTKGLNQKFSLSHSVFMGPTEIPSQSSKPLDSTAHYESVLTL

SEQ ID NO: 10383 - protein, 310 aa, Arnica chamissonis
MATHFPPPTTASPVAAEAIKPEKVDYMDLPCPIPYEEIHREAMMSLKPEHFEGMRVDFTKGLNQRFSLSHSIVMGPTEIPSQSAETIKIPTSNYEFGANFIDPKVMLFGRILTDGRLSARVKCDLSENLTMKANAQLTNEPHMSHGMFNFDYKGTDYRTQFQLGNGGLLGASYIQSVTPHLSLGGEVFWAGQHRKSGLGYAARYNTDKMVASGQIASTGMVALSYVQKVSEKVSLATDMMYNYMSRDVTASFGYDYILRQCRLRGKIDSNGCTSAFLEERLNMGLNFILSAEIDHKKKDYKFGFGLTVGE

SEQ ID NO: 10384 - protein, 309 aa, Vicia sativa
MASMVPPIPTADDNKPDVKVDYSNLPCPIPFEELHREAMMSLKPELFEGMRFDFTKMLNQKFSLNHSVSMGPTEVPSQSAEIIKIPTANYEFGATVIDHPKMLLMGRALTDGRVTARVKYDLTENLTVKANAQLSSEPHASQGIVNFDYKGKDYRTQIQLGNGSLLGASYIQSVTNHLSLGGEVFWTGQHRKSGVGYAARYNTDKMVATGQIASTGMALLSYVQKVSDKVSLATDLMCNFNSMSRDVTASFGYDYILRQCRLRGKVDSNGVCAAFLEERLNMGLNFILSAELDHKKKDYKFGFGLTVGE

SEQ ID NO: 10385 - protein, 308 aa, Lactuca sativa
MATLVPPPPAAAAAETIKPEKVDYMDLPCPIPYEEIHREALMSLKADYFEGMRVDFTKGLNQRFSLSHSIAMGPTELPSQSAEVIKIPTANYEFGANFIDPKLMLIGRVLTDGRVNARVKCDLSENLTMKANAQLTSEPHMSHGMFNFEYKGSDYRSQFQLGNGGLLGASYIQSVTPHLSLGGEVFWAGQHRKSGLGYAARYNTDKMVASGQIASTGMVALSYVQKVSEKVSLASDLMYNYMSRDVTASFGYDYILRQCRLRGKIDSNGCTSAFLEERLSMGLNFIISAEIDHMKKDYKFGFGLTVGE

SEQ ID NO: 10386 - protein, 312 aa, Panax ginseng
MATLVPPPYSAPPATSKPPVIEPEKVDYMDLPCPIPYEEIHREALMSLKPELFEGLRFDFTKGLNQKFSLSHSVFMGPTEVPSQSAETIKIPTGHYEFGANYVDPKLMLIGRILTDGRLNARVKCDLSDNLTMKANAQLTNEPHMSHGMVNFDYKGNDFRTQLQLGNGALFGASYIQSVTPQFSLGGEVFWAGQHRKSGIGYAARYNTDKMVATGQVASTGMVALSYVQKLSDKVSLASDFMYNYMSRDVTASFGYDYILRQCRLRGKIDSNGCTAAFLEERLNMGLNFILSAEIDHSKKDYKFGFGLTVGE

SEQ ID NO: 10387 - protein, 307 aa, Valeriana officinalis
MATLIPPPLPSQPAVVEPKKVDYMDLPCPIPFEEIHREALMSLKPELFEGMRFDFTKGLNQKFCLSHSVFMGPTEVPSQGAETIKIPTAHYEFGANFIDPKLMLVGRVLTDGRVNARLKCDLTDNLILKGNAQLTSEPHMSHAMGTFDYRGKDYRTQFQLGNGALFGASYIQSVTPSLSLGGEVFWAGQHRKSGIGYAARYNTDKMVATGQVASTGMVALSYVQKVSEKVSLAADLMYNYMSRDVTSSFGYDYILRQARIRGKIDSNGCTSAFLEERLNMGLNFILSAEIDHVKKDYKFGFGLTVGE

SEQ ID NO: 10388 - protein, 69 aa, Juglans hindsii x Juglans regia
MATALNVPPATTTTTLPEMKKEEEKVDYLNLPCPIPYEEIHREALMSLKPELFEGMRFDFTKVSIRSFH

SEQ ID NO: 10389 - protein, 314 aa, Solanum tuberosum
  Sequence also found in Organisms: Solanum phureja
MATLIPPSVIVPPANSRSAAVESEKEKVDYLNLPCPIPYEEIHREALMSLKPELFEGLRFDFTKGLNQRFSLSHSVFMGPTELPTQSADIVKIPTAHYEFGANFIDPQMMLIGRVMTDGRVNARVKCDLSENLSLKANGQLTGEPHMSHGMVNFDYKGKDYRTQFQLGNGALLGASYIQSVGPHLSLGGEVFWAGQHRKSGIGYAARYNTDKMVAAGQVASTGMVALSYVQKISDKVSLASDFMYNYMSRDVTASFGYDYILRQCRLRGKIDSNGCVAAFLEERLNMGLNFILSAEVDHKKKDYKFGFGLTVGE

SEQ ID NO: 10390 - protein, 307 aa, Ocimum basilicum
MATLIPPPPAASNSAAEPQKVDYLNLPCPIPYEEIHREALMSLKPELFEGLRFDFTKGLNQKFSLSHSVTMGPTEIPAQSSDVIKIPTANYEFGANFIDPKLMLFGRVTTDGRLNARLKCDLTDNLSLKGNAQLTNEPHMSHGMFNFDYKGSDFRTQFQVGNGALFGASYIQSVTPNLSLGGEVFWAGQHRKSGIGYAARYNTDKMVATGQVASTGIVALGYVQKVSEKVSLATDFMFNYMSRDVTASVGYDYILRQCRLRGKIDSNGVTSAFLEERLNMGLNFLLSAEIDHRKKDYKFGFGLTVGE

SEQ ID NO: 10391 - protein, 313 aa, Nicotiana benthamiana
MATLVPPSTTVPPAAGSKSPAVESEKVDYLNLPCPIPYEEIHREALMSLKPELFEGLRFDFTKGLNQRFSLSHSVFMGPTELPTQSADIVKIPTAHYEFGANFIDPKMMLIGRVLTDGRVNARVKCDLSENLSLKANGQLTGEPHMSHGMANFDYKGKDYRTQFQLGNGALFGASYIQSVSPHLSLGGEVFWAGQHRKSGIGYAARYNTDKMVASGQVASTGMVALSYVQKISEKVSLASDFMYNYMSRDVTASFGYDYILRQCRLRGKIDSNGCVAAFLEERLNMGLNFVLSAEVDHKKKDYKFGFGLTVGE

SEQ ID NO: 10392 - protein, 308 aa, Ricinus communis
MAGIVPPPTTASSKTINEVHSKVDYMDLPCPIPYEELHREALMSLKPELFEGMRFDFTKGLNQKFSLSHSVFMGPMELPSQSSETIKIPTAHYEFGANYIDPKLMLFGRVLTDGRLNARVKCDLTDNLTLKANAQLTNEPHMSHAMFNFDYKGNDYRTQLQLGNGALFGASYIQSVTPHLSLGGEVFWAGQHRKSGVGYAARYETDKMVGTGQVASTGMVALSYVQKVSEKVSLATDLMYNYMSRDVTASVGYDYILRQARLRGKIDSNGCASAFLEERLNMGLNFILSAELDHKKKDYKFGFGLTVG

SEQ ID NO: 10393 - protein, 302 aa, Panax ginseng
VPPATSKPTVIEPEKVDYMDLPCPIPYEEIHREALMSLKPELFEGLRFDFTKGLNQKFSLSHSVFMGPTEVPSQSAETIKIPTATYEFGANFIDPKLMLIGRILTDGRLSARVKCDLSDNLTLKANAQLTNEPHMSHGMVNFDYKGKDFRSQVQLGNGALFGASYIQSVTPHFSLGGEVFWAGQHRKSGIGYAARYNTDKMVATGQVASTGMVALSYVQKLSDKVSLASDFMYNYMSRDVTASVGYDYIPRQCHLRGKIDSNGCTAAFLEERLNMGLNFILSAEIDHKKKDYKFGFGLTVGE

SEQ ID NO: 10394 - protein, 314 aa, Solanum lycopersicum
MATLIPPSVIVPPANSKSAAVESEKEKVDYLNLPCPIPYEEIHREALMSLKPELFEGLRFDFTRGLNQRFSLSHSVFMGPTELPTQSADIVKIPTAHYEFGANFIDPQMMLIGRVMTDGRVNARVKCDLSENLSLKANGQLTGEPHMSHGMVNFDYKGKDYRTQFQLGNGALLGASYIQSVGPHLSLGGEVFWAGQHRKSGIGYAARYNTDKMVAAGQVASTGMVALSYVQKISDKVSLASDFMYNYMSRDVTASFGYDYILRQCRLRGKIDSNGCAAAFLEERLNMGLNFILSAEVDHKKKDYKFGFGLTVGE

SEQ ID NO: 10395 - protein, 311 aa, Citrus clementina
  Sequence also found in Organisms: Citrus sinensis
MAGLVPPGTTVKPDASTAKPKEEEKVDYMNLPCPIPYEEIHREALMSLKPELFEGLRFDFTKGLNQKFSLSHSVIMGPTEIPSQSTETIKIPTAHYEFGANYIDPKLMLIGRVLTDGRLNARVKCDLSDNLSLKANAQLTNEPHMSHGMINFDYKGKDYRTQFQFGNGALFGASYIQNVSPHLSLGGEVFWAGQHRKSGIGYAARYENDKMVATGQVASTGMVALSYVQKLSEKVSLATDLMYNYMSRDVTSSVGYDYILRQCRLRGKIDSNGCAAAYLEERLNMGLNFILSAEIDHRKKDYKFGFGLTVG

SEQ ID NO: 10396 - protein, 312 aa, Lippia dulcis
MAALVPPSPAAPAAAASSSDAEQPKVDYLNLPCPIPYEEIHREALMSLKPELFEGLRFDFTKGLNQKFSLSHSVMMGPTEIPAQSAETIKIPTANYEFGANFIDPKLMLFGRVMTDGRLNARLKCDLTDNLTLKGNAQLTNEPHMSHGMFNFDYKGSDYRTQFQVGNGALLGASYIQSVTRNLSLGGEVFWAGQHRKSGIGYAARYNTDKMVASGQVASTGMVALSYVQKVSDKVSLATDLMYNYMSGDVTSSVGYDYILRQCRLRGKIDSNGSVSAFLEERLNMGLNFLLSAEIDHRKKDYKFGFGLTVGE

SEQ ID NO: 10397 - protein, 312 aa, Solanum melongena
MATLVPPATAASPVGTKPTVIEPEKVDYFNLPCPIPYEEIHREALMSLKPELFEGMRFDFTKGLNQRFSLSHSVFMGPTELPTQSTDVVKIPTAHYEFGANFIDPKMMLLGRVMTDGRVNARVRCDLSENLAMKANAQLMGEPHMSHGMVNFDYKGKDYRAQFQFGNGALFGANYIQSVTPHLSLGGEVFWAGQHRKSGIGYAARYNTDKMVATGQVASTGMVALGYVQKVSEKVSLASDFMYNYMSRDVTASVGYDYILRQCRLRGKIDSNGCVAAFLEERLNMGLNFILSAEVDHKKKDYKFGFGLTVGE

SEQ ID NO: 10398 - protein, 317 aa, Cucumis melo
MAGLAPPTAATATAAPYPLPVPPKKTEDEKVDYLNLPCPIPYEEIHREAFMSLKPELFEGMRFDFTKGLNQKFSLSHSVFMGPTEIPNQSAETIKIPTATYEFGANFIDPKLMLFGRILTDGRLNARVKCDLSDNLTLKANAQLTNEPHMSHGMVNFDYKGRDFRTQFQLGNGALFGASYIQSVSPHLSLGGEVFWAGQHRKSGIGYAARYNTDKMVATGQVASTGMVALSYVQKVSEKVSLATDFTYNYMSRDVISSLGYDYILRQSRLRGKIDSNGCVAAFLEERLNMGVNFILSAEIDHRKKDYKFGFGLTVGE

SEQ ID NO: 10399 - protein, 51 aa, Orobanche aegyptiaca
MTTLIPPSPAPAVTPPAAGSNPTVSEQPKANYLNLPCPFPYEEIHREALMS

SEQ ID NO: 10400 - protein, 313 aa, Quercus alba
MATATATAPPTSSTTALPQMKKENEKVDYFNLPCPIPYEEIHREAFMSLKPELFEGMRFDFTKGLNQRFSLSHSVFMGPMEIPSQSSETIKIPTAHYEFGANFIDPKLMLFGRIMTDGRLNARVKCDLTDNLSFKGNAQLTNEPHMSHGMAYFDYKGKDYRSQFQLGNGALLGANYIQSVTPNLSFGGEVFWAGQHRKSGIGYAARYNTDKMVATGQVASTGLVALSYVQKISEKVSLASDLMYNYMSKEATASFGYDYILRQCRLRGKIDSNGCASAFLEERLNMGLNFILSAELDHRKKDYKFGFGLTVGE

SEQ ID NO: 10401 - protein, 283 aa, Gossypium hirsutum
MNLPCPIPFEEIHREALMSLKPETFEGLRFDFTKGLNQKFSLSHSVSMGPTEIPSQSAETIKIPTSHYEFGANYIDPNLMLIGRVLTDGRLNARVKWDLTDNFTVKANAQLTNEPHMSHGMFNFDYKGKDYRSQFQIGNGALFGASYFQSVTPHLSMGGEVFWAGQHRKSGIGYAGRYETDKMVATGQVASTGMVALSYVQKVSEKVSLASDFMYNYMSKDVTASVGYDYILRQCRLRGKIDSNGCTTAFLEERLNMGLNFILSAEIDHKKKDYKFGFGLTVG

SEQ ID NO: 10402 - protein, 313 aa, Theobroma cacao
MAGLVPPGITTIPADASKTAHTKHEEKTDYMNLPCPIPYEEIHREALMSLKPETFEGLRFDFTKGLNQKFSLSHSVFMGPTEIPSQSAETIKIPTAHYEFGANFIDPNLMLIGRVLTDGRLNARVKWDLTDNLALKANAQLTNEPHMSHGMVNFDYKGKDYRSQFQMGNGALFGASYIQSVTPHLSLGGEVFWAGQHRKSGIGYAARYETDKMVATGQVASTGMVALSYVQKVSEKVSLASDLMYNYMSREVTSSVGYDYILRQCRLRGKIDSNGCTAAYLEERLNMGLNFVLSAEIDHRKKDYKFGFGLTVG

SEQ ID NO: 10403 - protein, 421 aa, Centaurea maculosa
MKKDSPKSWKPYCCSADKDKVFCNFSRCRPSRSEFSKNVAPSPSFRRMSFSDLSRSSSMRINEDIAHAFGPDLFDFKLSELRAITQNFSSNFLLGEGGFGKVHKGYVDENMRPGLKAQPIAVKLLDIEGLQGHREWLAEVIFLGQLRHPNLVKLIGYCCEEEERLLVYEFLARGSLENHLFKRISVCLPWGIRIKIAIGAAKGLAFLHGADNPVIYRDFKTSNILLDSDFNAKLSDFGLATMGPEGSNTHVTTRVMGTYGYAAPEYVNTGHLTTKSDIYSFGVVLLELLTGRRAMDKNRPKSEQNLVEWAKPYLTSSRRVRGVIDPRLAGQYSVRGAKEMALLALYCVSPNPKDRPKMPAIIETLEGLKNFKDMAITCGQWPPASRKTPRDAVYMPKDSTETNGGRIYWKQTPVKTVRTKG

SEQ ID NO: 10404 - protein, 418 aa, Cichorium intybus
MKDSPKPWKPYCCSAENKVFHSFSRCRPSKSEFSKNVAPSPSFRRMSFSDLSRSSSMRLNEDIQSFGPDLFDFKLSELRAVTQNFSSNFLLGEGGFGKVHKGYVDESMRPGLKAQPVAVKLLDIEGLQGHREWLAEVIFLGQLRHPNLVKLIGYCCEEEERLLVYEFMARGSLENHLFKRISVCLPWAIRIRIAIGAAKGLAFLHGAESPVIYRDFKTSNILLDSDFNAKLSDFGLATMGPEGSNTHVTTRVMGTYGYAAPEYVNTGHLTTKSDIYSFGVVLLELLTGRRAMDKKRPKSEQHLVDFAKPYLTSSRRVRAIIDPRFGGQYSVKGAKEVALLALYCVSSNPKDRPKMPVIIETLEGVKNFKDMAITCGQWAPPSQKNARNAVYMPKENKEMNGGRIYWKQTPVKTVSTKG

SEQ ID NO: 10405 - protein, 423 aa, Lactuca sativa
MKAKDSPKTTWKPYCCSAENKVFHSFSRCRPSKSEFSKNVAPSPSFRRMSFSDLSRSSSMRLNEDIQSFGPDLFDFKLSELRGVTQNFSSNFLLGEGGFGKVHKGYVDETMRSGLKPQPVAVKLLDIEGLQGHREWLAEVIFLGQLRHPNLVKLIGYCCEEEERLLVYEFMPRGSLENHLFKRISVCLAWGIRIRIAIGAAKGLAFLHGAESPVIYRDFKTSNILLDSDFNAKLSDFGLATMGPEGSNTHVTTRVMGTYGYAAPEYVNTGHLTTKSDIYSFGVVLLELLTGRRAMDKKRPKSEQNLVDFARPYLTSSRRVRAIIDPRLGGQYSVKGAKEVALLALYCVSLNPKDRPKMPVIIETLEGVKNLKDMAISSGQWAPPPTQKTARNAVYMPKESKDMNGGGRIYWKQTPVKTVSTKG

SEQ ID NO: 10406 - protein, 319 aa, Chrysanthemum coronarium
MKETRKSWKPRCCTAEDKVFCNFSRCRPSKSKFSKNVGPTPSFRRMSFSDLSRSSSLRISENIANTFGPDLLDFKLSELRAITQNFSSNFLLGEGGFGKVHKGYVDENMRPGLKAQPIAVKLLDIEGLQGHREWLAEVIFLGQLRHPNLVKLVGYCCEEEERVLVYEFMARGSLENHLFKRISVCLPWGIRIKIAIGAAKGLAFLHGAETPVIYRDFKTSNILLDSDFNAKLSDFGLATMGPEGSNTHVTTRVMGTYGYAAPEYVNTGHLTTKSDIYSFGVVLLELLTGRRAMDGGGGGGGGGAKERAKSCGLGQAIPD

SEQ ID NO: 10407 - protein, 423 aa, Lactuca sativa
MKDSSKSWQPFIANCCSVKDQTVFNNFSRCRTSRSDFSKNVTPSPSFRHLSFSDLSQSSSMRINEDIAQTFGPDLFDFKLSELRAITQNFSSNFLLGEGGFGTVHKGYVDDNMRCGMKAQAVAVKLLDIEGLQGHREWLAEVIFLGQLRHPNLVKLIGYCCEEEERLLVYEFMPRGSLENHLFKRISVCLPWGNRLKIAIGAAKGLAFLHGADKPVIYRDFKTSNILLDSDFNAKLSDFGLATMGPEGSNTHVTTRVMGTYGYAAPEYVNTGHLTTKSDIYSFGVVLIELLTGKRAMDKTRPKSEQYLVDWAKPYMTSSRRLRCIIDPRLTGQYSVRGVKEMAVLALNCVNLNPKDRPKMTEIIETLERLENLKDMAVTCGQWPVASRKTARDAVFSPKGRKEINGGHIYWKQTPVKNIKVKG

SEQ ID NO: 10408 - protein, 380 aa, Centaurea maculosa
KDSPKSWRPYCCSADKDKVFCNFSRCRPSRSEFSKNVAPSPSFRRMSFSDLSRSSSMRINEDIAHAFGPDLFDFKLSELRAITQNFSSNFLLGEGGFGKVHKGYVDENMRPGLKAQPIAVKLLDIEGLQGHREWLAEVIFLGQLRHPNLVKLIGYCCEEEERLLVYEFLARGSLENHLFKRISVCLPWGIRIKIAIGAAKGLAFLHGADNPVIYRDFKTSNILLDSDFNAKLSDFGLATMGPEGSNTHVTTRVMGTYGYAAPEYVNTGHLTTKSDIYSFGVVLLELLTGRRAMDKNRPKSEQNLVEWAKPYLTSSRRVRGVIDPRLAGQYSVRGAKEMALLALYCVSPNPKDRPKMPAIIETLEGAQIFKIWPSLVASGP

SEQ ID NO: 10409 - protein, 419 aa, Chrysanthemum coronarium
MKETRKSWKPRCCTAEDKVFCNFSRCRPSKSKFSKNVGPTPSFRRMSFSDLSRSSSLRISENIANTFGPDLLDFKLSELRAITQNFSSNFLLGEGGFGKVHKGYVDENMRPGLKAQPIAVKLLDIEGLQGHREWLAEVIFLGQLRHPNLVKLVGYCCEEEERVLVYEFMARGSLENHLFKRISVCLPWGNRLKIAIGAAKGLAFLHGAESPVIYRDFKTSNILLDSDFNAKLSDFGLATMGPEGSNTHVTTRVMGTYGYAAPEYVNTGHLTTKSDIYSYGVVLLELLTGKRAMDKSRPKSEQYLVDWVKPYLTSTRRLRYIIDPRLSGQYSVRGTREMAVLALGCVSLNPKDRPKMTEIIHILEALQDLKDMAISCGQWPVTSQKNARNAVFNPNGRKERNGGRAYWKTTPVSTIKSKG

SEQ ID NO: 10410 - protein, 164 aa, Panax ginseng
MQSLQQKASEWSGVATDDAFAIDKTNLFQKLGLQAFINLSTNFYTRVYDEDEEWFRSIFANSKKEDAIQNQYEFFVQRMGGPPLYSQRKGHPALIGRHRPFPVTHRAAERWLHHMQQALDDSTDIDADSKTKMMHFFRHTAFFLVAGDELKNPNQGVPPKPGAS

SEQ ID NO: 10411 - protein, 256 aa, Helianthus annuus
MANIRAFFILALLLLSSSFFLQVARSQSDPDAEADAELVAETVEEGSHVGDDVEDIGVGNYNPAPGVETVSVFPKNFAKLVVAGQETELLIGLKNEGEQNVKVFAVHASVHLPFDHRMLVQNLSTVAFNDASVPASVQATFPYTFAVSKFLQPGTFDLVGTIVYEIDQLPYQNVFYNGTIEVTEAGGLVSVETVFLVSLGLALLVLFGLWVRTQLQSLSKKTKKITKVEVGTRTVDASMDEWLQGTAYTPSQSNKL

SEQ ID NO: 10412 - protein, 253 aa, Helianthus annuus
MAKIRACFILALLLLSSSFFLQVARSQSDPDAEADAELVAETVEEGSHVGDDVEDIGVGNYKPAPGVETVSVFPKNFAKLVVAGQETELLIGLKNEGEQNVKVFAVHASVHLPFDHRMLVQNLSTVAFNDASVPASVQATFPYTFAVSKFLQPGTFDLVGTIVYEIDQLPYQNVFYNGTIEVTEAGGLVSVETVFLVSLGLALLVLFGLWVRTQLQSLSKKTKKITKVEVGTRTGDASMDEWLQGTAYTQSQS

SEQ ID NO: 10413 - protein, 261 aa, Ambrosia trifida
MAKIRAFFILSLLVLLSSSFFLQVARSQSEPDSEADAELVAETVEEGSHVDDDVQDIGFGNYNPAPGVETVSVFPKNFAKLVVAGQETELLVGLKNEGEHSVKVIAVRASVHLPYDHRMLVQNLSTVAFNDASVPASVQATFPYTFAVSKFLQPGTFDLVGTIVYEIDQVPYQNVFYNGTIEVTEAGGLVSVETVFLVSLGLALLVLFGLWIRTQLQSLSKKTKKITKVEVGTRTVDASMDEWLQGTAYTQSQSNKLKKKK

SEQ ID NO: 10414 - protein, 260 aa, Flaveria ramosissima
MAKIRAFFILALLLLSSSFFLQVARSQSDSDSEADAELVAETVEEGSYVGDDNQDIGIGNYNPAPGVETVCVFPKNFAKLVVAGQETELLVGMKNEGEQSVKVIAVHASVHLPFDHRMLVQNLSTMAFNNASVPASVQATFPYIFAVSKFLQPGTFDLVGTIVYEIDQLPYQNTFYNGTIEVTEAGGLVSVETVFLVSLGLALLVLLGLWVRSQLQFLSKKTKKITKVEVGTRTVDASMDEWLQGTAYTQSQSNKLKKKK

SEQ ID NO: 10415 - protein, 260 aa, Ambrosia trifida
MAKISAFFFLSLLLLSSSFFLQVARSQSDSESEADAELVAETVKEGSHVDDDVQDIGFGNYNPAPGVETVSVFPKNFAKLVVAGQETELLVGLKNEGEHSVKVIAVRASVHLPYDHRMLVQNLSTVAFNDASVPASVQATFPYTFAVSKFLQPGTFDLVGTIVYEIDQVPYQNVFYNGTIEVTEAGGLVSVETVFLVSLGLALLVLFGLWVRTQLQSLSKKTKKVTKVEVGTRTVDASMDEWLQGTAYTQSQSNKLKKKK

SEQ ID NO: 10416 - protein, 260 aa, Flaveria ramosissima
MAKIRAFFILALLLLSSSFFLQVARSQSDSDSEADAELVAETVEEGSYVGDDNQDIGVGNYNPAPGVETVCVFPKNFAKLVVAGQETELLVGMKNEGEQSVKVIAVHASVHLPFDHRMLVQNLSTMAFNNASVPASVQATFPYIFAVSKFLQPGTFDLVGTIVYEIDQLPYQNTFYNGTIEVTEAGGLVSVETVFLVSLGLALLVLLGLWVRSQLQFLSKKTKKITKVEVGTRTVDASMDEWLQGTAYTQSQSNKLKKKK

SEQ ID NO: 10417 - protein, 224 aa, Flaveria ramosissima
MAKIRAFFILALLLLSSSFFLQVARSQSDSDSEADAELVAETVEEGSYVGDDNQDIGVRNFNPAPGVETVCVFPKNSAKLVVAGQETELLVGMKNEGEQSVKVIAVHASVHLPFDHRMLVQNLSTMAFNNASVPASVQATFPYIFAVSKFLQPGTFDLVGTIVYEIDQLPYQSTFYNGTIEVTEAGGLVSVETVFLVSLGLALLVLLGLWVRSQLQFLSKKTKR

SEQ ID NO: 10418 - protein, 261 aa, Helianthus annuus
MAKIRAFFFFTLLLLSSSFFIQVARSQSDSVDSDADAELVAETVKEGEYVGDDTHDFGVGNYNPAPGVETVSVFPKNPVKLVVAGQETELLVGLKNEGEQSVNVVAVHASVHLPFDHRMLVQNLSVMSFNNASVPASVQATFPYIFAVSKFLQPGTFDLVGTIVYEIDQQPYQNTFYNGTIEVTEAGGLVSVETVFLVSLGLALLVLLGLWVRTQLQSLSKKTKKITKVEVGTRTVDASMDEWLQGTAYTQSQSNKLKKKK

SEQ ID NO: 10419 - protein, 262 aa, Helianthus annuus
MAKIRAFFFFTLLLLLSSSFFIQVARSQSDSVDSDADAELVAETVKEGEYVGDDTHDFGVGNYNPAPGVETVSVFPKNPVKLVVAGQETELLVGLKNEGEQSVNVVAVHASVHLPFDHRMLVQNLSVMSFNNASVPASVQATFPYIFAVSKFLQPGTFDLVGTIVYEIDQQPYQNTFYNGTIEVTEAGGLVSVETVFLVSLGLALLVLLGLWVRTQLQSLSKKTKKITKVEVGTRTVDASMDEWLQGTAYTQSQSNKLKKKK

SEQ ID NO: 10420 - protein, 261 aa, Helianthus annuus
MAKIRAFFFFTLLLLSSSFFIQVARSQSDSVDSDADAELVAETVKEGEYVGDDTHDFGVGNYNPAPGVETVSVFPKNPVKLVVAGQETELLVGLKNEGEQSVNVVAVHASVHLPFDHRMLVQNLSVMSFNNASVPASVQATFPYIFAVSKFLQPGTFDLVGTIVYEIDQQPYQNTFYNGTIEVTEAGGLVSVETVFLVSLGLALLVLLGLWVRTQLQSLSKKTKKITKVEVGTRTVDASMDEWLQGTAYTQSQSKQLKKKK

SEQ ID NO: 10421 - protein, 261 aa, Artemisia annua
MANLRAFFIFTLLLLSSSFLIQVARSQSDPDSDNAELVAETVEEGGVGNVGDEAQDFGVGNYNPAPGVETVCVFPKNIGKLVVAGQETEVLIGLKNEGEQNVKVLAIHSSVHLPYDHRMLVQNLSTVAFNKASVPASVQATFPYVFAVSKFLQPGTFDLVGTIVYEIDQVPYQNTFYNGTIEVTEAGGFVSVETVFLVSLGLASLVLFGLWVRTKLQVLSKKTKKITKIEVGTRTVDASMDEWLQGTAYTQSQSNKLKKKK

SEQ ID NO: 10422 - protein, 261 aa, Chrysanthemum coronarium
MANLKTFFIFTLLLLSSSFLIQVARSQSDPDSDNAELVAETVEEGAVGNVGDEAQDFGVGNYNPAPGVETVCVFPKNIGKLVVAGQETEVLIGLKNEGEQNVKVLAIHSSVHLPYDHRMLVQNLSTVAFNKASVPASVQATFPYVFAVSKFLQPGTFDLVGTIVYEIDQVPYQNTFYNGTIEVTEAGGFVSVETVFLVSLGLASLVLFGLWVRTKLQALSKKTKKITKIEVGTRAVDASMDEWLQGTAYTQSQSNKLKKKK

SEQ ID NO: 10423 - protein, 262 aa, Centaurea maculosa
MAKIRVFFLLALLLLSSSFFLQVARSQSDSDADADAELVAETVEEGGDLGIVGDDTQDFGGGNYSPAPGVKTVCVFPKNPVKFVVAGQETELLIGLKNEGEQSVKVLAIHASVHLPFDHQMLVQNLSTQAFNNASVPASVQATYPYMFAVSKFLQPGTFDLVGTIVYEIDNLPYQNTFYNGTIEVTEAGGLVSVETVFLVSLGLALLVLLGLWVRGQLQNLSKKTKRVKVEVGTRTVDASMDEWLQGTAYTLSQANKSKKKK

SEQ ID NO: 10424 - protein, 269 aa, Helianthus annuus
MAKIRAFFFLTLLLLSSSFFIQVARSQSDSVDSDADAELVAETVKEGEYVGDDTHDFGVGNYNPAPGVETVSVFPKNPVKLVVAGQETELLVGLKNEGEQSVNVVAVHASVHLPFDHRMLVQNLSVMSFNNASVPASVQATFPYIFAVSKFLQPGTFDLVGTIVYEIDQQPYQNTFYNGTIEVTEAGGLVSVETVFLVSLGLALLVLLGLWVRTQLQSLSKKTKKITKVEVGTRTVDASMDEWLQGTAYTQSQSNKLKRRSRGIELASN

SEQ ID NO: 10425 - protein, 259 aa, Chrysanthemum coronarium
MANLRAFFIFTLLLLSSSFLIQVARSQSDPDSDNAELVAETVQEGEHVSDEAQDFGVGNYNSAPGVETVCVFPKNIGKLVVAGQETEVLIGLKNEGEQNVKVLAIHSSVHLPYDHRMLVQNLSTLAFNKASVPASVQATFPYVFAVSKFLQPGTFDLVGTIVYEIDQVPYQNTFYNGTIEVTEAGGLVSVETVFLVSLGLACLVLFGLWARTKLQLFSKKNKKITKIEVGTRTVDASMDEWLQGTAYTQSQSTKLKKKK

SEQ ID NO: 10426 - protein, 262 aa, Centaurea maculosa
MANIRVFFLLALLLLSSSFFLQVARSQSDSDPDADAELVAETVEEGGDLGIVGDETQDFGGGNYSPAPGVKTVCVFPKNPVKFVVAGQETELLIGLKNEGEQSVKVLAIHASVHLPFDHQMLVQNLSTQAFNNASVPASVQATYPYMFAVSKFLQPGTFDLVGTIVYEIDNLPYQNTFYNGTIEVTEAGGLVSVETVFLVSLGLALLVLLGLWVRGQLQNLSKKTKRVKVEVGTRTVDASMDEWLQGTAYTLSQANKSKKKK

SEQ ID NO: 10427 - protein, 142 aa, Centaurea maculosa
MLVQNLSTQAFNNASVPASVQATYPYMFAVSKFLQPGTFDLVGTIVYEIDNLPYQNTFYNGTIEVTEAGGLVSVETVFLVSLGLALLVLLGLWVRGQLQNLSKKTKRVKVEVGTRTVDASMDEWLQGTAYTLSQANKSKKKK

SEQ ID NO: 10428 - protein, 259 aa, Chrysanthemum coronarium
MANLRAFFIFTLLLLSSSFLIQVARSQSDPDSDNAELVAETVQEGEHVSDEAQDFGVGNYNSAPGVETVCVFPKNIGKLVVAGQETEVLIGLKNEGEQNVKVLAIHSSVHLPYDHRMLVQNLSTVAFNKASVPASVQATFPYVFAVSKFLQPGTFDLVGTIVYEIDQVPYQNTFYNGTIEVTEAGGLVSVETVFLVSLGLASLVLAGLWLRTKVQAFSKKNKKITKIEVGTRTVDASMDEWLQGTAYTQSQSTKLKKKK

SEQ ID NO: 10429 - protein, 238 aa, Arnica chamissonis
VARSQSDLDSDADAELVAETVEEGSDVGDDIRDIGVGNFNPAPGVETVSVFPKNFAKVVVAGQETELLIGMKNEGEHSVKVIAVHASVHLPFDHRMLVQNLSTVAFNNASVPASVQATFPYIFAVSKFLQPGTFDLVGTIVYEIDQLPYQNVFYNGTIEVTEAGGLVSVETVFLVSLGLALLVLLGLWIRTQLQFLSKKTKKITKVEVGTRTVDASMDEWLQGTAYTQSQSNKMKKKK

SEQ ID NO: 10430 - protein, 260 aa, Cichorium intybus
MAKIRVSFILALLLLLSSSFFLQVVRSQSDSDSDSDAELVAETVAEGGVSDDDIQDFGTGNFSPSPDVETVCVFPKNSAKLVVAGQETELLIGMKNEGEHNVKVLAVYASVHLPFDHRMLVQNLTTQTFNNASVPSSVQATFPYIFAVSKFLQPGTFDLVATIVYEIDQLPYQNTFYNGTIEVTEAGGLVSVETVFLVSLGLGLLILLGLWVRGQLQNLSKKTKRVKVEVGTKTVDASMDEWLQGTAYTQSQSYKLKKKK

SEQ ID NO: 10431 - protein, 263 aa, Carthamus tinctorius
MSKIRVSFILALLLLSSSCFLQVARCQSESDSESDAELVAETVEEGGDLGIVGDDVVDFGAGNFSPAPGVETVCIFPKNLAKTVVAGQETELLIGLKNEGDQNVKVIAVQASVHLPYDHRMLVQNLSTQAFNNASVPASVQATFPYIFAVSKFLQPGTFDLVGTIVYEIDQLPYQNTFYNGTIEVIEAGGLVSIETVFLVSLGISLLVFLGLWVRGQIQNLSKKTKRAPKVETGTKTVDASMDEWLEGTAYTQSKASKLKKKK

SEQ ID NO: 10432 - protein, 143 aa, Centaurea maculosa
MLVQNLSTQAFNNASVPASVQATFPYIFAVSKFLQPGTFDLVGTIVYEIDQLPYQNTFYNGTIEVIEAGGLVSIETVFLVSLGISLLVFLGLWVRGQIQNLSKKTKRAPKVETGTKTVDASMDEWLEGTAYTQSKANKLKKKK

SEQ ID NO: 10433 - protein, 263 aa, Cirsium arvense
MTKIRVSFILALLLLSSSCFLQVVRCQSESDSDADAELVAETVEEGADLGIVGDDAVDFGGGNYSPAPGVETVCIFPKNLAKTVVAGQETELLIGMKNEGDQNVKVLAVHASVHLPYDHRMLVQNLSAVAFNNASVPASVQATFPYIFAVSKFLQPGTFDLVGTIVYEIDQLLYQNTFYNGTIEVIEAGGLVSIETVFLVSLGISLLIFLGLWVRGQIQNLSKKTKKGPKVETGTRTVDASMDEWLEGTAYTQSKASKLKKKK

SEQ ID NO: 10434 - protein, 247 aa, Cichorium intybus
LLLSSSFFLQVVRSQSDSDSDSDAELVAETVAEGGVSDDDVQDFGIGNFSPSPDVETVCVFPKNSAKLVVAGQETELLIGMKNEGEHSVKVLAVYASVHLPFDHRMLVQNLTTQAFNNASVPSSVQATFPYIFAVSKFLQPGTFDLVGTIVYEIDQLPYQNTFYNGTIEVTEAGGLVSVETVFLVSLGLGLLILLGLWVRGQLQNLSKKTKRVKVEVGTKTVDASMDEWLQGTAYTQSQSYKLKKKK

SEQ ID NO: 10435 - protein, 263 aa, Flaveria ramosissima
MAKIRVSFIIALLLLLSSSFFLQVARCQSESDSEDAELVAETVEEGGDLGFVGDDVQDFGGGNYSPAPGVETVCVFPKNAAKTVVAGKETEILIGLKNDGEQTIKVLAVHASVHLPFDHRMLVQNLSAQVFNNASVPPSVQAAFPYIFAVSKFLQAGTFDLVGTIVYEIDQLPYQNTFYNGTIEVTEAGGLVSMETVFLVSLGISLLVFLGLWVRGQIQNLSKKTKKAPKVETGTRTVDASMDEWLEGTAYTQSKANKSKKKK

SEQ ID NO: 10436 - protein, 263 aa, Centaurea maculosa
  Sequence also found in Organisms: Cirsium arvense
MSKIRVSFLLALLLLSSSCFLQVARCQSESDSDSDAELVAETVEEGADLGIVGDDVVDFGAGNYSPAPGVETVCIFPKNLAKTVVAGQETELLIGLKNEGDQNVKVIAVQASVHLPYDHRMLVQNLSTQAFNNASVPTSVQATFPYIFAVSKFLQPGTFDLVGTIVYEIDQLPYQNTFYNGTIEVIEAGGLVSIETVFLVSLGISLLVFLGLWVRGQIQNLSKKTKRAPKVETGTKTVDASMDEWLEGTAYTQSKASKLKKKK

SEQ ID NO: 10437 - protein, 256 aa, Cichorium intybus
MAKIRVSWGGLLSSSFFLQVVRSQSDSDSDSDAELVAETVAEGGVSDDDVQDFGTGNFSPSPDVETVCVFPKNSAKLVVAGQETELLIGMKNEGEHSVKVLAVYASVHLPFDHRMLVQNLTGQAFNNASVPSSVQATFPYIFAVSKFLQPGTFDLVGTIVYEIDQLPYQNTFYNGTIEVIEAGGLVSVETVFLVSLGFGLLILLGLWVRGQLQNLSKKTKRVKVEVGTKTVDASMDEWLQGTAYTQSQSYKLKKKK

SEQ ID NO: 10438 - protein, 70 aa, Helianthus annuus
TKNVSCEQKQLGKVHQKFIMVMQFVKKIKGITNRMGLPMVFAFRRHCGMRVCERHRFCVAYTKEREETQV

SEQ ID NO: 10439 - protein, 162 aa, Ambrosia trifida
MSLVTKAIRDSASEIYHGDAICQEKSKELLTEMGLPNGLLPLEDIVECGYVKDTGFVWLTQKKEKKHKFEKIGKLTTYGTEVTAYIEKFKIKKLTGVKSKELLMWITLSEITVDNPSTGKINFKATSGLYRSFPVSAFQLDDVKKDVGGVSEAKKDSQVKEV

SEQ ID NO: 10440 - protein, 161 aa, Helianthus annuus
MSLVTKAIRESASEIYYGDAICQEKSRELLAEMGLPNGLLPLEDIVECGYVKDTGFVWLIQKKEKKHKFEKIGKVTAYEKEVTAYIEKFKIKKLTGVKSKELLMWIAPSEISVDNPPTGKINFKAASGLQRSFPVSAFQLDDVKKDVGGASVAKDAQVKEV

SEQ ID NO: 10441 - protein, 128 aa, Arnica chamissonis
MGLPNGLLPLEDIVECGYVKDTGFVWLIQKKEKKHKFEKIGKLTSYATEVTAIIEKFKITKLTGVKTKELLMWITLGEISIDNPPTGKINFKATSGLYRSFPVSAFQIDDVKKDVGGVSHSAKDAKEV

SEQ ID NO: 10442 - protein, 184 aa, Senecio madagascariensis
MSLVTEQIRASASEIYHGDAICQEKSKFLLTEMGLPNGLLPLEDIIECGYVKDTGFVWLIQRKEKKHKFEKVGKLTQYGTEVTAYIEKFKIKKLTGVKTKELLMWITLSEITVDDPPTGKITFKATSGLYRQFPVSAFQLEDVKKDVAVDVAKETQVVKDTEKVEDVKKDVEVDVAKEPQVTEV

SEQ ID NO: 10443 - protein, 129 aa, Cirsium arvense
MGLPNGLLPLEDIEECGYVKDTGFVWLKQKKEKKHKFEKIGKLTSYGTEVTAIIEKYRIKKLTGVKTKELLMWITLNEIYVDDPPTGKITFKATSGLYRSFPVSAFEIEDVKKDVGAVDVAKDGQVKEV

SEQ ID NO: 10444 - protein, 161 aa, Centaurea maculosa
MSLVTEEIRASASEVYHGDAICQEKSKFLLTEMGLPNGLLPLEDIEECGYVKDTGFVWLKQKKEKKHKFEKIGKVSSYGTEVTAYIEKYRIKKLTGVKTKELMMWITLSEISVDDPPTGKITFKATSGLYRSFPVSAFEIEDVKKDVGTVDVAKEGQVKEV

SEQ ID NO: 10445 - protein, 161 aa, Carthamus tinctorius
MSLVTEEIRASASEVYHGDAICQEKSKFLLTEMGLPNGLLPLEDIEECGYVKDTGFVWLKQKKEKKHKFEKIGRLTSYGTEVTAIIEKYRIKKLTGVKTKELLMWITLSEISVDDPPTGKITFKATSGLYRSFPVSAFEIEDAKKDVGAVDVAKEGQVKEV

SEQ ID NO: 10446 - protein, 161 aa, Cirsium arvense
MSLVTEEIRASASEVYHGDAICQEKSKFLLTEMGLPNGLLPLEDIEECGYVKDTGFVWLKQKKEKKHKFEKIGKVSSYGTEVTAIIEKYRIKKLTGVKTKELMMWITLSEISVDDPPTGKITFKATSGLYRSFPVSAFEIEDVKKDVGAVDVAKEGQVKEV

SEQ ID NO: 10447 - protein, 183 aa, Helianthus annuus
MSLVTDEIRASASEIYHGDALGQEKSKFLLTEMGLPNGLLPLEDIEECGYVKDTGFVWLKQKKSKVHKFEKIGKLVSYATEVTAVIEKFKIKKLTGVKSKELLMWITLSEITVDDPPTGKITFTATSGLYRTFPVSAFQIEDVKKEGAPQVGVAKDGQVVEDVKKDAGATQVDVAKETKVQEV

SEQ ID NO: 10448 - protein, 187 aa, Helianthus annuus
MSLVTDEIRASASEIYHGDALGQEKSKFLLTEMGLPNGLLPLEDIEGCGYVKDTGFVWLKQKKSKVHKFEKIGKLVSYATEVTAVIEKFKIKKLTGVKSKELLMWITLSEITVDDPPTGKITFTATSGLYRTFPVSAFQIEDVKKDVKKEGAPQVGVAKDGQVVEDVKKDAGATQVGVAKETKVQEV

SEQ ID NO: 10449 - protein, 309 aa, Ambrosia trifida
MVRIKDIFITFFNNRWLVFVAAMWVQSCAGIGYLFGSISPVIKSSLNYNQKQVARLGVAKDLGDSVGFLAGSMSEILPLWALLLVGALQNFVGYGWVWLVVTGKAPMLPLWVMCLLIFIGTNGETYFNTVALVSCVQNFPKSRGPIVGILKGFAGLSGAILTQIYALINSPDKASIIFMVAVGPTMVGIALMFIVRPVGGHRQLRLSDRSSFSLIYCVCLVLAAYLMGVMLVEDLIDLNQTIVKILTAILFVLLVAPIGIPLWLTFLLTQNPQKKKLFCLNHKIKNNPNRHMILMRLYLVKWKMRRLQM

SEQ ID NO: 10450 - protein, 577 aa, Flaveria ramosissima
NRWLVFVAAMWVQSCAGVGYLFGSISPVIKSSLNYNQKQVASLGVAKDLGDSVGFLAGSMSEILPLWALLLVGAIQNFVGYGWVWLIVIGKAQELPLWVMCLLIFIGTNGETYFNTVALVSCVQNFPKSRGPVVGILKGFAGLSGAILTQIYALIKTPDQASIIFMVAVGPTMVAIALMFIVRPVGGHRQLRLSDASSFSLIYCVCLVLAAYLMGVMLVEDLVDLNQTIVQILTSILFVLLVLPIGIPLWLTFSSGPKTSEQEALLSEPQNKEQPESSHDNEIIFSEVEDEKPTEVDLLPASERQKRILQLQSKLAQAAAEGAVRIKRRKGPHRGEDFDLTQALIKADFWLLFWTLLLGSGSGLTIIDNLGQMSESLGYDNTHIFVSMISIWNFLGRVGGGYVSEIVVRDHAYPRPVALAVAQGLMAIGHLFFAMGWPGAMYIGTLLIGLGYGAHWAIIPATASELFGVKKFGALYNFLTLANPGGSLVFSGLIASYIYDSEAEKQAQQRGELIIKSASFLTKLFETDDALKCTGSICYFLTCMIMSGLCIIAAILSMILVHRTKTVYQHLYGTTRA

SEQ ID NO: 10451 - protein, 577 aa, Arnica chamissonis
MARFFVAAMWVQSCAGIGYLFGSLSPVIKSSLNYNQKQVARLGVAKDLGDSVGFLAGSMSEILPLWALLLVGSLQNFVGYGWVWLVVTGKAPMLPLWVMCLLIFIGTNGETYFNTVALVSCVQNFPKSRGPVVGILKGFAGLSGAILTQVYALIKTPDSASLIFMVAVGPTMVGISLMFIVRPVGGHRQLRLSDASSFSLIYCVCLILAAYLMGVMLVEDLIDLNHTIVQILTSILFVLIVVPIGIPLWLTFSSGSRTIEEEALLSEPQNKGQPESSHDPNEIIFSEIEDEKSSEVDLLPASERQKRILQLQSKLAQAAAEGAVRIKRRRGPHRGEDFDLTQALIKADFWLLFWTLLLGSGSGLTVIDNLGQMSESLGYDNAHIFVSMISIWNFLGRVGGGYVSEIVVRDYAYPRPVALAVAQGGMAIGHFIFAMGWPGAMYIGTLLIGLGYGAHWAIIPATASELFGVKKFGALYNFLTLANPGGSLVFSGLIASYIYDSEAEKQAQQRGDLIVKSTSLLTKLFDTDDAPKCSGSICFFLTYMIMSGLCIVAVILSLILVRRTKSVYQNLYGKTQT

SEQ ID NO: 10452 - protein, 560 aa, Flaveria ramosissima
VGYLFGSISPVIKSSLNYNQKQVARLGVAKDLGDSVGFLAGSMSEILPLWALLLVGAIQNFVGYGWVWLIVIGKAQELPLWVMCLLIFIGTNGETYFNTVALVSCVQNFPKSRGPIVGILKGFAGLSGAILTQIYALIKTPDQASIIFMVAVGPTMVAIALMFIVRPVGGHRQLRLSDASSFSLIYCVCLVLAAYLMGVMIVEDLVDLNQTIVQILTSILFVLLVVPIGIPLWLTFSSGPKTSEEEALLSEPQNKEQPESSHENEIIFSEVEDEKPTEVDLLPASERQKRILQLQSKLAQAAAEGAVRIKRRRGPHRGEDFDLTQALIKADFWLLFWTLLLGSGSGLTIIDNLGQMSESLGYDNTHIFVSMISIWNFLGRVGGGYVSEIVVRDHAYPRPVALAAAQGLMAIGHLFFAMGWPGAMYIGTLLIGLGYGAHWAIIPATASELFGVKKFGALYNFLTLANPGGSLVFSGLIASYIYDSEAEKQAQQRGELIIKSASFLTKLFETDDALKCTGSICYFLTCMIMSGLCIIALILSMILVHRTKTVYQHLYGKTRA

SEQ ID NO: 10453 - protein, 403 aa, Echinacea purpurea
MPTAISLSILFLLSITTTISAHNITRILAKHPEFSTFNHYLTITHLANEINRRQTITVCAVDNAAMSDLLSKGLSIQTVKNVLSLHVFADYFGTKKLHQVTKGSTSTATMYQATGEAPGTAGYVHITDIKGGKVRFTPEDNLSQTDSVYVKSILEMPYNISVIQISAILQSPEAEAPTAAPDLNLTSLLQRDGCQNFYDLLTTSGAIGTFLSSVESGVTVFCPDDDAVTAFAPKYKNLTASEKTSLLLYHAIPVYNSMGMLRSSNGLMNTLATEGAKKKYDFTVQNDGNDVKLKTKVVTATVSATVVDEEPIAIYTIDKVLQPRELFKGAVEEADEPAPAPKGAKNKKKATKKGDETEDDAEAPGPDSADDYSDDDAADQKASGGGRLVASVVMLCLSWLVFV

SEQ ID NO: 10454 - protein, 394 aa, Lactuca sativa
LLLLSISAAVHGHNITRILAKHPEFSTFNHYLTITHLANEINRRQTITVCAVDNAAMSSLLSKGLSIQTIKNVLSLHVFADYFGSKKLHQVTKGSTSTATMYQATGEAPGTAGYVHITDIKGGKVRFTPEDNPSQTDTTYVKSILEMPYNISVIQISAILQSPEAEAPTAAPDLNLTSLLQREGCQAFYDLLTTSGAIGTFLSSADGGVTVFCPGDDAIAAFAPKYKNLTASEKTSLLLYHGVPVYNSMGMLRSSNGLMNTLATEGAKKKYDFTVQNDGNDVTLKTKVVKATISGTVVDEEPIAIYTIDKVLLPRELFKGTVEEAEEPAPAPKAAKKKKKPAKKGDTEEEADAPGPDSSDDYSDDDAADQTASGGGRLVASAVMAFCFSWLAFV

SEQ ID NO: 10455 - protein, 402 aa, Chrysanthemum coronarium
MSPLSLAFLVILALTTTVQSHNITKILAKHPEFSTFNHYLTITHLANEINRRQTITVCAVDNAAMSDLLAKGLSIQTIKNVLSLHVFADYFGSKKLHQVTKGSTSTATMYQATGEAPGTAGYVHITDVKGGKVRFTPEDNPSQTDTTYVKSILEMPYNISVIQISAILNSPEAEAPTAAPDLNLTSLLQREGCQAFYDLLTTSGAIGTFLSSADGGVTVFCPSDDAITKFAPKYKNLTASEKTSLLLYHGVPVYNSMGMLRSSNGMMNTLATEGAKKKYDFDVQNDGNDVTLKTKVVTATISGTVVDEEPIAIYTLDKVLQPRELFKGTAVEADEPAAAPAPAKKKKKPAKKGAAADEDAAAPGPGDGDYSDDEAADSTNGGGRLVAPLMVMVACFSWLIFA

SEQ ID NO: 10456 - protein, 402 aa, Chrysanthemum coronarium
MSPLSLAFLVVLALTPTVQSHNITKILAKHPEFSTFNHYLTITHLANEINRRQTITVCAVDNAAMSDLLAKGLSIQTIKNVLSLHVFADYFGSKKLHQVTKGSTSTATMYQATGEAPGTAGYVHITDVKGGKVRFTPEDNPSQTDTTYVKSILEMPYNISVIQISAILNSPEAEAPTAAPDLNLTSLLQREGCQAFYDLLTTSGAIGTFLSSADGGVTVFCPSDDAITKFAPKYKNLTASEKTSLLLYHGVPVYNSMGMLRSSNGMMNTLATEGAKKKYDFDVQNDGNDVTLKTKVVTATISGTVVDEEPIAIYTLDKVLQPRELFKGTAVEADEPAAAPAPAKKKKKPAKKGAAADEDAAAPGPGDGDYSDDEAADSTNGGGRLVAPLMVMVACFSWLIFA

SEQ ID NO: 10457 - protein, 400 aa, Chrysanthemum coronarium
PLSLAFLVLLALSSTVQSHNITKILAKHPEFSTFNHYLTVTHLANEINRRQTITVCAVDNAAMSDLIAKGLSLQTIKNVLSLHVFADYFGSKKLHQVTKGSTSTATMYQATGEAPGTAGYVHITDVKGGKVRFTPEDNPSQTDTTYVKSILEMPYNISVIQISAILNSPEAEAPTAAPDLNLTSLLQREGCQAFYDLLTSSGAIGTFLSSADGGVTVFCPSDDAITKFAPKYKNLTASEKTSLLLYHGVPVYNSMGMLRSSNGMMNTLATEGAKKKYDFDVQNDGNDVTLKTKVVTATISGTVVDEEPIAIYTLDKVLQPRELFKGTAVEADEPAAAPAPAKKKKKPAKKGAAADEDAAAPGPGDGDYSDDEAADSTNGGGRLVAPMMVMVACFSWLIFA

SEQ ID NO: 10458 - protein, 352 aa, Ambrosia trifida
PEFSTFNHYLTITHLANEINRRQTITVCAVDNAAMSDLLSKGLSIQTIKNVLSLHVFADYFGSKKLHQVTKGSTSTATMYQATGEAPGTAGYVHITDIKGGKVRFTPEDNLKQTDSVYVKSILEMPYNISVIQISSVLQSPEAEAPTSAPDLNLTSLLDRDGCQSFHNLLTTSGAIGTFLSSVESGVTVFCPDDDAVAAFAPKYKNLTAPEKTSLLLYHGIPIYNSMGMLRSSNGLMNTLATEGAKKKYDFTVQNDGNDVKLKTKVVTATISGTVVDEEPIAIYTIDKVLQPKELFKGAVEEADEPAPAPKADEKEKKATKKGDEADEDAGAPGPGSDEDYSDDAADPTASD

SEQ ID NO: 10459 - protein, 403 aa, Chrysanthemum coronarium
MSPLSLAFLVLLALSSTVNSHNITKILAKHPEFSTFNHYLTVTHLANEINRRQTITVCAVDNAAMSDLIAKGLSLQTIKNVLSLHVFADYFGSKKLHQVTKGSTSTATMYQATGEAPGTAGYVHITDVKGGKVRFTPEDNPSQTDTTYVKSILEMPYNISVIQISAILNSPEAEAPTAAPDLNLTSLLQREGCQAFYDLLTSSGAIGTFLSSADGGVTVFCPTDDAITKFAPKYKNLTASEKTSLLLYHGVPVYNSMGMLRSSNGMMNTLATEGAKKKYDFDVQNDGNDVTLKTKVVTATISGTVVDDEPIAIYTIDKVLQPRELFKGTVVEADEPAAAPAPAKKKKKAAKKGAAADEDAAAPGPDGEGDYSDDETADSTNGGGRLVAPLMAMVACFSWLIFV

SEQ ID NO: 10460 - protein, 404 aa, Chrysanthemum coronarium
MSPLSLAFLVLLALSSTVNSHNITKILAKHPEFSTFNHYLTVTHLANEINRRQTITVCAVDNAAMSDLIAKGLSLQTIKNVLSLHVFADYFGSKKLHQVTKGSTSTATMYQATGEAPGTAGYVHITDVKGGKVRFTPEDNPSQTDTTYVKSILEMPYNISVIQISAILNSPEAEAPTAAPDLNLTSLLQREGCQAFYDLLTSSGAIGTFLSSADGGVTVFCPTDDAITKFAPKYKNLTASEKTSLLLYHGVPVYNSMGMLRSSNGMMNTLATEGAKKKYDFDVQNDGNDVTLKTKVVTATISGTVVDDEPIAIYTIDKVLQPRELFKGTAVEADEPAAAPAPAKKKKKAAKKGAAADEDAAAPGPDGEGDYSDDETADSTNGGGRLVAPLMAAMVACFSWLIFV

SEQ ID NO: 10461 - protein, 404 aa, Chrysanthemum coronarium
MSPLSLAFLVLLALSSTVQSHNITKILAKHPEFSTFNHYLTVTHLANEINRRQTITVCAVDNAAMSDLIAKGLSLQTIKNVLSLHVFADYFGSKKLHQVTKGSTSTATMYQATGEAPGTAGYVHITDVKGGKVRFTPEDNPSQTDTTYVKSILEMPYNISVIQISAILNSPEAEAPTAAPDLNLTSLLQREGCQAFYDLLTSSGAIGTFLSSADGGVTVFCPTDDAITKFAPKYKNLTASEKTSLLLYHGVPVYNSMGMLRSSNGMMNTLATEGAKKKYDFDVQNDGNDVTLKTKVVTATISGTVVDDEPIAIYTIDKVLQPRELFKGTVVEADEPAAAPAPAKKKKKAAKKGAAADEDAAAPGPDGEGDYSDDETADSTNGGGRLVAPLMAAMVACFSWLIFV

SEQ ID NO: 10462 - protein, 449 aa, Arnica chamissonis
MDQAELNSDQVLRRDIPWETYMTTKLITGTALQLLRRYDKKTENERAPLLENDGPSYIRVFVNILRDIQKEDTVEYVLALIDEMLTANPKRAKLFHDKSLEDEDIYEPFLRLLWKGSWFIQEKSSKILTLVVSARSKKNGLTANGEGTKKKITSSDDVLKGLVEWLCIQLKKPSHPHRSIPSSINCLATLLKEPVVRSSFVQADGLKLLVPLISPASTQQSIQLLYETCFCVWLLSYYEPAIEYLATSRALPRLLEVVKGSTKEKVVRLIVLTFKNLLSKGTFGAQMVNLGLPQIVQSLKGQAWSDEDLLDALNHMEEGLKDNIKKLSSFDKYKQEVLLGHLDWSPMHKDPNFWRDNITNFEENDFQTLRVLLTILETSSDPRALAVACFDLSQFIQYHPAGRVIVTDLKAKERVMKLMNHENAEVTKNALLCIQRLFLGAKYASFLQA

SEQ ID NO: 10463 - protein, 451 aa, Chrysanthemum coronarium
MDQAELNSDQVLRRDIQWETYMTTKLITGTSLQLLRRYDKKTETERASLLENDGPSYIRVFISILRDIQKEDTVEYVLALIDEMLTADPKRAKLFHDKSLADEDIYEPFLRLLWKGSWFIQEKSSKILTLVVSARPKQYGSSANGESADSKKKITASSDVLKGLVEWLCIQLKKPSHPSRSIPASVNCLSTLLKEPIVRSSFVQADGVKLLVPLIVPASTQQSIQLLYETCLCVWLLSYYEPAIEYLATSRALPRLLEVVKASTKEKVVRLIVLTFKNLLVKGTFGAQMVDLGLPQIVQSLKAQAWSDEDLLDALNNLEEALKDNIKRLSSFDKYKQEVLLGHLDWSPMHKDPNFWRENITAFEENDFQTLRVLLTILDTSSDPRALAVACYDLSQFIQYHPAGRVIVTDLKAKERVMKLMNHENAEVTKNALLCIQRLFLGAKYASFLQV

SEQ ID NO: 10464 - protein, 452 aa, Tabernaemontana elegans
MDHAELTTEQVLRRDIPWETYMTTKLITGTGLQLLRRYDKKTESYKAQLLDDDGPAYVRVFVSILRDIFKEETVEYVLALIDEMLTANPKRARLFHDKSLANEDTYEPFLRLLWKGNWFIQEKSCKILSLIVSARPKVQDGITANGGASDSKKTSTSIDDVLKGLVEWLCAQLKKPSHPIRGIPTAINCLATLLREPMVRSSFVQADGVKLLVPLISPASTQQSIQLLYETCLCVWLLSYYEPAVEYLATSRALPRLTEVVKGSTKEKVVRVVILTLRNLLQKGNFGAQMVDLGLLQVVQSLKAQAWSDEDLLEALNQLEEGLKDNIKKLSSFDKYKQEVLLGHLDWSPMHKDPVFWRENIKNFEENDFQILRVLLTILETSTDPRTLAVACFDLSQFIQNHPAGRVIVTDLKAKERVMKLMNHENTEVTKNALLCIQRLFLGAKYASFLQV

SEQ ID NO: 10465 - protein, 452 aa, Catharanthus roseus
MDHAELTTDQVLRRDIPWETYMTTKLITGTGLQLLRRYDKKAESYKAQLLDDDGPSYIRVFVSILRDIFKEETVEYVLALIDEMLTANPKRARLFHDKSLANEDTYEPFLRLLWKGNWFIQEKSCKILSLIVSARPKVQDGVTANGEASVSKKTSTSIDDVLKGLVEWLCAQLKKPSHPIRGIPSAINCLATLLREPMVRSSFVQADGVKLLVPLISPASTQQSIQLLYETCLCVWLLSYYEPAVEYLATSRALPRLTEVVKGSTKEKVVRVVILTLRNLLQRGNFGAQMVDLGLLQIVQSLKAQAWSDEDLLEALNQLEGGLKENIKKLSSFDKYKQEILLGHLDWSPMHKDPVFWRENINNFEENDFQILRVLLTILETSTDPRTLAVACFDLSQFIQIHPAGRVIVTDLKAKERVMKLMNHENSEVTKNALLCIQRLFLGAKYASFLQV

SEQ ID NO: 10466 - protein, 451 aa, Amsonia hubrichtii
MDHAEFTTEQVLRRDIPWETYMTTKLITGTGLQLLRRYDKKAESYKAQLLDDDGPAYVRVFVSILRDIFKEETVEYVLALIDEMLTANPKRARLFHDKSVASEDTYEPFLRLLWKGNWFIQEKSCKILSLIVSARPKLDGGITANGEASSKQKSTSIDDVLKGLVEWLCAQLKKPSHPIRGIPSAINCLATLLREPVVRSSFVQADGVKLLVPLISPASTQQSIQLLYETCLCVWLLSYYEPAVEYLATSRALPRLTEVVKGSTKEKVVRVVILTLKNLLQKGNFGPQMMDLGLLQIVQSLKAQAWSDEDLLESLNQLEEGLKENIKKLSSFDKYKQEVLLGHLDWSPMHKDPIFWRENITNFEENDFQILRVLLTILETSTDPRTLAVACFDLSQFIQNHPAGRVIMTDLKAKERVMKLMNHENTEVTKNALLCIQRLFLGAKYASFLQV

SEQ ID NO: 10467 - protein, 452 aa, Vitis vinifera
MDRAELTTDQVLKRDIPWETYMTTKLITGTCLQLLRRYDNRSESQRAVLLDDDGPAYVRVFVSILRDIFKEETVEYVLALIDEMLTANPKRAKLFHDKSLANEDTYEPFLRLLWKGNWFVQEKSCKILALIVSARPKTQDGVLSNGESSNSKKKFVTIDDVLRGLVEWLCAQLKKPSHPTRGIAIAISCLATLLKEPLVRSSFVQADGVKLLIPLISPASTQQSIQLLYETCLCVWLLSYYEPAIEYLATSRTLPRLVEVVKSSTKEKVVRVVVLTLKNLLSKGAFGAQMVDLGLLQIVQSLKAQAWSDEDLLEALNQLDEGLKANIKKLSSFDKYKQEVLLGHLDWTPVHKDPMFWRDNISNFEENDFQILRVLITILDTSSDPRALAVACFDLSQFIQYHPAGRVIVNDLKAKERVMKLMNHENAEVTKNSLLCIQRLFLGAKYASFLQA

SEQ ID NO: 10468 - protein, 452 aa, Rhizophora mangle
MDHAELTTEQVLKRDIPWETYMTTRLISGTDLQLLRRYDNRSEIYRAQLLDDDGPAYVRVFVSILRDIFKEETVEYVLALIDEMLTANPKRARLFHDKSLANEDPYEPFLRLLWKGNWFIQEKSCKTLASVVSARPKAHDGVLSNGEASNSKRKVTSIDDVLKGLVEWLCAQLRKLSHPSRAIPIAVNCLATLLKEPVVRSSFVQADGVKLLVPLISPATTQQSIQLLYETCLCVWLLSYYEPAIEYLATSRALPRLIEVVKTSTKEKVVRVIVLTFRNLLSKGTFGAQMVDFGLPQIVQSLKAQAWSDEDLLDALSQLEDGLRDNIKKLSSFDKYKQEVLLGQLDWSPMHKDPTFWRETITNFEDNDFQILRVLITILETSSDPRALAVACFDLSQFIQYHPAGRIIVTDLKAKERVMKLMNHENAEVTKNALLCIQRLFLGAKYASFLQA

SEQ ID NO: 10469 - protein, 158 aa, Platanus occidentalis
QAELTMEQVLKRDIPWETYMTTKLITGTCLQLLRRYDNRSESYRATLLDDDGPAYVRVFVNILRDIFKEETVEYVLALIDEMLTANPKRARLFHDKSLANEDTYEPFLRLLWKGNWFIQEKSCKILSLIVSARRNPRMVLLQMELHIQRTSLHPLTMC

SEQ ID NO: 10470 - protein, 452 aa, Vinca minor
MDHAELTSEQVLRRDIPWETYMTTKLITGTGLQLLRRYDKKSESYKAQLLDDDGPAYIIVLVSILRDIFKEETVEYVLALIDEMLTANPKRARLFHDKSLANEDTYEPFLRLLWKGNWFIQEKSCKILSLIVSARPKVQAGITANGEASVSKKTSTSIDDVLKGLVEWLCAQLKKPSHPVRGIPSAINCLATLLKQPMVRSSFVQADGVKLLVPLIIPASTQQSIQLLYETCLCVWLLSYYEPAVEYLATSRALPRLSDVVKGSTKEKVVRVVILTLRNLLQKGNFGPQMVDLGLLQIVQSLKAHAWSDEDLLEALDQLEGGLKDNIKKLSSFDKYKQEVLLGHLDWSPMHKDPIFWRENINNFEENDFQILRVLLTILETSTDPRTLAVACFDLSQFIQTHPAGRVIVTDLKAKERVMKLMNHENTEVTKNALLCIQRLFLGAKYASFLQV

SEQ ID NO: 10471 - protein, 129 aa, Manihot esculenta
MAQAELTTEQVLKRDIPWETYMATKLISGTDLQLLRRYDNRSESYRAQLLDDDGPAYVRVFVNILRDIFKEETVEYVLALVDEMLTANPKRARLFHDRSLANEDTYEPFLNCFGKVTGMYKKRAARFLL

SEQ ID NO: 10472 - protein, 127 aa, Citrus clementina
MDHAELTTEQVLKRDIPWETYMTTKLISGTGLQLLRRYDNRSESHRAQLLDDDGPSYVRVFVSILRDIYKEETVEYVLALIDEMLTANPKRARLFHDKSLASEDTYEPFLNCCGKVIGSYKKRAVRY

SEQ ID NO: 10473 - protein, 452 aa, Panax ginseng
MDQAELTSEQILKRDIPWESYMTTKLISGTGLQLLRRYDKKPESSKAQLLDDDGPAYVRVFFTILRDIFKEETVEYVLALIDEMLTGNPKRARLFHDKSVASEDTYEPFLRLLWNGNWFIQEKSCKILSLIISARLKTQDGVTMNGEASNSKKTFTTVDDVLKGLVEWLCAQLKQPSHPSRGIPTTISCLATLLKEPVVRSSFVKADWVKLLVPLISPASTQQSMQLLYETCLCVWLLSYYEPAIEYLATSRSLQRLIEVVKGSTKEKVVRVIVLTLKNLLSKGSFGAQMVDLGLPQVVQSLKAQAWSDEDLLEALNQLEEGLKEKIKKLSSFEKYKQEVLLGHLDWSPMHKDPIFWRDNITNFEENDFQILRVLITILDTSGDPRALSVACFDLSQFIQYHPAGRIIVTDLKAKERVMKLMNHENAEVTKNALLCIQRLFLGAKYASFLLA

SEQ ID NO: 10474 - protein, 452 aa, Prunus persica
MDHAELTTEQVLKRDIPWETYMTTKLITGTCLQLLRRYDKRSESHRSQLLDDDGPAYVQVFVGILRDIFKEETVEYVLALIDEMLAANPKRARLFHDGTIVDKDIYEPFLRLLWKGNWFIQEKSCKILALIVSARPKPQDGTVANGEASNSKRKITTIDDVLKGLVEWLCAQLKKPSHPSRGIPTAVNCLATLLKEPVVRSSFVQLDGVKLLVPLISPASTQQSIQLLYETCLCIWLLSYYEPAIEYLATSRTLPRLIEVVKSSTKEKVVRVVVLTLRNLLSKGTFGAQMVDLGLPQMVQSLKAQAWSDEDLLEGLNQLEEGLKDNIKKLSSFDKYKQEVLLGHLDWSPMHKDPIFWRENVTNFEENDFQILRVLITILDTSSDPRALAVACFDISQFVQQHPAGRIIVTDLKAKERVMKLMNHENAEVTKNALLCIQRLFLGAKYASFLQA

SEQ ID NO: 10475 - protein, 454 aa, Actinidia deliciosa
MPTEHAELTTEQVLRRDIPWETYMTTKLITGTGLQLLRRYDNRSESDRAALLDDDGPAYVHVFVSILCDIFKEETVEYVLALIDEMLTANPKRARLFYDKSLASEDTYEPFLRLLWKGNWFIQEKSCTILSMIVSARSKNQGGVTANGESSNSKKQLTTIDDVLKGLVEWLCVQLKNPSHPSRGIPTAITCLVTLLKEPVARSLFVQADGVKLLLPLISPASTQQSIQLLYETCLCVWLLSYYEPAIEYLATSRTLQRLIEVVKGSTKEKVVRVVILTLRNLLPKGTFGAQMVDLGLPQIVQSLKAQAWSDEDLLEALNQLEDGLKANIKKMSSFDKYKQEVLLGHLDWSPMHKDPIFWRENITKFEENDFQILRVLITILDTSGDPRALAVACFDLSQFIQYHPAGRVIVTDLKAKERVMKLMNHENPEVTKNALLCIQRLFLGAKYASFLQA

SEQ ID NO: 10476 - protein, 451 aa, Sesamum indicum
MDQAELSTEQVLRRDIPWETYMTTKLITGTGLQLLRRYDKKPENYKAQLLDDDGPAYVRVFVSILRDIFKEETVEYVLALIDEMLSANPKRARLFHDKSLKDEDVYEPFLRLLWKGNWFTQEKSCKILSLIVSGRPKSQDGAVANGASNSKKEITTINDVLKGLVEWLCTQLKKPSHPSRGVPTAINSLATLLKEPLVRSSFVQSDGVKLLIPLISPASTQQSIQLLYETCLCVWLLSYYEPAIEYLATSRSLPRLIEVVKGSTKEKVVRVVILTLRNLLHKGTFGAQMVDLGLPQLVQNLKAQAWSDEDLLESLNQLEEGLKVNIKKLSSFEKYKQEVLLGHLDWSPMHKDPVFWRENITNFEEHDFQILRVLITILDTASDPRTLAVACYDISQFIQYHPAGRIIVTDLKAKERVMKLMNHENAEVTKNALLCIQRLFLGAKYASFLQA

SEQ ID NO: 10477 - protein, 453 aa, Triphysaria pusilla
MPTDQAELSTDQVLRRDIPWETYMTTKLITGTGLQLLRRYDKKPENYKAQLLDDDGPAYIRVFVSILRDIFKEETVEYVLALIDETLSANPKRARLFHDKSLTDVDTYEPFLRLLWKGNWFIQEKSCKILSLIVSGRPKSHDSVSANGESNSKKEITTINDVLKGLVEWLCGQLKNPSHPSRGIPSAINCLATLLKEPVVRSSFVEADGVKLLIPLISPASTQQSIQLLYETCLCVWLLSYYEPAIEYLATSRSLPRLIEVVKGSTKEKVVRVVILTLKNLLHKGTFGAQMVPLGLPQLVQNLKAQAWSDEDLLESLNQLEEGLKDNIKQLSSFDKYKQEVLLGHLDWSPMHKDPIFWRDNTTNFEEHDFQILRVLITILDTSSDPRTLAVACYDLSQFVQYHPAGRIIVTDLKAKERVMKLMNHENPEVTKNALLCIQRLFLGAKYASFLQA

SEQ ID NO: 10478 - protein, 452 aa, Vinca minor
MDHAELTTDEVLRRDIPWETYMTTKLITGTGLQLLRRYDKKAESYKAQLLDDDGPAYIHVFVSILRDIFKEETVEYVLALIDEMLTANPKRARLFHDKSLANEDTYEPFLRLLWKGNWFIQEKGCKILSLIVSARPKFQDGITANGEASVSKKTSTSIDDVLKGLVEWLCSQLKKPSHPVRGIPSAINCLATLLREPTVRSSFVQADGVKLLVPLITPASTQQSIQLLYETCLCVWLLSYYEPAVEYLATSRALPRLTEVVKGSTKEKVVRVAILTLRNLLQKGNFGPQMVDVGLLQIVQSLKAQAWSDEDLLEALDQLEGGLKDNIKKLSSFDKYKQEILLGHLDWSPMHKDPIFWRENINNFEENDFQILRVLLTILETSTDPRTLAVACFDLSQFIQTHPAGRVIVTDLKAKERVMKLMNHENTEVTKNALLCIQRLFLGAKYSSFLQV

SEQ ID NO: 10479 - protein, 452 aa, Euonymus alatus
MDQAELTTEQVLRRDIPWEAYMTTKLISGTGLQLLRRYDKKPESYKAQLLEDDGPAYVRVFVSILRDIFKEETVEYVLALIDGMLTANPKRARLFHDKSLTDEDTYEPFLRLLWKGNWFIQEKSCKILALIVSARPKNHGGAVSNGEVASSKSKVTSINDVLKGLVEWLCVQLKKPSHPSRGIPAAINCLATLLKEPIVRSSFVQADGVKLLIPFISPASTQQSIQLLYETCLCIWLLSYYEPAIEYLATSRTLPRLLEVVKSSTKEKVVRVVVLIFRNVLHKGTFGAQMVDLGLPQIVQSLKTQAWSDEDLLETLNQLEEGLKDNIKKLSSFDKYKQEVLLGHLDWSPMHKDPIFWRENITNFEENDFQILRVLITILDTSSDPRALAVSCFDLSQFVQHHAAGRVILTDLKVKERVMKLMNHENAEVTKNALLCIQRLFLGAKYASFLQA

SEQ ID NO: 10480 - protein, 450 aa, Olea europaea
MDQSDLTTEQVLRRDIPWETYMNTKLITGTGLQLLRRYDKKPENYKAQLLDDDGPSYIRVLVSILRDIFKEETVEYVLALIDEMLTANSKRARLFHDTSLANEDTYEPFLRLLWKGNWFIQEKSCKILSLIVSGRPKAQDALIANGASKSKEFTTIDDVLKGLVEWLCAQLKKPSHPSRGIPTAINCLATLLKEPVVRSSFVQSDGVKLLVPLISPASTQQSIQLLYETCLCVWLLSYYEPAIEYLGTSRSLPRLIEVVKGSTKEKVVRVVVLTLRNLLQKGTYGALMIDLGLPQLVQSLKAQAWSDEDLLEALTQLEEGLKDNIKKLSSFDKYKQEVLLGHLDWSPMHKDPIFWRENITNFEENDFQILRVLITILDTSTNPRTLAVACFDISQFIQYHPAGRIIVTDLKAKERVMKLLNHENAEVTKNALLCIQRLFLGAKYASFLQA

SEQ ID NO: 10481 - protein, 452 aa, Populus trichocarpa
MEQAELTTEQVLKRDIPWETYMMTKLISGTDLQLLRRYDNRPESYRAQLLDDDGPAYVRVFVTILRDIFKEETVEYVLALIDEMLAANPKRARLFHDKSLANDDPYEPFLRLLWKGNWFIQEKSCKILALIVSARPKTQDGLLSNGEASNSKSKITCIDDVLKGLVEWLCAQLKKPSHPSRSIPTAISCLATLLKEPVVRSLFVRLDGVKLLIPSICPASTQQSIQLLYETSLCVWLLSYYEPAIEYLATSRTLPRLVDVVKSSTKEKVVRVVVLTFKNLLSKGAFGAQMVDLGLPQIVQNLKAQAWSDEDLLEALNQLEEGLKDNIKKLSSFDKYKQEVLLGHLDWSPMHKDPAFWRENITNFEENDFQILRVLITILDTSNDPRALAVACFDLSQFIQHHPAGRVIVTDLKTKERVMKLMNHENAEVTKNALLCIQRLFLGAKYASFLQV

SEQ ID NO: 10482 - protein, 454 aa, Solanum tuberosum
  Sequence also found in Organisms: Solanum phureja
MTTENAELTTEEVLRRDIPWETYMTTKLITGTGLQLLRRYDKKAESYKAQLLDDDGPGYVRVFVTILRDIFKEETVEYVLALIDEMLTANPKRARLFHDESLADEDTYEPFLRLLWKGNWFIQEKSCKILSLTVSARSKVQNGADANGDASSSKKKITTIDDVLAGVVEWLCAQLKKPTHPTRSIPSTINCLSTLLKEPVVRSSFVRADGVKLLVPLISPASTQQSIQLLYETCLCVWLLSYYEPAIEYLATSRALPRLIEVVKGSTKEKVVRVVILTLRNLLSKGTFSAHMVDLGVLQIVQSLKAQAWSDEDLLDALNQLEQGLKENIKKLSSFDKYKQEVLLGHLDWSPMHKDPIFWRENINNFEENDFQILRVLITILDTSSDARTLAVACYDLSQFIQCHSAGRIIVNDLKAKERVMRLLNHENAEVTKNALLCIQRLFLGAKYASFLQA

SEQ ID NO: 10483 - protein, 451 aa, Fragaria vesca
MDHAELTTEQVLKRDIPWEQYMTTKLITGTCLQLLRRYDKRSETYRSQLLDDDGPAYVQVFVGILRDIFKEETVEYVLALIDELLTANPKRARLFHDTSLVDKDVYEPFLRLLWKGNWFIQEKSCKILGLIVSARTKPQGTVANGEASNSKSKITSIDDVLKGLVEWLCAQLKKPSHPSRGIPTAISCLATLLKEPVVRSSFVQADGVKLLVPLISPASTQQSMQLLYETCLCVWLLSYYEPAIEYLATSRTLPRLIEVIRSSTKEKVVRVVVLTLRNLLSKGTFGAQMVDLGLPQIVQSLKAQAWSDEDLLEGLNQLEEGLKDNIKKLSSFDKYKQEVLLGHLDWSPMHKDAIFWRENITNFEENDFQILRVLITILDTSSDPRALAVACFDISQFVQHHPAGRIIVTDLKAKERVMKLMNHESAEVTKNALLCIQRLFLGAKYASFLQA

SEQ ID NO: 10484 - protein, 459 aa, Theobroma cacao
MDHAELNTEQVLKRDIPWETYMTTKLISGTGLQLLRRYDNRAESYRAQLLDDDGPAYVRVFVSILRDIFKEETVEYVLALIDEMLTANPKRARLFHDKSLANEDTYEPFLKSEEYKHVLLWKGNWFIQEKSCKILALIVSARPKTQDGVVANGEASNSKKKFTTIDDVLKGLVEWLCTQLRKPSHPSRGIPTAINCLASLLKEPVVRSSFVQADGVKLLIPLISPASTQQSIQLLYETCLCLWLLSYYEPALEYLATSRTLPRLVDVVKSSTKEKVVRVIILTFRNLLSKGTFGAQMVDLGLPQIVQSLKAQAWSDEDLLEALNQLEDGLKDNIKKLSSFDKYKQEVLLGHLDWSPMHKDPLFWRDNITCFEENDFQILRVLITIMDSSNDSRALAVACFDLSQFIQHHPAGRVIVTDLKAKERVMKLMNHESAEVTKNALLCIQRLFLGAKYASFLQV

SEQ ID NO: 10485 - protein, 452 aa, Euphorbia peplus
MDQAELSTEQVLKRDIPWETYTITKLISGTDLQLLRRYDNQSESHRAQLLDDDGPAYVRVFVSILRDIFKEETVEYVLALVDELLTGNPKRAKFFHDQSLTNEDTYEPFLRLLWKGNWFIQEKSCKILALIVSARPKNQDGITANGEASNSKSKVTTIDDVLKGLVEWLCAQLKKPSHPSRGVPTAISCLSTLLKEPVVRSSFVKADGVKLLIPLITPASTQQSIQLLYETCLCVWLLSYYEPAIEYLATSRTLPRLADVVKSSTKEKVVRVIVLTFRNLLARGTFGAQMVDIGLPQIVQNLKSQAWSDEDLLEALNQLEEGLRDNIKKLSSFDKYKQEVLLGHLDWTPMHKDPTFWRENIKFFEENDFQILRVLITILDTSSDPRAMAVACFDLSQFIQIHPAGRIIVTDLKAKERVMKLMNHENAEVTKNALLCIQRLFLGAKYASFLQA

SEQ ID NO: 10486 - protein, 452 aa, Panax ginseng
MDQAELTSEQILKRDIPWESYMTTKLISGTGLQLLRRYDKKPESSKAQLLDDDGPAYVRVFFTILRDIFKEETVEYVLALIDEMLTGNPKRARLFHDKSVASEDTYEPFLRLLWNGNWFIQEKSCKILSLIISARLKTQDGVTMNGEASNSKKTFTTVDDVLKGLVEWLCAQLKQPSHPSRGIPTAISCLATLLKEPVVRSSFVKADGVKLLVPLISPASTQQSMQVLYETCLSVWLLSYYEPAIEYLATSRSLQRLIEVVKVSTKEKVVRVIVLTLKNLLSKGSFGAQMVDLGLPQVVQSLKAQAWSDEDLLEALNQLEEGLKEKIKKLSSFEKYKHEVLLGHLDWSPMHKDPIFWRDNITNFEDNDFQILRVLVTILDTSGDPRALSVACFDLSQFIQYHPAGRIIVTDLKAKERVMKLMNHENAEVTKNALLCIQRLFLGAKYASFLLA

SEQ ID NO: 10487 - protein, 465 aa, Tropaeolum majus
MAQAELTTEQVLKRDIPWETYMTTKLISGTGLQLLRRYDNRSGSQRAQLLEDDGPAYVRVFVSIIRDILKEETVEYVLALIDELLTENPNRARFFHDKSLASEDTYEPFLRLLWKGNWFLQEKSCKILALIVSARPKAQDNVVANGESSNSKSKFTTIDDVLKGLVEWLCAQLKKPSHPTRAVPTAINCLAALLKEPVVRSSFVQADGVKLLVILISPASTQQSIQILYETCLCVWLLSYYEPAVEYLATSRTLQRLVEVVKSSTKEKVVRVVILTLRNLLPKGTFGAQMVDLGLPQIVQNLKTQAWSDEDLLDALNQLEEGLRDNIKKLSSFDKYKQEVLLGHLDWTPMHKDAIFWRDNITNFEESDFQVLRVLITILDTSSDPRALAVACFDLSQFVQHHPAGRVIVTDLKAKERVMKLMNHENAEVTKNALLCIQRLFLGAKYASFCKFDLMNKIYAILDGC

SEQ ID NO: 10488 - protein, 284 aa, Panax ginseng
MGQAELTSEQILKRDIPWESYMTTKLISGTGLQLLRRYDKKPESSKAQLLDDDGPAYVRVFFTILRDIFKEETVEYVLALIDEMLTGNPKRARLFHDKSVASEDTYEPFLRLLWNGNWFIQEKSCKILSLIISARLKTQDGVTMNGESSNSKKTFTTVDDVMKGLVEWLCAQLKQPSHPSRGIPTTISCLATLLKEPVVRSSFVKADWVKLLVPLISPASTQQSMQLLYETCLCVWLLSYYEPAIEYLATSRSLQRLIEVVKGSTKEKVSPGDCLDTQKPAFQR

SEQ ID NO: 10489 - protein, 452 aa, Castanea mollissima
MDQAELNTEQVLKRDIPWETYMTTKLISGTSLQLLRRYDNRPESYRAQLLDDDGPAYVRVFVSILRDIYKEETVEYVLALVDEMLTANPKRARLFHDKSLASEDTYEPFLRLLWKGNWFIQEKSCKIVALIVSARPKIQDGNIANGEASNSKKKSTSIDDVLQGLVDWLCEQLKKPSHPSRGVPTAISCLATLLKEPMVRSSFVQADGVKLLVPLISPASTQQSIQLLYETCLCVWLLSYYEPAVEYLATSRALPRLIDVVKSSTKEKVVRVVVLTLRNLLSKAAFGAQMIDLGLPQIVQSLKAQAWSDEDLLEALNQLEEGLKDKIKKLSSFDKYKQEVLLGQLDWSPMHKDNLFWRDNIKNFEENDFQILRVLITILDTSNDPRTLAVACYDLSQFIQHHPAGRIIVTDLKAKERVMKLMNHENPEVTKNALLCIQRLFLGAKYASFLQV

SEQ ID NO: 10490 - protein, 452 aa, Vaccinium corymbosum
MDHAELSMEQVLKRDIPWETYMTTKLITGTGLQLLRRYDNRSESQRAVLLDDDGPAYVRVFVSILRDIFKEETVEYVLALIDEMLTANPKRARLFHDKSLASEDIYEPFLRLLWKGNWFIQEKSCKILSMIVSGRPENQERVTSNGEASNSKSQMTATDDVLKGLVEWLCAQLKKPSHPSRAVPTSINCLATLLKEPMVRSLFVQADGVKLLIPLISPASTQQSMQLLYETCLCLWLLSYYEPAIDYFATTRGLARLIEVVKGSTKEKVVRVVVLTLRNLLPKGTFGAQMVDLGLPQIVQSLKAQAWSDEDLLEALNQLEDGLKDNIKKMSSFDKYKQEVLLGHLDWSPMHKDPIFWRENITKFEENDFQILRVLITILDTSRDPRAIAVACFDLSQFIQCHPAGRVIVTDLKAKDRVMKLMNHENAEVTKNALLCIQRLFLGAKYASFLQV

SEQ ID NO: 10491 - protein, 452 aa, Gossypium raimondii
MERAELTTEQVLKRDIPWETYMTTKLISGTGLQLLRRFDNRAESVRAQLLDDDGPAYVQVFVSILRDIFKEETVEYVLALIDEMLTANPKRARLFHDKSLANEDTYEPFLRLLWKGNWFIQEKSCKILALIVSARPKTQNGVVANGEASNSKTKLTTIDDVLRGLVEWLCTQLKKPYHPSRGIPTAINCLAALLKEPVVRSSFVQADGVKLLIPLICPASTQQSIQLLYETCLCVWLLSYYEPVIEYLATSRALPRLVDVVRSSTKEKVVRVVVLTFRNLLSKGTCGAQMVDLGLPQIIQSLKAQAWSDEDLLEALNQLEDGLKDNIKKLSSFDKYKQEVLLGHLDWSPMHKDPLFWRDNITCFEENDFQILRVLITIMDSSNDPRPLAVACFDISQFIQHHPAGRVIVNDLKAKERVMKLMNHESAEVTKNALLCIQRLFLGAKYASFLQV

SEQ ID NO: 10492 - protein, 454 aa, Momordica charantia
MAIDQGELTTEQVLTRDIPWETYMTTKLISGTSLQLLRRYDNRQESYRAQLLDDDGPAYVRVFVSILRDIFKEETVEYVLALIDEMLTANPKRARLFHDHSLANEDAYEPFLRLLWKGNWFVQEKSCKILALIVSARKQNHDGSFSNGDASNSKRQITAIDDVLDGLVKWLCAQLKNPSHPSRAVQTSINCLATLLKEPKVRSSFVQADGVKLLIPLISPASTQQSIQLLYETCLCVWLLSYYEPAIEFLATSRTLPRLIEVVKSSTKEKVVRVVILTLRNLLHKGTFGAQMVGLGLPQIVQSLKSQAWSDEDLLEALNQLEEGLKDNIKKLSSFDKYKQEVLLGHLDWSPMHKDVNFWRENITSFEENDFKILRVLITILDTSSDPRALAVACFDISQFIQHHPAGRVIVTDLKAKERVMKLMNHEHAEVTKYALLCIQRLFLGAKYASFLQA

SEQ ID NO: 10493 - protein, 452 aa, Carica papaya
MDHAELSTEQVLKRDIPWETYMTTKLISGTGLQLLRRYDNRSESYRAQLLDDDGPAYVKVFVSILRDIFKEETVEYVLALMDEMLTANPKRARLFHDKSLANEDTYEPFLRLLWKGNWFIQEKSCKILSLIVSARPRALDGVIANGEASNSKKNITCIGDVLKGLVEWLCAQLKNPSHPTRGVPTAVNCLAALLKEPVVRSSFVRADGVKLLIPLISPASTQQSIQLLYETCLCIWLLSYYEPAIEFLATSRALQRLVEVVKSSTKEKVVRVIVLTLRNLLPKGTFGAQMVDLSLPQIVQSLKTQAWSDEDLLEALNQLEEGLKDNIKKLSSFDKYKQEVLLGHLDWTPVHKDPLFWRDNITSFEENDFQILRVLITILDTSNDPRSLAVACYDLSQFIQYHPAGRIIVTDLKAKERAMKLMNHENAEVTKNALLCIQRLFLGSKYASFLQA

SEQ ID NO: 10494 - protein, 452 aa, Lippia dulcis
MPTDQAELSTEQVLRRDIPWETYMTTKLINGTGLQLLRRYDKKAEKDKAQLLDDDGPAYVRVFVSILRDIFKEETVEYVLALIDEMVSANPSRARLFHDHSLGDEDIYEPFLRLLWKGNWFIQEKSCKILSLILSGRPKTHESATAGASNSKKERSTVDDVLKGLVEWLCTQLKKPSHPSKGIPTAISCLATLLKESVVRSSFVQADGVKLVIPLISPASTQQSIQLLYETCLCVWLLSYYEPAHEYLATSRSLPRLIEVVKGSTKEKVVRVVVLTLRNLLHKGTFGAQMVDLGLPQLVQSLKAQAWSDEDLLEALNQLEEGMKVNIKKLSSFDKYKQEVLLGQLDWSPMHKDPIFWRENITSFEEHDFQILRVLITILETSTDSRTLAVACYDLSQFIQCHPAGRVIVNDLKAKERVMKLMNHENAEVTKNALLCIQRLFLGAKYASFLQV

SEQ ID NO: 10495 - protein, 109 aa, Orobanche aegyptiaca
MDQAELSTDQVLRRDIPWETYMTTKLIRGTGLQLLRRYDKKPENYKAQLLDDDGPAYIRVFVSILRDIFKEETVEYVLALIDEMLSANPKEQDYFMIRLLLMKIHTSLS

SEQ ID NO: 10496 - protein, 450 aa, Eschscholzia californica
MDQAELTTENVLKRDIPWETYMNTKLITGTCLQLLRRYDNKSESYRASLLDDDGSAYIRVFVNLLRDVFKEDTVEYVLALIDEMLTANPKRARLFHDKSLADEDTYEPFLRLLWKGNWFIQEKSCKILSLIVSARPKGKNGVTANGESSKSKSTSIDDVLKGLVEWLCAQLKKPSHPSRGIPTSISCLSNLLKEPLVRSSFVQVDGVKLLIPLISPASTQQSIQLLYETCLCIWLLSYYEPAIEYLATSRALPRLVEVVKGSTKEKVVRVVVLTFKNLLGKGTFGAEMVDLGLPQIVQSLKGQAWSDEDLLEALNQLEDGLKDNIKKMSSFDKYKQEILLGHLDWSPMHKDPIFWRENITNFEENNFQILRVLITILETSGDSKSLAVACYDLSQFIQYHSSGRLIMNDLKAKERVMKLMNHDNSEVTKNALLCIQRLFLGAKYASFLQA

SEQ ID NO: 10497 - protein, 452 aa, Cajanus cajan
MDQAELTSEQVLRRDIPWETYMSTKLISGTSLQLLRRYDHRPESHKAQLLDDDGPSYVRVFVRVLRDIFKEDTVEYVLALIDEMLAANPKRARLFHDSALADEDTYEPFLRLLWKGNWFIQEKSCKILALIVSVRPKSQNGTVSNGEASNGKKSLTTIDDVLIGLVKWLCEQLKKPSHPIRGVPTAINCLATLLKEPVVRSSFVQADGVKLLVPLISPASTQQSIQLLYETCLCIWLLSYYEPAIEYLATSRTLPRLIDVVKSSTKEKVVRVVVLTLKNLMSKGTLGAQMVDLQLPQVVQSLKAQAWSDEDLLEALNSLEEGLKDNIKKLSSFDKYKQEVLLGHLDWSPMHKDPIFWRENITNFEESDFQILRVLITILDTSNDPRSLAVACFDLSQFIQIHPAGRIIVTDLKAKERVMKLMNHENAEVTKNALLCIQRLLLGAKYASFLQV

SEQ ID NO: 10498 - protein, 452 aa, Gossypium hirsutum
MERAELTTEQVLKRDIPWETYMTTKLISGTGLQLLRRFDNRAESVRAQLLDDDGPAYVQVFVSILRDIFKEETVEYVLALIDEMLTANPKRARLFHDKSLANEDTYEPFLRLLWKGNWFIQEKSCKILALIVSARPKTQNGVVANGEASNSKTKLTTIDAVLRGLVEWLCTQLKKPYHPSRGIPTAINCLAALLKEPVVRSSFVQADGVKLLIPLICPASTQQSIQLLYETCLCVWLLSYYEPVIEYLATSRALPRLVDVVRSSTKEKVVRVVVLTFRNLLSKGTCGAQMVDLGLPQIIQSLKAQAWSDEDLLEALNQLEDGLKDNIKKLSSFDKYKQEVLLGHLDWSPMHKDPLFWRDNITCFEENDFQILRVLITIMDSSNDPRPLAVACFDISQFIQHHPAGRVIVNDLKAKERVMKLMNHESAEVTKNALLCIQRLFLGAKYASFLQV

SEQ ID NO: 10499 - protein, 454 aa, Cucumis sativus
MAIDQAELSTEQVLRRDIPWETYMTTKLISGTSLQLLRRYDNRPESYRAQLLDDDGPAYVRVFVSILRDIFKEETVEYVLALIDEMLTANPKRARLFHDPSLASEDAYEPFLRLLWKGNWFIQEKSCKILALIVSARPKTHDGSFANDDSSNSKNKNTTIDDVLDGLVKWLCAQLKNPSHPSRAVQTSINCLATLLKEPKVRSSFVQTDGVKLLIPLISPASTQQSIQLLYETCLCVWLLSYYEPAIEFLATSRTLPRLIDVVKSSTKEKVVRVIILTLRNLLHKGTFGAQMVGLGLPQVVQSLKSQAWSDEDLLEALNQLEEGLKDNIKKLSSFDKYKQEVLLGHLDWSPMHKDVNFWRENITSFEENDLKILRVLITILDSSTDPRALAVACFDLSQFIQHHPAGRVIVTDLKAKERVMKLMNHENAEVTKYALLCIQRLFLGAKYASFLQA

SEQ ID NO: 10500 - protein, 452 aa, Humulus lupulus
MDHAELSTEQVLKRDIPWETYMTTKLITGTCLQLLRRYDNRSESYRAQLLDDDGPAYVRVFVSILRDIHKEETVEYVLALIDEMLAANPKRARLFHDSSLSGADTYNPFLRLLWDGNWFAQEKSCKILASIVSARPKSHDGIIANGGASNSKRTTATIDDVLKGLVDWLCAQLKRPSHPSRGIPIAVNCLATLLKEPVVRSSFVQADGVKLLVPLITPASTQQSIQLLYETCLCVWLLSYYEPAIEYLATSRTLPRLIDVVKSSTKEKVVRVVVLTIRNLLSKGTFGAQMVDLGLPQIVQSLKAQAWSDEDLLDALNQLDEGLKDKIKKLSSFDKYKQEVLLGHLDWSPMHKDAAFWRENITNFEESDFQILRVLITILDTSSDPRALAVACFDLSQFIQHHAAGRIIVTDLKAKERVMKLMNHENAEVTKNALLCIQRLFLGAKYASFLQV

SEQ ID NO: 10501 - protein, 454 aa, Cucumis melo
MAIDQAELSTEQVLTRDIPWETYMSTKLISGTSLQLLRRYDNRPESYRAQLLDDDGPAYVRVFVSILRDIFKEETVEYVLALIDEMLTANPKRARLFHDPSLASEDAYEPFLRLLWKGNWFIQEKSCKILALIVSARPKTHDGSFANDDASNSKNKNTTIDDVLDGLVKWLCAQLKNPSHPSRAVQTSINCLATLLKEPKVRSSFVQTDGVKLLIPLISPASTQQSIQLLYETCLCVWLLSYYEPAIEFLATSRTLPRLIDVVKSSTKEKVVRVIILTLRNLLHKGTFGAQMVGLGLPQIVQSLKSQAWSDEDLLEALNQLEEGLKDNIKKLSSFDKYKQEVLLGHLDWSPMHKDVNFWRENIMSFEENDLKILRVLITILDSSSDPRALAVACFDLSQFIQHHPAGRVIVTDLKAKERVMKLMNHENAEVTKYALLCIQRLFLGAKYASFLQA

SEQ ID NO: 10502 - protein, 451 aa, Triphysaria pusilla
MDQAELSADQVLRRDIPWETYMTTKLITGTGLQLLRRYDKKPENYKAQLLDDDGPAYIHVFVSILRDIFKEDTVEYVLALIDEMLSANPKRARLFHDNSLTDEDIYEPFLRLLWKGNWFIQEKSCKILSLIVSGRPKSQDRPLANGVSNSGKKITNINDVLKGQVEWLCTQLRNPSHPSRGIPSAINCLATLLKEPVVRSSFVQADGVKLLIPLISPASTQQSIQLLYETCICVWLLSYYEPVIEYLATSRLLPRLIEVVKGSTKEKVVRVVILTLKNLLHKGTFGAQMVPLGLPQLVQNLKGQAWSDEDLLESLNQLEEGLKDNIKQLSSFDKYKQEVLLGHLDWSPMHKDPIFWRDNITNFEEHDFQILRVLITILDTSSDPRTLGVACYDLSQFVQYHPAGRIIVTDLKAKERVMKLMNHENAEVTKNALLCIQRLFLGAKYASFLQP

SEQ ID NO: 10503 - protein, 452 aa, Tripterygium wilfordii
MDQAELTTEQVLRRDIPWEAYMTTKLISGTGLQLLRRYDKKPESYKAQLLEDDGPAYVRVFVSILRDIFKEETVEYVLALIDEMLTANPKRARLFHEKSLANEDTYEPFLRLLWKGNWFVQENSCKILALIVSARPKHHGGAVSNGEVASSKSKVTSIDDVLKGLVEWLCVQLKNPSHPIRGIPAAINCLATLLKEPIVRSSFVQADGVKLLIPFISPASTQQSIQLLYETCLCIWLLSYYEPAFEYLATSRTLPRLLEVVKSSTKEKVVRVVVLTFRNLLHKGTFGAQMVDLGLPQIVQSLKTQAWSDEDLLEALNQLEEGLRDNIKKLSSFDKYKQEVLLGHLDWSPMHKDPMFWRENIKIFEENDFQILRVLITILDTSSDPRALAVACFDLSRFVQHHPAGRVILTDLRAKERVMKLMNHENAEVTKNALVCIQRLFLGAKYASFLQG

SEQ ID NO: 10504 - protein, 454 aa, Capsicum annuum
MTMENSELTTEQVLRRDIPWETYMTTKLITGTGFQLLRRYDKKAESYKAQLLDDDGPGYVRVFVTILRDIFKEETVEYVLALIDEMLTANPKRARLFHHDSLADEDTYEPFLRLLWKGNWFIQEKSCKILSLIASARSKGQNGVDANGDASSSKKKHTTIDDVLAGLVEWLCAQLKKPTHPTRSIPSTINCLSTLLKEPVVRSSFVRADGVKLLVPLISPASTQQSIQLLYETCLCVWLLSYYEPAIDYLATSRALPRLIEVVKGSTKEKVVRVVILTLRNLLSKGTFSAQMVDLGVLQIVQSLKAQAWSDEDLLDALNQLEQGLKENIKKLSSFDKYKQEVLLGHLDWSPMHKDPIFWRENINNFEENDFQILRVLITILDTSTDARTLAVACYDLSQFIQCHSAGRIIVNDLKAKERVMKLLNHQNAEVTKNALLCIQRLFLGAKYASFLQV

SEQ ID NO: 10505 - protein, 454 aa, Solanum lycopersicum
MTTESVELTTEEVLRRDIPWETYMTTKLITGTGLQLLRRYDKKAESYKAQLLDDDGPGYVRVFVTILRDIFKEETVEYVLALIDEMLTANPKRARLFHDESLADEDTYEPFLRLLWKGNWFIQEKSCKILSLTVSARSKVQNGADANGDASSSKKKITTIDDVLAGVVEWLCAQLRKPTHPTRSIASTINCLSTLLKEPVVRSSFVRADGVKLLVPLISPASTQQSIQLLYETCLCVWLLSYYEPAIEYLATSRALNRLIEVVKGSTKEKVVRVVILTLRNLLSKGTFSAHMVDLGVLQIVQSLKAQAWSDEDLLDALNQLEQGLKENIKKLSSFDKYKQEVLLGHLDWSPMHKDPIFWRENINNFEENDFQILRVLITILDTSSDARTLAVACYDLSQFIQCHSAGRIIVNDLKAKERVMRLLNHDNAEVTKNALLCIQRLFLGAKYASFLQA

SEQ ID NO: 10506 - protein, 135 aa, Aquilegia formosa
MDQHATAAELNTDQVLKRDIPWETYMTTKLITGTCLQLLRRYDNRSQTYRAALLDDDGPAYVGVFVNILRDIFKEETVEYVLALIDEMLTANPKQATLFHDQSLADEDIYEPFLNCCGKATGSYKRRAVRYCQWL

SEQ ID NO: 10507 - protein, 271 aa, Panax ginseng
MDQAELTSEQILKRDIPWESYMTTKLISGTGLQLLRRYDKKPESSKAQLLDDDGPAYVRVFFTILRDIFKEETVEYVLALIDEMLTGNPKRARLFHDKSVAGEDPYEPFLRLLWKGNWFIQEKFCKILSLIVSSRPKTQDVVIMNGEASNSNKKVTSIDDVLKGLVEWLCTQLKQPSHPSRGIPTAINCLTTLLKEPAVRSSFVQADGVKLLVPLISPASTQQSVQLLYETCLCVWLLSYYEPAIDYFATSRSLPRLIEVVKGSKRKRLSG

SEQ ID NO: 10508 - protein, 165 aa, Quercus alba
MDQAELNTEQVLKRDIPWETYMTTKLISGTSLQLLRRYDNRPESYRAQLLDDDGPAYVRVFVSILRDIYKEETVEYVLALVDEMLTANPKRARLFHDKSLASEDTYEPFLRLLWKGNWFIQEKSCKIVALIVSARPKIQDGIIANGEASNSKKNPLLLMMYCKHW

SEQ ID NO: 10509 - protein, 452 aa, Ricinus communis
MDQAELTTEQVLKRDIPWETYMMTKLISGTDLQLLRRYDNRSESQRAQLLDDDGPAYVRVFVNILRDIFKDETVEYVLALIDEMLAANPKRARLFHDKSLTNEDTYEPFLRLLWKGNWYIQEKSCKILALIISDRPKTQDGTIANGEASNSKRKGTTISDVLKGLVEWLCAQLKKPSHPSRGVPSAISCLATLLKEPVVRSSFVQADGVKLLIPLISPASTQQSMQLLYETCLCVWLLSYYEPAIEYLATSRTLPRLIDVVKSSTKEKVVRVIVLTFKNLLSRGTFGAQMVDLGLPQVVQSLKTRAWSDEDLLEALNQLEEGLRDNIKKLSSFDKYKQEVLLGHLDWTPMHKDPIFWRENLNNFEENDFQILRVLITILDTSNDSRALAVACFDLSQFIQNHPAGRIIVTDLKAKERVMKLMNHENAEVTKNALLCIQRLFLGAKYASFLQA

SEQ ID NO: 10510 - protein, 452 aa, Phaseolus vulgaris
MDQAELTTEQVLSRDIPWETYMSTKLISSTSLQLLRRYDHRSESHRAQLLDDDGPSYVRVFVRVLRDIFKEDTVEYVLALIDEMLAANPKRGRLFHDSTLADEDTYEPFLRLLWKGNWFIQEKSCKILALIVSVRPKNQNGVVSNGDASDGKKPFTTIDDVLIGLVKWLCEQLKKPFHPTRGVPTAINCLSTLLKEPVVRSSFVQADGVKLLVPLISPASTQQSIQLLYETCLCIWLLSYYEPAIEYLATSRTLPRLIDVVKSSTKEKVVRVIVLTLKNLMSKGTLGAQMVDLQLPQVVQSLKAQAWSDEDLLEALNSLEEGLKDNIKKLSSFDMYKQEVLLGHLDWSPMHKDPIFWRENITNFEENDFQIPRVLITILDTSSDPRTLAVACYDISQFIQHHPAGRIIVTDLKAKERVMKLMNHENAEVTKNALLCIQRLFLGAKYASFLQV

SEQ ID NO: 10511 - protein, 452 aa, Vigna unguiculata
MDQAELTTEQVLSRDIPWETYMSTKLISSTSLQLLRRYDHRSESHRAQLLDDDGPSYVRVFVRVLRDIFKEDTIEYVLALIDEMLAANPKRARLFHDSTLADEDTYEPFLRLLWKGNWYIQEKSCKILALIVSVRPKNQNGVVSNGEASNGKKPFTTIDDVLIGLVKWLCEQLKKPFHPTRGVPTAINCLATLLKEPVVRSSFVQADGVKLLVPLISPASTQQSIQLLYETCLCIWLLSYYEPAIEYLATSRTLPRLIDVVKSSTKEKVVRVIVLTLKNLMSKGTLGAQMVDLQLPQVVQSLKAQAWSDEDLLEALNSLEEGLKDNIRKLSSFDMYKQEVLLGHLDWSPMHKDPLFWRENITNFEENDFQILRVLITILDTSSDPRTLAVACYDLSQFIQNHPAGRIIVTDLKAKERVMKLMNHENAEVTKNALLCIQRLFLGAKYASFLQV

SEQ ID NO: 10512 - protein, 452 aa, Fagus grandifolia
MDQAELNTEQVLKRDIPWETYMTTKLISGTSLQLLRRYDNRPESYRAQLLDDDGPAYVRVFVSILRDIFKEETVEYVLALVDEMLTANPKRARLFHDKSIANEDTYEPFLRLLWKGNWFIQEKSCKILALIVSARPKIQDGIIANGEASNSKKKFTSIDDILQGLVEWLCAQLKKPSHPSRGVPSAISCLATLLKEPMVRSSFVKADGAKLLIPLISPASTQQSIQLLYETCLCVWLLSYYEPAVEYLATTRTLPRLIEVVKSSTKEKVVRVVVLTLRNFISNVAFGAQMVELGLPQIVQSLKAQAWSDEDLLEALNQLEEGLKDNIKKLSSFDKYKQAVLLGQLDWTPMHKDPLFWRDNITCFEENDFQILRVLITILDTSNDPRALAVACFDLSQFIQYHPAGRIILTDLKAKERVMKLMNHENAEVTKNALLCIQRLFLGAKYASFLQA

SEQ ID NO: 10513 - protein, 450 aa, Olea europaea
MDHSDLTTEQVLRRDIPWETYMSTKLITGTGLQLLRRYDKKPENYKAQLLDDDGPSYIRVLVSILRDIFKEETVEYVLALIDEMLTANPTRARLFHDTSLANEDTYEPFLRLLWKGNWFIQEKSCKILSLIVSARPKPQDAAIANGSSKSKELTTIDDVLKGLVEWLCTQLKKPSHPSRGIPTAISCLATLLKEPVVRSLFVQADGVKLLVPLISPVSSQQSIQLLYETCLCVWLLSYYEPAIEQLGASRALPHLIEVVKGSTKEKVVRVVVLTLRNLLQKGTFGALMIDLGLPQLVQSLKAQAWSDEDLLEALNQLEGGLQDNIKKLSSFDKYKQEVLLGHLDWSPMHKDPMFWRENITKFEENDFQILRVLITILDTSTDPRTLAVACFDLSQFIQYHPAGRIIVTDLKAKERVMKLMNHENPEVTKNALLCIQRLFLGAKYASFLQA

SEQ ID NO: 10514 - protein, 452 aa, Aristolochia fimbriata
MDQAELTTEQVLKRDIPWETYMTTKLITGTCLQLLRRYDNRSESYRAQLLDDDGPAYVRVFVSILRDILKEDTVEYVLALIDEMLTANPKRARLFHDKSLANEDTYEPFLRLLWKGNWFIQEKSCKILSMIVSARPKAHDSVVVNGDASYSKSKFTTLDDVLKGLVDWLCGQLRKPSHPTRGVPTAVNSLATLLREPLVRSSFVQAEGVKLLVPLISPASTQQSIQLLYEACLCLWLLSYYEPAVEYIATTRALPRLAEVVKSSTKEKVVRVAVLTLRNLLSKGTLGAQMVDLGLPQIVVSLKAQAWSDEDLLEALDQLEEGLKDNIKKLSSFDKYKQEVLLGHLDWSPMHKDPVFWRDNITNFEENDFQILRVLITILDTSVDPRTLSVACYDLSQFIQYHPAGRGIVNDLKAKDRVMKLMNHENAEVTKNALLCIQRLFLGTKYASFLQS

SEQ ID NO: 10515 - protein, 452 aa, Trifolium pratense
MDQAELTTDQVLNRDIPWETYMSTKLISGTSLQLLRRYDHRSESQRAQLLDDDGPAYVRVFVRVLRDIFKEDTVEYVLALIDEMLTANPKRARLFHDNALADDDTYEPFLRLLRKGNWFVQEKSCKILALIVSVRPKNQSGVASNGEASSEKKPFTSIDDVLIGLVKWLCEQLKKPSHPTRGVPTAINCLSTLLKEPVVRSSFVQADGVKLLVPLICPASTQQSIQLLYETCLCIWLLSYYEPAIEYLATSRTLPRLIDVVKSSTKEKVVRVVVLTLKNLLSKGTLGAQMVDLQLPQVVQSLKAQAWSDEDLLDALNSLEEGLKDNIKKLSSFDKYKQEVLLGNLDWSPMHKDPIFWRENITNFEEHDFQILRVLLTILDTSNDPRTLAVACFDISQFIQCHPAGRIIVTDLKAKERVMKLMNHESAEVTKNALLCIQRLFLGAKYASFLQV

SEQ ID NO: 10516 - protein, 450 aa, Arachis hypogaea
MDHAELTTDQVLRRDIPWETYMSTKLISGTSLQLLRRYDHRSESHRAQLLDDDGPAYVRVFVHVLRDIFKEDTVEYVLALIDEMLAANPKRARLFHDSSLSDEDTYEPFLRLLWKGNWFIQEKSCKILALIVSARPKNQNGVVSNGDTSKKPFTTIDDVLRALVKWLCEQLKKPSHPNRGVPTAVNCLATLLKEHLVRSSFVQADGVKLLVPLISPASTQQSIQILYEACLCIWLLSYYEPAIEYLATSRALPRLIDVVKTSTKEKVVRVVVLTLRNLLSKGSLGAQMVDFQLPQVVQSLKAQAWSDEDLLEALNSLEEGLKDNIKKLSSFDKYKQEVLLGHLDWSPMHKDPLFWRENINHFEENDFQILRVLVTILDTSSDPRTLAVACFDISQFIQHHPSGRIIVADLKAKERVMKLMNHENTEVTKNALLCIQRLFLGAKYASFLQA

SEQ ID NO: 10517 - protein, 436 aa, Tragopogon dubius
MALVALASSFIPQHTQHDHAHLKSLSAKCQHQRSRWFGFSWEKICNLKASDRTLRMISNGYAGRDTYRMKKDIDDKIYRRLDSCLVIPPPKGKKPKAIIKFLGGAFIGAVPEVTYSYLLGLLANEGYLIISVPYNVTFDHSQAATEVYERFHSCLSSILTSGLPNDDVSAAELVDLPLYSVGHSNGALLQVLAGSYFSEKIPKANAIISYNNRPATEAVPYFEQLGPLVSQLMPVVEASPVSSMAKGAADAWKALLDTAEAMAPDYDPEARVSLNKFVDQLPSVFNQVAQGISEFKPTPSENRECCKNLYNVKKTLLVKFNSDAIDETDLLEETLRPRVEAIGGRLDKVSLSGNHITPCIQEPKLQVGMYILQQMRLHKDSRLFHLMRPRFLLEPSLSGSATLTKGTGGLNQFGESCVCDIKLYIKLAVSDYFVNV

SEQ ID NO: 10518 - protein, 464 aa, Arnica chamissonis
MSSLNYDALKLIFITILLTSINASTALPHQNPKSNSTQINSNSVLVALLDSHYTELSELVEKALLLQTLEEEVSSHNITIFAPNNEALERQMDPEFKRFLLEPGNLKSLQNLLLFHIIPHRVGSKEWPGEDVGAVAHHKTLCVGEADNHLPLTRGNTGEKIVGGVARVTRPDDVIRPDGLIHGIERLLVPRSVQEDFNRRRSLTSISAVLPEGAPVVDPRTHRLKKPASPVPAGASPVLPVYDAMAPGPSLAPAPAPGPGGPHHHFDGESQVKDFIQTLLHYGGYNELADILVNLTSLATEMGKLVSEGYVLTVLAPNDEAMAKLTTDQLSDPGAPEQIMYYHLIPEYQTEESMYNSVRRFGKVQYDTLRLPHKVVAEEADGSVKFGQGEGSAYLFDPDIYTDGRISVQGIDGVLFPVEETKEKPASKVSPATVPKVVANQRRGKLLEVACWIGGSLGHFTSCY

SEQ ID NO: 10519 - protein, 448 aa, Helianthus annuus
TTTTALPIQNPSSNSTHSTQINSNSVLVALLDSHYTELSELVEKALLLQTLEQTVSGQNITIFAPNNEALERQMDPEFKRFLLEPRNLKSLQKLLLFHIIPGRVGSEQWPGHGTGTGSVSHHQTLCVDEPDNHLPLTRGNTGERIVNGVAKVTRPDDVIRPDGVIHGIERLLVPRSVQEDFNRRRSLASISAVLPEGAPVVDPRTHRLKKPAAPVPAGAPPVLPVYEAMAPGPSLAPAPAPGPGTGHRHFDGESQVKDFIQTLLHYGGYNELADILVNLTSLATEMGKLVSEGYVLTVLAPNDEAMAKLTTDQLSDPGAPEQIMYYHLVPEYQTEESMYNSVRRFGKVEYDTLRLPHKVVAEEADGSVKFGSGEGSAYLFDPDIYTDGRISVQGIDGVLFPVEEVKEKPVGKVAPATVGKVVATQRRGKLLEVACSIAGSFGHFTSCY

SEQ ID NO: 10520 - protein, 738 aa, Solanum phureja
MEESLLPGESSSNSWGRIRNRRRVGSMFDPRDAIAHGSAYQKAAALVDLAEDGVGLPEEILEGTSFEKAAQLYFMFTRFDFLWSLNYLALILINFFEKPLWCSRHLAESCNNRDYYYLGQLPFLTGAESLIYEGVTLLLLVIHILFPISYEGFHLYWRSLLNRLKIVLLLILVADIVVYILFLADFYYLPFRIASYLRVVFFILNIRELRDSFFILAGMFRTYLNVVALTALFLLFSSWLAYVFFEDTQQGKTMFTSYGTTLYQMFVLFTTSNNPDVWIPAYKESRWYCLFFVLYVLLGVYFVTNLVLAVVYDSFKSELVKQVAEKDRRKLRTLKKAFSLIDDSNTGVLDKKQCILLFEELNKYRTLPKISGDDFESIFNELDDTGDFKINLEEFADLCTAIGLRFQKEDSLPIFEACPNFYHSAASEKLRDFVRGDMFEYIIVSVLLVNLVAVIIETTLDIQNNSGQTFWQKVEFTFGWLYVIEMALKVYTYGFENYWRDGQNQFDFIVTWVIVIGETATFVAPDDLTFLSNGEWIRYLLIARMLRLMRLLLHVERYRAFVATFLTLIPSLMPYLGTIFCILCFYCSLGLQIFGGIVNAGNPNLAQTELSDNDYLLFNFNDYPSGMVTVFNILVMGNWQVWMQSYKELTGTAWTYVYFVSFYLISVLWLLNLIVAFVLEAFQAEMDLEAAANCVDGDDKESSERRRNVGTKTRSQRVDFLLHHMLSSELTECSHDNP

SEQ ID NO: 10521 - protein, 740 aa, Capsicum annuum
MDESLLPGESSSSWGRVRNRRWSGSNYDRREAIAHGSAYQKAAALVDLAEDGVGLPEEILEGSSFGKAAQLYFVFTRFDFLWSINYLALVVLNFLEKPLWCSKHLVESCNNRGYYYLGQLPFLTGAESLIYEGVTFLLLAIHVLFPISYEGFHLYWRSLLNRLKVILLLILVADIVVYILFLADFYYLPFRIAPYLRVVFFILNIRELRDSFFILAGMLRTYLNVVALTALFLLFSSWLGYVLFEDTQQGKKKFTSYGTTLYQMFVLFTTSNNPDVWIPAYKESRWFCLFFVLYVLLGVYFVTNLVLAVVYDSFKSELVKQVAEKDRRKLRTLKKAFTLIDDSNNGFLDKKQCIRLFEELNKYRTLPKISGDDFEAIFTELDDTGDFKINLEEFADLCTAIGLRFQKEDSLPIFEACPNFYHSPASESLRNFVRGNTFEYIIVFILLVNLVAVIIETTLDIQNNSGQTFWQKVEFIFGWLYVVEMALKVYTYGFENYWRDGQNRFDFVITWVIVIGETATFVAPNDLTFLSNGEWIRYLLIARMLRLIRLLLHVDQYRGFVATFLTLIPSLMPYLGTIFCILCFYCSIGLQIFGGMVNAGNPNLASTDLADNDYYLFNFNDYPSGMVTLFNILVMGNWQVWMQTYKELTGTAWSYVYFVSFYLISVLWLLNLIVAFVLEAFQAEMALEASASCVDDEDKESRSERRRNVGTKTRSQRVDFLLHHMLSSELTECSNDNNNP

SEQ ID NO: 10522 - protein, 631 aa, Triticum aestivum
MDTPDRPRAGAAAGFEDSPVFNFINNLSPIPPPKPQDSSHNVHLFKSSDLAPVSSIFASPHVNPPKESKLLIRDDSVQLSQDSNSPNSVRTRLGSAIRLIKCKNIVSENCSFTCHLNQGPIDSSANRSNSTSKLPQTIQFVGDSSECGKNQSADGKKDLARDQESIELEGVLLDHTGPDKIDSSQPGRIVHENQQCEQQKDGFTAYDGDYLITHESSMDMLRLAPPCEADTQLVNETLNADNVFSGNSLLTDGPSGSYINNAAHDPNLYWDGTVEGPTTDYTPQLLSGACQSQSVSNDQICNAVEEPSDHIPIDQSALSQNMRGMRRRCLFNEKAGAVNKAAKKTSDRHSANTTTPRCKTNSGDKPVRTPPCALPGIGLHLNALAPISTDKIVPQAAQSTINQASNFPCAVSSSTAEPNIVNEDSSQAIVVANADESGQGSPKKKRHKFDDGDGTSCKRCSCKKSKCLKLYCECFHAGVFCSEPCSCQGCLNKPSNMEIVLSTREQIESRNPLAFAPKVIRTSEPGQELGEYSNKTPASARHKRGCNCKKSSCLKKYCECYQGGVGCSISCRCEGCKNAFGRREGLGPLSIEEAKQGNEENSACVKEEKRKMIIISSLSAQLLIQLLLRMY

SEQ ID NO: 10523 - protein, 251 aa, Pseudoroegneria spicata
MASVHLCGPKVASAAMAKPALADGLRIPPSSSARPVPTARRLRGLVVRAATVVSPKYTSVKPLGDRVLVKTKTTEDKTAGGILLPTTAQSRPQAGEVVAVGEGRSLGSNIVEISVPVGAKVIYSKYAGTELEFNDTTHLIMKEDDIIGILDTDDVKDLKPLSDRILIKVAESEEETAGGLLLTQASKEKPSVGTVVAVGPGGLGDDGSRTPLSITPGSSVLYSKYAGSEFKGSEGEYIVLRSSDVIAVLSS

SEQ ID NO: 10524 - protein, 251 aa, Leymus cinereus x Leymus triticoides
MASVHLCGPKVASAAMAKPALADGLRVPPSSSARPVPTGRRFRGLVVRAATVVSPKYTSVKPLGDRVLVKTKTSEDKTAGGILLPTTAQSRPQAGEVVAVGEGRSLGSNIVEISVPVGAKVIYSKYAGTELEFNDTTHLIMKEDDIIGILDTDDVKDLKPLSDRILIKVAESEQETAGGLLLTQASKEKPSVGTVVAVGPGGLGEDGGRTPLSINPGSSVLYSKYAGSEFKGSEGEYIVLRSSDVIAVLSS

SEQ ID NO: 10525 - protein, 251 aa, Leymus cinereus x Leymus triticoides
MASVHLCGPKVASAAMAKPALADGLRIPPSSSARPVPTGRRFRGLVVRAATVVSPKYTSVKPLGDRVLVKTKTSEDKTAGGILLPTTAQSRPQAGEVVAVGEGRSIGSNIVEISVPVGAKVIYSKYAGTELEFNDTTHLIMKEDDIIGILDTDDVKDLKPLSDRILIKVAESEQETAGGLLLTQASKEKPSVGTVVAVGPGPLGDDGSRTPLSITPGSSVLYSKYAGSEFKGSEGEYIVLRASDVIAVLSS

SEQ ID NO: 10526 - protein, 250 aa, Avena sativa
MASVHLCGPQVASAAMVKPASADGLRIPASSSRAAPTGRRFRGLVVRAATVVSPKYTSVKPLGDRVLVKTKTTEDKTAGGILLPTTAQSRPQGGEVVAVGEGRSLGSNIVEISVPVGAKVIYSKYAGTELEFNDTTHLIMKEDDIIGILDTDDVKDLKPLSDRILIKVAESEEETAGGLLLTQATKEKPSVGTVVAVGPGPLGDDGSRTPLTITPGSSVLYSKYAGSEFKGSEGEYIVLRVSDVIAVLWS

SEQ ID NO: 10527 - protein, 250 aa, Avena sativa
MASVHLCGPQVASAAMVKPASADGLRIPQSSARAVPTGRRFRGLVVRAATVVSPKYTSVKPLGDRVLVKTKTTEDKTAGGILLPTTAQSRPQGGEVVAVGEGRSIGSNVVEISVPVGAKVIYSKYAGTELEFNDTNHLIMKEDDIIGILDTDDVKDLKPLSDRILIKVAESEEETAGGLLLTQATKEKPSVGTVVAVGPGPLGDDGSRTPLTITPGSSVLYSKYAGSEFKGSEGEYIVLRVSDVIAVLSS

SEQ ID NO: 10528 - protein, 250 aa, Avena sativa
MASVHLCGPQVASAAMVKPASADGLRIPASSSRAAPTGRRFRGLVVRAATVVSPKYTSVKPLGDRVLVKTKTTEDKTAGGILLPTTAQSRPQGGEVVAVGEGRSIGSNIVEISVPVGAKVIYSKYAGTELEFNDTNHLIMKEDDIIGILDTDDVKDLKPLSDRILIKVAESEEETAGGLLLTQATKEKPSVGTVVAVGPGPLGDDGSRTPLTITPGSSVLYSKFAGSEFKGSEGEYIVLRVSDVIAVLSS

SEQ ID NO: 10529 - protein, 250 aa, Avena sativa
MASVHLCGPQVASAAMVKPASADGLRIPASSSRAAPTGRRFRGLVVRAATVVSPKYTSVKPLGDRVLVKTKTTEDKTAGGILLPTTAQSRPQGGEVVAVGEGRSIGSNIVEISVPVGAKVIYSKYAGTELEFNDTNHLIMKEDDIIGILDTDDVKDLKPLSDRILIKVAESEEETAGGLLLTQATKEKPSVGTVVAVGPGPLGDDGSRTPLTITPGSSVLYSKYAGSEFKGSEGEYIVLRVSDVIAVLWS

SEQ ID NO: 10530 - protein, 250 aa, Avena sativa
MASVHLCGPQVASAAMVKPASADGLRIPASSSRAAPTGRRFRGLVVRAATVVSPKYTSVKPLGDRVLVKTKTTEDKTAGGILLPTTAQSRPQGGEVVAVGEGRSIGSNIVEISVPVGAKVIYSKYAGTELEFNDTNHLIMKEDDIIGILDTDDVKDLKPLGDRILIKVAESEEETAGGLLLTQATKEKPSVGTVVAVGPGPLGDDGSRTPLTITPGSSVLYSKFAGSEFKGSEGEYIVLRVSDVIAVLSS

SEQ ID NO: 10531 - protein, 250 aa, Avena sativa
MASVHLCGPQVASAAMVKPASADGLRIPQSSARAVPTGRRFRGLVVRAATVVSPKYTSVKPLGDRVLVKTKTTEDKTAGGILLPTTAQSRPQGGEVVAVGEGRSIGSNVVEISVPVGAKVIYSKYAGTELEFNDTNHLIMKEDDIIGILDTDDVKDLKPLGDRILIKVAESEEETAGGLLLTQATKEKPSVGTVVAVGPGPLGDDGSRTPLSITPGSSVLYSKYAGSEFKGSEGEYIVLRVSELIAVLSS

SEQ ID NO: 10532 - protein, 108 aa, Avena sativa
MTSLVFLYTDDVKDLKPLSDRILIKVAESEEETAGGLLLTQATKEKPSVGTVVAVGPGPLGDDGSRTPLTITPGSSVLYSKYAGSEFKGSEGEYIVLRVSDVIAVLSS

SEQ ID NO: 10533 - protein, 250 aa, Avena sativa
MASVHLCGPQVASAAMVKPASADGLRIPASSSRAAPTGRRFRGLVVRAATVVSPKYTSVKPLGDRVLVKTKTTEDKTAGGILLPTTAQSRPQGGEVVAVGEGRSIGSNVVEISVPVGAKVIYSKYAGTELEFNDTNHLIMKEDDIIGILDTDDVKDLKPLGDRILIKVAESEEETAGGLLLTQATKEKPSVGTVVAVGPGPLGDDGSRTPLSITPGSSVLYSKYAGSEFKGSEGEYIVLRVSELIAVLSS

SEQ ID NO: 10534 - protein, 250 aa, Lolium multiflorum
MASLHLCGQQMASAAMVKPASADGLRVAASSPRAVPARRRFRGLVVRAATVVSPKYTSVKPLGDRVLVKTKTTEDKTAGGILLPTTAQSRPQGGEVVAVGEGRTIGSNTVEISVPVGAKVVYSKYAGTDLEFNDANHLIMKEDDIIGVLDTDDVKDLKPLGDRILIKVAESEEETAGGLLLTQATKEKPSVGTVVAVGPGPLGDDGSRTPLSLTPGSSVLYSKYAGSEFKGSEGDYIVLRVSDVIAVLSS

SEQ ID NO: 10535 - protein, 250 aa, Lolium multiflorum
MASLHLCGQQMASAAMVKPASADGLRVAASSPRAVPARRRFRGLVVRAATVVSPKYTSVKPLGDRVLVKTKTTEDKTAGGILLPTTAQSRPQGGEVVAVGEGRTIGSNTVEISVPVGAKVVYSKYAGTDLEFNDANHLIMKEDDIIGVLDTDDVKDLKPLGDRILIKVAESEEETAGGLLLTQATKEKPSVGTVVAVGPGPLGDDGSRTPPSLTPGSSVLYSKYAGSEFKGSEGDYIVLRVSDVIAVLSS

SEQ ID NO: 10536 - protein, 241 aa, Festuca arundinacea
QMASAAMVKPASADGLRVAASSPRAVPTGRRFRGLVARAATVVSPKYTSVKPLGDRVLVKTKTTEDKTAGGILLPTTAQSRPQGGEVVAVGEGRTIGSNIVEISVPVGAKVVYSKYAGTDLEFNDTNHLIMKEDDIIGVLDTDDVKDLKPLGDRVLIKVAESEEETAGGLLLTQATKEKPSVGTVVAVGPGPLGDDGSRTPLSLTPGSSVLYSKYAGSEFKGAEGEYIVLKVSDVIAVLSS

SEQ ID NO: 10537 - protein, 245 aa, Festuca arundinacea
MASLQMASAAMVKPASADGLRVAASSPRAVPTRRRFRGLVVRAATVVSPKYTSIKPLGDRVLVKTKTTEDKTAGGILLPTTAQSRPQGGEVVAVGEGRTIGSNTVEISVPVGAKVVYSKYAGTDLEFNDANHLIMKEDDIIGVLDTDDVKDLKPLGDRILIKVAESEEETAGGLLLTQATKEKPSVGTVVAVGPGPLGDDGSRTPLSLTPGSSVLYSKYAGSEFKGSEGDYIVLRVSDVIAVLSS

SEQ ID NO: 10538 - protein, 249 aa, Brachypodium distachyon
MASVHLCGPQVALAPVAKPASVDGLRIPQLSSHAVSRSRKFRGLVVRAATVVSPKYTSVKPLGDRVLVKTKISEEKTPGGILLPTSVKPKPQGGEVVAVGEGRSIGSNTVEISVPVGVQVVYSKYAGTELEFNDSNHLILKEDDIIGILDTDDVKDLKPLSDRILIKVAEAEEETSGGLLLTQATKEKPSVGTVIAVGPGPLGEDGSRTPLSITPGSSVLYSKYAGSEFKGADGEYIVLRVSDVIAVIS

SEQ ID NO: 10539 - protein, 287 aa, Triticum aestivum
MATPDLLFNLRNLFYLGAYQSAINNSDVPGLDADAAAERDVIVFRSYIALGSYQLVISEIDSSAATSLQAVKLLALYLTGDKEGAISSLKEWLSDSAIGSNPVLRLIAGIIFMHEQDYNEALKHTHTGGTLDLHALNVQIFLKMHRSDYADKQLKIMQQTDEDHTLTQLANAWLDIAVGGSKIREAYLIFQDFAEKYPMTGMVLNGKAVCCMHMGSFEEAETLLLEALNKDAKDPETLANLIVCNLHLGKPSSRYFSQLKLSHPDHVLVKTTTSAEGNFERALQAVA

SEQ ID NO: 10540 - protein, 287 aa, Pseudoroegneria spicata
MATPDLLFNLRNLFYLGAYQSAINNSDVPGLDADAAAERDVIVFRSYIALGSYQLVISEIDSSAATSLQAVKLLALYLTGDKEGVISSLKEWLSDSAIGSNPVLRLIAGIIFMHEQDYNEALKHTHTGGTLDLHALNVQIFLKMHRSDYADKQLKIMQQTDEDHTLTQLANAWLDIAVGGSKIREAYLIFQDFAEKYPMTGMVLNGKAVCCMHMGSFEEAETLLLEALNKDAKDPETLANLIVCNLHLGKPSSRYFSQLKLSHPDHVLVKTTTSAEDNFERALQAVA

SEQ ID NO: 10541 - protein, 287 aa, Avena sativa
MATPDLLFNLRNLFYLGAYQSAINNSDVPGLDADAAAERDVIVFRSYIALGSYQLVISEIDSSAATSLQAVKLLALYLTGDKEGAIASLKEWLSDSAIGSNPVLRLIAGIIFMHEQDYNEALKHTHTGGTLDLHALNVQIFLKMHRSDYADKQLKIMQQTDEDHTLTQLANAWLDIAVGGSKIREAYLIFQDFAEKYPMTGMVLNGKAVCCMHMGSFEEAETLLLEALNKDAKDPETLANLIVCNLHLGKASSRYFSQLKLSHPDHVLVKSTASAEDNFERALQAVA

SEQ ID NO: 10542 - protein, 287 aa, Avena sativa
MATPDLLFNLRNLFYLGAYQSAINNSDVPGLDADAAAERDVIVFRSYIALGSYQLVISEIDSSAATSLQAVKLLALYLTGDKEGAIASLKEWLSDSAIGSNPVLRLIAGIIFMHEQDYNEALKHTHTGGTLDLHALNVQIFLKMHRSDYADKQLKVMQQTDEDHTLTQLANAWLDIAVGGSKIREAYLIFQDFAEKYPMTGMVLNGKAVCCMHMGSFEEAETLLLEALNKDAKDPETLANLIVCNLHLGKASSRYFSQLKLSHPDHVLVKSTASAEDNFERALQAVA

SEQ ID NO: 10543 - protein, 287 aa, Avena sativa
MATPDLLFNLRNLFYLGAYQSAINNSDVPGLDADAAAERDVIVFRSYIALGSYQLVISEIDSSAATSLQAVKLLALYLTGDKEGAIASLKEWLSDSAIGSNPVLRLIAGIIFMHEQDYNEALKHTHTGGTLDLHALNVQIFLKMHRSDYADKQLKIMQQTDEDHTLTQLANAWLDISVGGSKIREAYLIFQDFAEKYPMTGMVLNGKAVCCMHMGSFEEAETLLLEALNKDAKDPETLANLIVCNLHLGKASSRYFSQLKLSHPDHVLVKSTASAEDNFERALQAVA

SEQ ID NO: 10544 - protein, 287 aa, Leymus cinereus x Leymus triticoides
MATPDLLFNLRNLFYLGAYQSAINNSDVPGLDADAAAERDVIVFRSYIALGSYQLVISEIDSSAATSLQAVKLLALYLTGDKEGAISSLREWLNDSAIGNNPVLRLIAGIIFMHEQDYNEALKHTHTGGTLDLHALNVQIFLKMHRSDYADKQLKIMQQTDEDHTLTQLANAWLDIAVGGSKIREAYLIFQDFAENYPMTGMVLNGKAVCCMHMGSFEEAETLFLEALNKDAKDPETLANLIVCNLHLGKPSSRYFSQLKLSHPDHVLVKTTTSAEDNFERALQAVA

SEQ ID NO: 10545 - protein, 287 aa, Festuca arundinacea
MATPDLLFNLRNLFYLGAYQSAINNSDVPGLDADAAAERDVIVFRSYIALGSYQLVISEIDSSAATSLQAVKLLALYLTGDKEGAISSLKEWLSDSAIGSNPVLRLVAGIIFMHEQDYNEALKHTHTGGTLDLHALNVQIFLKMHRSDYADKQLKMMQQTDEDHTLTQLANAWLDIAVGGSKIREAYLIFQDFAEKYPMTGMVLNGKAVCCMHMGSFEEAETLLLEALNKDAKDPETLANLIVCNLHLGKASSRYFSQLKLSHPDHVLVKSTASAEDNFERALQAVA

SEQ ID NO: 10546 - protein, 287 aa, Lolium multiflorum
MATPDLLFNLRNLFYLGAYQSAINNSDVPGLDADAAAERDVIVFRSYIALGSYQLVISEIDSSAATSLQAVKLLALYLTGDKEGAISSLKEWLSDSAIGSNPVLRLVAGIIFMHEQDYNEALKHTHTGGTLDLHALNVQIFLKMHRSDYADKQLKIMQQTDEDHTLTQLANAWLDIAVGGSKIREAYLIFQDFAEKYPMTGMVLNGKAVCCMHMGSFEEAETLLLEALNKDAKDPETLANLIVCNLHLGKASSRYFNQLKLSHPDHVLVKSTASAEDNFERALQAVA

SEQ ID NO: 10547 - protein, 204 aa, Avena sativa
MATPDLLFNLRNLFYLGAYQSAINNSDVPGLDADAAAERDVIVFRSYIALGSYQLVISEIDSSAATSLQAVKLLALYLTGDKEGAIASLKEWLSDSAIGSNPVLRLIAGIIFMHEQDYNEALKHTHTGGTLDLHALNVQIFLKMHRSDYADKQLKIMQQTDEDHTLTQLANAWLDIAVGGSKIREAYLIFQDFDGKISYDRNGS

SEQ ID NO: 10548 - protein, 287 aa, Brachypodium distachyon
MATPDLLFNLRNLFYLGAYQSAINNSDVPGLDADAAAERDVIVFRSYIALGSYQLVISEIDSSAATSLQAVKLLALYLSGDKEGAISSLKEWLSDSAIGSNPVLRLIAGIIFMHEQDYNEALKHTHTGGTLDLHALNVQIFLKMHRSDYADKQLKIMQQTDEDHTLTQLANAWLDIAVGGSKIREAYLIFQDFAEKYPMTAMVLNGKAVCCMHMGSFEEAETLLLEALNKDAKDPETLANLIVCNLHLGKPSSRFFSQLKLSHPDHVLVKSAASAEDNFERALQSVA

SEQ ID NO: 10549 - protein, 287 aa, Festuca arundinacea
MATPDLLFNLRNPFYLGAYQSAINNSDVPGLDADAAAERDVIVFRSYIALGSYQLVISEIDSSAATSLQAVKLLGLYLTGDKEGAISSLKEWLSDSAIGSNPVLRLVAGIIFMHEQDYNEALKHTHTGGTLDLHALNVQIFLKMHRSDYADKQLKIMQQTDEDHTLTQLANAWLDIAVGGSKIREAYLIFQDFAEKYPMTGMVLNGKAVCCMHMGSFEEAETLLLEALNKDAKDPETLANLIVCNLHLGKASSRYFNQLKLSNPDHVLVKSTASAEDNFERALQAVA

SEQ ID NO: 10550 - protein, 287 aa, Echinochloa colona
MATPDLLFNLRNLFHLGAYQAAINNSDVPGLDADAAAERDVIVFRSYIALGSYQLVISEIDSSAATSLQAVKLLALYLTGDKEGAISSLKEWLSDSAIGSNPVLRLIAGIIFMHEQDYNEALKHTHSGGTLDLHALNVQIFIKMHRSDYAEKQLKIMQQIDEDHTLTQLANAWLDIAVGGSKIREAYLIFQDFAEKYPMTGMVLNGKAVCCMHMGSFEEAETLLLEALNKDAKDPETLANLIVCNLHLGKPSSRFLSQLKLSHPDHVLVKNAASSEANFERALQAVA

SEQ ID NO: 10551 - protein, 287 aa, Setaria italica
MATPDLLFNLRNLFYLGAYQAAINNSDVPGLDADAAAERDAIVFRSYIALGSYQLVISEIDSSAATSLQAVKLLALYLTGDKEGAISSLKEWLSDSAIGSNPVLRLIAGIIFMHEQDYNEALKHTHSGGTLDLHALNVQIFIKMHRSDYAEKQLKIMQQIDEDHTLTQLANAWLDIAVGGSKIREAYLIFQDFAEKYPMTGMVLNGKAVCCMHMGSFEEAETLLLEALNKDAKDPETLANLIVCNLHLGKPSSRFLSQLKLSHPDHVLVKNAASSEANFERALQAVA

SEQ ID NO: 10552 - protein, 287 aa, Panicum virgatum
MATPDLLFNLRNLFYLGAYQAAINNSDVPGLDADAAAERDAIVFRSYIALGSYQLVISEIDSSAATSLQAVKLLALYLTGDKEGAISSLKEWLSDSAIGSNPVLRLIAGIIFMHEQDYNEALKHTHSGGTLDLHALNVQIFIKMHRSDYAEKQLKIMQQIDEDHTLTQLANAWLDIAVGGSKIREAYLIFQDFAEKYPMTGMVLNGKAVCCMHMGSFEEAETLLLEALNKDAKDPETLANLIVCNLHLGKPSSRFLSQLKLSHPDHVLVKNSASSEANFERALQAVA

SEQ ID NO: 10553 - protein, 287 aa, Sorghum bicolor
  Sequence also found in Organisms: Saccharum officinarum
MASPDLLFNLRNLFYLGAYQAAINNSDVPGLDADAAAERDAIVFRSYIALGSYQLVISEIDSSAATSLQAVKLLALYLTGDKEGAISSLKEWLSDSAIGSNPVLRLIAGIIFMHEQDYNEALKHTHSGGTLDLHALNVQIFIKMHRSDYAEKQLKIMQQIDEDHTLTQLANAWLGIAVGGSKIREAYLIFQDFAEKYPMTGMVLNGKAVCCMHMGSFEEAETLLLEALNKDAKDPETLANLIVCNLHLGKPSSRFLSQLKLSHPDHVLVKNAASSEATFERALQAVA

SEQ ID NO: 10554 - protein, 287 aa, Zea mays
MASPDLLFNLRNLFYLGAYQAAINNSDVPGLDADAAAERDAIVFRSYIALGSYQLVISEIDSSAATSLQAVKLLALYLTGDKEGAISSLKEWLSDSAIGSNPVLRLIAGIVFMHEQDYNEALKHTHSGGTLDLHALNVQIFIKMHRSDYAEKQLKIMQQIDEDHTLTQLANAWLGIAVGGSKIREAYLIFQDFAEKYPMTGMVLNGKAVCCMHMGSFEEAETLLLEALNKDAKDPETLANLIVCNLHLGKPSSRYLSQLKLSHPDHVLVKNAAASEATFERALQAVA

SEQ ID NO: 10555 - protein, 287 aa, Pennisetum glaucum
MATPDLLFNLRNLFYLGAYQAAINNSDVPGLDADAAAERDAIVFRSYIALGSYQLVINEIDSSAATSLQAVKLLALYLTGDKEGAISSLKEWLSDSAIGSNPVLRLIAGIVYMHEQDYNEALKHTHSGGTLDLHALNVQIFIKMHRSDYAEKQLKIMQQIDEDHTLTQLANAWLDIAVGGSKIREAYLIFQDFAEKYPMTGMVLNGKAVCCMHMGSFDEAETLLLEALNKDAKDPETLANLIVCNLHLGKPSSRFLSQLKLSHPDHVLVKNAVSSEANFERALQAVA

SEQ ID NO: 10556 - protein, 287 aa, Oryza sativa
MASPDLLFNLRNLFYLGAYQAAINNSDVPGLDADAAAERDAIVFRSYVALGSYQLVISEIDSSAATSLQAVKLLALYLSGDKESAIVSLKEWLSDSAVGSNPVLRLIAGIIFMHEQDYTEALKHTHSGGTLDLHALNVQIFIKMHRSDYAEKQLKIMQQIDEDHTLTQLANAWLDIAVGGSKIREAYLIFQDFAEKYPMTGMVLNGKAVCCMHMGSFDEAETLLLEALNKDAKDPETLANLIVCNLHLGKPSSRYLSQLKLSHPDHVLVKRAVSAEDNFERALQAVA

SEQ ID NO: 10557 - protein, 290 aa, Musa acuminata
MAAATTPDLLFGLRNSFYLGAYQAAINSSDIPNLPADDALERDVLVHRSYIALGSYQLVISEIDSSAPTALQAVKLLALYLSGDKESAISSLQEWLSDAAISNNPVLRLIAGIIYMHEQDYNEALKHTNSGGTMELHALNVQIFIKMHRSDYAEKQLKIMQQIDEDHTLTQLANAWLDLAVGGSKIQEAYLIFQDFSEKYQMTGMILNGKAVCCMHMGRFDEAESLLLEALNKDAKDAETLANLAVCSLHLGKPSSRYLNQLKLSHPDHVLVARMASAEDNFDRALQSIA

SEQ ID NO: 10558 - protein, 289 aa, Chelidonium majus
MASPDHLFGLRNNFYLGAYQAAINNSEVPNLSQEDSVERDCLVYRSYIALGSYQLVINEIDSSAATPLQAVKLLALYLSGPENKETTISSLKEWLGDAAIGNNPVLRLIAGIIFMHEQDYNEALKHTNTGGTMELHALNVQIFLKMYRSDYAEKQLKIMQQIDEDHTLTQLANAWLNLAVGGSKIQEAYLIFQDFSEKYQMTGLVLNGKAVCCMHMGHFDEAESLLLEALNKDAKDAETLANLVVCNLHLGKPSSRYLSQLKLSHPDHMLVKRTSAAEESFDRALQTVA

SEQ ID NO: 10559 - protein, 290 aa, Musa acuminata
MAAATTPDLLFGLRNSFYLGAYQAAINSSDIPNLPADDALERDVLVHRSYIALGSYQLVVSEIDSSAPTALQAVKLLALYLSGDKESAISSLQEWLSDAAISNNPVLRLIAGIIYMHEQDYNEALKHTNSGGTMELHALNVQIFIKMHRSDYAEKQLKIMQQIDEDHTLTQLANAWLDLAVGGSKIQEAYLIFQDFSEKYQMTGMILNGKAVCCMHMGRFDEAESLLLEALNKDAKDAETLANLAVCSLHLGKPSSRYLNQLKLSHPDHVLVARMASAEDNFDRALQSIA

SEQ ID NO: 10560 - protein, 288 aa, Zingiber officinale
MATTPDLLFGLRNSFYLGAYQAAINSSDIPNLPADDAIERDVIVHRSYIAIGSYQLVINEIDSSAPTPLQAVKLLALYLSGSKEAAISSIQEWLSDAAIGNNPVLRLIAGIIYMHEQDYNEALKHTNAGGTMELHALNVQIFIKMHRSDYAEKQLKIMQQIDEDHTLTQLANAWLDLAVGGSKIQEAYLIFQDFSEKYQMTGMVLNGKAVCCIHMGHFDEAESLLLEALNKDAKDAETLANLVVCSLHLGKPSTRFLNQLKLSHPDHMLVKRLATAEDNFDRALQSLA

SEQ ID NO: 10561 - protein, 90 aa, Papaver somniferum
MATPDHLFSLRNNFYLGAYQAAINNSDVPNLSQEDSIERDSLVYRSYIALGSYQLVISEIDSSAPTALQAVKLLASYLCGPEQKETRFQV

SEQ ID NO: 10562 - protein, 289 aa, Ananas comosus
MASSSPDLLFGLRNSFYLGAYQGAINNSDIPNLGPDDAIERDSIVYRSYIALGSYQLVISEIDSSAPTALQAVKLLALYFAGDKEAAISGLQEYLSDSAIGNNPVLRLIAGIIYMHEQDYNEALKHTNSGGTMELHALNVQIYIKMYRSDYAEKQLKVMQQIDEDHTLTQLANAWLDLAVGGSKIQEAYLIFEDFSEKYQMTGMILNGKAVCCMHMGRFDEAETLLLEALNKDAKDAETLANLIVCSLHLGKSSSRYFNQLKLSHPDHTLVKRAASAEDSFDRALQAVA

SEQ ID NO: 10563 - protein, 289 aa, Papaver somniferum
MATPDHLFSLRNNFYLGAYQAAINNSDVPNLSQEDSIERDSIVYRSYIALGSYQLVISEIDSSAPTPLQAVKLLATYLSGPEQKENTISSLKEWLGDSAIGNNPVLRLIAGIIFMHEQDYNEALKHSNTGGTMELHALNVQIFLKMNRSDFAEKQLKIMQQIDEDHTLTQLANAWLNLAVGGSKIQEAYLIFQDFSEKYPMTGLILNGKAVCCMHMGHFDEAESLLLEALNKDAKDAETLANLIVCSLHLGKQSSRYLSQLKLSHPDHMLVKRTSADEESFDRALQTVA

SEQ ID NO: 10564 - protein, 296 aa, Carica papaya
MAAAAAAAAGPDHLFNLRNNFYLGAYQAAINNSDLPHLSADDAVERDCIVFRSYIALGSYQLVINEIDASAATPLQAVKLLALYLSSPGNKESTISSLKEWLSDPAIGNNATLRLIAGIIFMHEEDYNEALKHTNAGGTMELHALNVQIFLKMHRSDYGERQLRVMQQIDEDHTLTQLANAWLNLAVGGSKIQEAYLIFQDFSEKYPMTSLILNGKAVCCMHMGNFDEAETLLLEALNKDAKDPETLANLVVCSLHLGKSSSRYLSQLKLSHPDHMLVKRASSAEENFERAVQSVA

SEQ ID NO: 10565 - protein, 93 aa, Curcuma longa
MATTPDLLFGLRNSFYLGAYQAAINSSDIPNLPADDAIERDVIVHRSYIAIGSYQLVINEIDSSAPTPLQAVKLLLFTSPEARKLLFRASKSG

SEQ ID NO: 10566 - protein, 281 aa, Cenchrus ciliaris
SSTCGTSSTWAPTRRPSTTATSRASMPTPPPSATPSSSDSYIALGSYQLVINEIDSSAATSLQAVKLLALYLTGDKEGAISSLKEWLSDSAIGSNPVLRLIAGIIYMHEQDYNEALKHTHSGGTLDLHALNVQIFIKMHRSDYAEKQLKIMQQIDEDHTLTQLANAWLDIAVGGSKIREAYLIFQDFAEKYPMTGMVLNGKAVCCMHMGSFEEAETLLLEALNKDAKDPETLANLIVCNLHLGKPSSRFLSQLKLSHPDHVLVKNAVSSEANFERALQAVA

SEQ ID NO: 10567 - protein, 287 aa, Allium cepa
MATPDLLFNLRNNFYIGAYQAAINNSDVSNLSSDEIIERDSLVYRSYIALGSYELVISEIDSSAPTALQAVKLLAIYLSGDKEGAKSSLQEWLSDAAIASNPVLRLIGGIIYMHEQDYNEALKHTNAGGSMELLALNVQIFIKMHRSDYAEKQLKIMQQTDEDHTLTQLANAWLNLAVGGSKIQEAYLIFQDFAEKYQMTGMILNGQAVCCMHMGRFDEAESLLFEALNKDGKDAETLANLVVCSLHVGKPSSRYLSQLKLSHPDHLLVKRATAAEENFDKALQSVA

SEQ ID NO: 10568 - protein, 289 aa, Eschscholzia californica
MASPDHLFGLRNNFYLGAYQAAINNSEVPNLSSEDTIERDSLVYRSYIALGSYQLVINEIDSSAPTSLQAVKLLALYLSGTENKETTISTLKEWLGDATIANNPVLRLIAGIVFMHEQDYNEALKHTNAGGTMELHALNVQIFLKMYRSDYAEKQLKIMQQIDEDHTLTQLANAWLNLAVGGSKIQEAYLIFQDFSEKYQMTGLVLNGKAVCCMHMGHFDEAESLLLEALNKDAKDAETLANLIVCNLHLGKPSSRYLSQLKLSHPDHMLVKRTAAAEESFDRALQTVA

SEQ ID NO: 10569 - protein, 287 aa, Allium cepa
MATPDLLFNLRNNFYIGAYQAAINNSDVSNLSSDEIIERDSLVYRSYIALGSYELVISEIDSSAPTALQAVKLLAIYLSGDKEGAKSSLQEWLSDAAIANNPVLRLIGGIIYMHEQDYNEALKHTNAGGTMELLALNVQIFIKMHRSDYAEKQLKIMQQTDEDHTLTQLASAWLNLAVGGSKIQEAYLIFQDFAEKYQMTGMILNGQAVCCMHMGRFDEAESLLFEALNKDGKDAETLANLVVCSLHVGKPSSRYLSQLKLSHPDHLLVKRATAAEENFDKALQSVA

SEQ ID NO: 10570 - protein, 425 aa, Hordeum vulgare
MSQTTTASPAPAPAPATDAPPKPSAGAKRSLMGSLIDATALLRAASFKEDSYVAAALPSSDLRALADLRALLATHPDQISIWGVPLNPPSDSPADERTDVVLLKFLRARDFRVRDAHAMLLRCAAWRAEFRADAVLDEDLGFKDLEGIVAYMHGWDREGHPVCYNAYGVFKDRDMYDRVFGDGDRLSRFLRWRVQIMERGVRALQLRPGGVNAIIQVTDLKDMPKRELRAASNQILSLFQDNYPEMVARKVFVNVPWYFSVLFSMISPFLTERTKSKFVIAREGNVAETLFKFIRPELVPVQYGGLSRASELENGPPKPASEFTIKGGEKVFLEIDGIEAGATITWDLVVGGWELEYGAEYVPAAEGGYTLCVERTRKVPAAADEPVHNTFTAKEPGKMVLSIDNSGSRKRKVAAYRYFVRKPSA

SEQ ID NO: 10571 - protein, 435 aa, Oryza sativa
MSPTATPSPAPAEVAAAPKPPPSGTGAKRSLMSSLMEATALLRSSSFKEDSYVASALPASDLRALADLRALLSTHPDPISIWGVPLNPAPPQGGEGAPAPAAAADERADVVLLKFLRARDFRVRDAHAMLLRCAAWRAEFRADAVLDEDLGFKDLEGVVAYMHGWDREGHPVCYNAYGVFKDRDMYDRVFGDGERLARFLRWRVQVMERGVRALHLRPGGVNAIIQVTDLKDMPKRELRAASNQILSLFQDNYPEMVARKVFINVPWYFSVLFSMISPFLTERTKSKFVIAREGNVAETLFKFIRPELVPVQYGGLSRAGDLENGPPKPASEFTIKGGEKVFLEIDGIEAGATITWDLVVGGWELEYGAEYVPAAEDSYTLCVERTRKVPAAADEPVHNAFTAREAGKMVLSIDNSGSRKRKVAAYRYFVRKPSA

SEQ ID NO: 10572 - protein, 515 aa, Triticum aestivum
MELPQLASFLGVVLATVLFLKAVLRRRRQYNLPPGPKPWPIIGNLNLIGTLPHRSIHALSKKYGPLMQLQFGSFPVVVGSSVEMAKFFLKTHDVVFTDRPKTAAGRYTTYNYSDITWSPYGAYWRQARKMCLTELFSAKRLESYEYIRREEVLALLGDLYRGGAGAGRVVVLKDYLSTVSLNVITRMVMGKKYLEKEVRDEAGAVITTPEEFKWMIDELFLLNGVLNIGDSIPWLDWMDLQGYIKRMKKLSKMFDRFLEHVVDEHSERRRREGESFVVKDMVDVLLQFASDPGLEVKLNREGVKAFTQDLIAGGTESSAVTVEWALSELLKKPEVLAKATEELDRVVGRGRWVTEKDMSSLPYVDAIVKETMRLHPVAPMLVPRLSREDTSINGYDIPAGTRVLVMVWSIGRDPELWEAPEEFMPERFLGSRLDVKGQDYELLPFGSGRRMCPGYSLGLKVIQVSLANLLHGFTWRLPDGVELSMEEIFGLSTPRKYPLEAVVEPKLPAHLYAEA

SEQ ID NO: 10573 - protein, 515 aa, Secale cereale
MELPQWATFLGVVLATVLFFKAVLRRRRQYNLPPGPKPWPIIGNLNLIGTLPHRSIHALSKKYGPLMQLQFGSFPVVVGSSVEMAKFFLKTHDVVFTDRPKTAAGRYTTYNYSDITWSPYGAYWRQARKMCLTELFSAKRLESYEYIRREEVLALLGDLYRGGAGAGRVVVLKDYLSTVSLNVITRMVMGKKYLEKEVRDEAGAVITTPEEFKWMIDELFLLNGVLNIGDSIPWLDWMDLQGYIKRMKKLSKMFDRFLEHVVDEHSERRGREGESFVVKDMVDVLLQFASDPGLEVKLNREGVKAFTQDLIAGGTESSAVTVEWALSELLKKPEVLAKATEELDRVVGRGRWVTEKDMTSLPYVDAIVKETMRLHPVAPMLVPRLSREDTSINGYDIPAGTRVLVMVWSIGRDPELWEAPEEFMPERFLGSRLDVKGQDYELLPFGSGRRMCPGYSLGLKVIQVSLANLLHGFTWRLPDGVELSMEEIFGLSTPRKFPLEAVLEPKLPAHLYAEA

SEQ ID NO: 10574 - protein, 515 aa, Triticum aestivum
MELPQLASFLGVVLATVLFFKAVLRRRRQYNLPPGPKPWPIIGNLNLIGTLPHRSIHALSKKYGPLMQLQFGSFPVVVGSSVEMAKFFLKTHDVVFTDRPKTAAGRYTTYNYSDITWSPYGAYWRQARKMCLTELFSAKRLESYEYIRREEVLALLGDLYRGGAGAGRVVVLKDYLSTVSLNVITRMVMGKKYLEKEVRDEAGAVITTPEEFKWMIDELFLLNGVLNIGDSIPWLDWMDLQGYIKRMKKLSKMFDRFLEHVVDEHSERRGREGESFVVKDMVDVLLQFASDPGLEVKLNREGVKAFTQDLIAGGTESSAVTVEWALSELLKKPEVLAKATEELDRVVGRGRWVTEKDMLNLPYVDAIVKETMRLHPVAPMLVPRLSREDTSINGYDIPAGTRVLVMVWSIGRDPELWKAPEEFMPERFLGSRLDVKGQDYELLPFGSGRRMCPGYSLGLKVIQVSLANLLHGFTWRLPDGVELSMEEIFGLSTPRKFPLEAVVEPKLPAHLYAEA

SEQ ID NO: 10575 - protein, 515 aa, Secale cereale
MELPQLASFLGVVLATVLFFKAVLRRRRQYNLPPGPKPWPIIGNLNLIGTLPHRSIHALSKQYGPLMQLQFGSFPVVVGSSVEMAKFFLKTHDVVFTDRPKTAAGRYTTYNYSDITWSPYGAYWRQARKMCLTELFSAKRLESYEYIRREEVLALLGDLYRGGAGAGRVVVLKDYLSTVSLNVITRMVMGKKYLEKEVRDEAGAVITTPEEFKWMIDELFLLNGVLNIGDSIPWLDWMDLQGYIKRMKKLSKMFDRFLEHVVDEHSERRGREGESFVVKDMVDVLLQFASDPGLEVKLNREGVKAFTQDLIAGGTESSAVTVEWALSELLKKPEVLAKATEELDRVVGRGRWVTEKDMPSLPYVDAIVKETMRLHPVAPMLVPRLSREDTSINGYDIPAGTRVLVMVWSIGRDPELWEAPEEFMPERFLDSKLDVKGQDYELLPFGSGRRMCPGYSLGLKVIQVSLANLLHGFTWRLPDGVELNMEEIFGLSTPRKFPLEAVLEPKLPAHLYAEA

SEQ ID NO: 10576 - protein, 513 aa, Secale cereale
MELPQLASFLGVVLATVLFFKAVLRRRRQYNLPPGPKPWPIIGNLNLIGTLPHRSIHALSKQYGPLMQLQFGSFPVVVGSSVEMAKFFLKTHDVVFTDRPKTAAGRYTTYNYSDITWSPYGAYWRQARKMCLTELFSAKRLESYEYIRREEVLALLGDLYRGGAGAGRVVVLKDYLSTVSLNVITRMVMGKKYLEKEVRDEAGAVITTPEEFKWMIDELFLLNGVLNIGDSIPWLDWMDLQGYIKRMKKLSKMFDRFLEHVVDEHTERRGREGESFVVKDMVDVLLQFASDPGLEVKLNREGVKAFTQDLIAGGTESSAVTVEWALSELLKKPQVLAKATEELDRVVGRGRWVTEKDMPSLPYVDAIVKETMRLHPVAPMLVPRLSREDTTINGYDIPAGTRVLVMVWSIGRDPELWEAPEEFMPERFLGSRLDVKGQDYELLPFGSGRRMCPGYSLGLKVIQVSLANLLHGFTWRLPDSVELSMEEIFGLSTPRKFPLEAVVEPKLPAHLYT

SEQ ID NO: 10577 - protein, 515 aa, Secale cereale
MELPQWATFLGVVLATVLFFKAVLRRRRQYNLPPGPKPWPIIGNLNLIGTLPHRSIHALSKKYGPLMQLQFGSFPVVVGSSVEMAKFFLKTHDVVFTDRPKTAAGRYTTYNYSDITWSPYGAYWRQARKMCLTELFSAKRLESYEYIRREEVLALLGDLYRGGAGAGRVVVLKDYLSTVSLNVITRMVMGKKYLEKEVRDDAGAVITTPEEFKWMIDELFLLNGVLNIGDSIPWLDWMDLQGYIKRMKKLSKMFDRFLEHVVDEHTERRRGEGKSFVVKDMVDVLLQFASDPGLEVKLNREGVKAFTQDLIAGGTESSAVTVEWALSELLKKPEVLAKATEELDRVVGRGRWVTEKDMSSLPYVDAIVKETMRLHPVAPMLVPRLSREDTSINGYDIPAGTRVLVMVWSIGRDPELWEAPEEFMPERFLGSRLDVKGQDYELLPFGSGRRMCPGYSLGLKVIQVSLANLLHGFTWRLPDGVELSMEEIFGLSTPRKFPLEVVLEPKLPAHLYAEA

SEQ ID NO: 10578 - protein, 518 aa, Avena sativa
MELPQLASFLAVVLATALFLKAVIRHRSSRKYNLPPGPKAWPIIGNLNLIGTLPHRSIHALAKQYGPLVQLQFGSFPVVVGSSVEMAEFFLKTHDVVFTDRPKTAAGKHTTYNYCDITWSPYGAYWRQARKMCLTELFSAKRLESYEYIRREEVLSLLRDLNRGAAAAGGRPLVLKDYLSTVSLNVITRMVMGKKYLEKEVRDESGAVITTPDEFKWMIDELFLLNGVLNIGDSIPWLDWLDLQGYIKRMKKLSKMFDRFLEHVVDEHSERRRLDGESFVAKDMVDVLLQFASNPDLEVKLNREGVKAFTQDLIAGGTESSAVTVEWALSELLKKPEVLAKATEELDRVVGRGRWVTEKDMPSLPYVDAIVKETMRLHPVAPMLVPRLSREDTSIGGYDIPAGTRVLVSVWTIGRDPELWEAPEEFMPERFLGSKLDVKGQDYELLPFGSGRRMCPGYSLGLKVIQVSLANLLHGFEWRLSDGVELSMEEIFGLSTPRKFPLEAVVEPKLPAHLYVEA

SEQ ID NO: 10579 - protein, 516 aa, Avena sativa
LPEWASFLGIVVATVLFLKAVLRHRSSRQYNLPPGPKAWPIIGNLNLIGTLPHRSIHALAKQYGPLVQLQFGSFPVVVGSSVEMAKFFLKTHDVVFTDRPKTAAGKHTTYNYCDITWSPYGAYWRQARKMCLTELFSAKRLESYEYIRREEVLALLRDLNRGAAAAGGRPLVLKDYLSTVSLNVITRMVMGKKYLEKEVRDESGAVITTPDEFKWMIDELFLLNGVLNIGDSIPWLDWLDLQGYIKRMKKLSKMFDRFLEHVVDEHSERRHLDGESFVAKDMVDVLLQFASNPDLEVKLNREGVKAFTQDLIAGGTESSAVTVEWALSELLKKPEVFAKATEELDRVVGRDRWVTEKDMPSLPYVDAIVKETMRLHPVAPMLVPRLSREDTSIGGYDIPAGTRVLVSVWTIGRDPELWDSPEEFMPERFLGSKLDVKGQDYELLPFGSGRRMCPGYSLGLKVIQVSLANLLHGFEWSLPDGVELSMEEIFGLSTPRKFPLEAVVEPKLPAHLYVEA

SEQ ID NO: 10580 - protein, 518 aa, Avena sativa
MELPQWASFVGIVVATVLFLKVVLGRRSRKYNLPPGPKAWPIIGNLNLIGTLPHRSIHALAKQYGPLVQLQFGSFPVVVGSSVEMAKFFLKTHDVVFTDRPKTAAGKHTTYNYCDITWSPYGAYWRQARKMCLTELFSAKRLESYEYIRREEVLALLRDLHRGAATAGAGRALVLKDYLSTVSLNVITRMVMGKKYLEKEVRDETGAVITTPDEFKWMIDELFLLNGVLNIGDSIPWLDWLDLQGYIKRMKKLSKMFDRFLEHVVEEHSERRRCNGESFVAKDMVDVLLQFASDPNLEVKLNREGVKAFTQDLIAGGTESSAVTVEWALSELLKKPEVFAKATEELDSVIGRGRWVTEKDIPSLPYIEAIVKETMRLHPVAPMLVPRLSREDTSIGGYDIPAGTRVLVSVWSIGRDPELWDAPEEFMPERFLSSRLDVKGQDYELLPFGSGRRMCPGYSLGLKVIQVSLANLLHGFTWRLPNGVELSMEEIFGLSTPRKFPLEAIVEPKLPAHLYAET

SEQ ID NO: 10581 - protein, 516 aa, Festuca arundinacea
MEFPQWASFLGVVLATVLFLKAVLRRRSGRKYNLPPGPKAWPIIGNLNLMGTLPHRSIHALSKQYGPLLQLQFGSFPCVVGSSVEMAKFFLKTHDVSFTDRPKFASGKHTTYNYSDITWSPYGAYWRQARKMCLTELFSARRLRSYEYIRSEEVLALVRDLHRGATAGAGRALVLKDYLSTVSLNVITRMVMGKKYLEKEVRDESGAVITTPDEFKWMIDELFLLNGVLNIGDSIPWLDWMDLQGYIKRMKKLSKMFDRFLEHVVEEHSERRRRDGESFVAKDMVDVLLQFASNPNLEVKLNREGVKAFTQDLIAGGTESSAVTVEWALSELLKKPEVFARATEELDRVVGRGRWITEKDMPSLPYVDAIVKETMRLHPVAPMLVPRLSREDTTIGGYDIPAGTRVLVSVWSIGRDPELWEAPEEFMPERFIGSRLDVKGQDYELLPFGSGRRMCPGYSLGLKVIQVSLANLLHGFEWKLPDGVELNMEEIFGLSTPRKFPLEAVVEPKLPAHLYE

SEQ ID NO: 10582 - protein, 514 aa, Oryza sativa
MELMLPPWASFVGVVLATVLFLKAVLGRSRRVYNLPPGPKPWPVIGNLNLVGTLPHRSIHNLSKKYGPLMYLRFGSFPVVVGSSVEMAKFFLKTHDVVFTDRPKTAAGKHTTYNYSDITWSPYGAYWRQARKMCLTELFSAKRLESYEYIRGEEVRALLRDLHGAAGGVVVLKDYLSTVSLNVITRMVLGKKYLDKDAGGSVTTPEEFKWMLDELFLLNGVLNIGDSIPWLDWLDLQGYIKRMKKLGKMFDRFLEHVVDEHNERRRREGESFVAKDMVDVLLQFADNPNLEVKLKREGVKAFTQDLIAGGTESSAVTVEWALSELLKKPEVFAKATEELDRVVGRGRWVTEKDVPSLTYVDAIVKETMRLHPVAPMLVPRLSREDTSVDGYDIPAGTRVLVSVWTIGRDPKLWDAPEEFMPERFIGNKIDVKGQDFELLPFGSGRRMCPGYSLGLKVIQLSLANLLHGFAWRLPDGVTREQLSMEEIFGLSTPRKFPLEAVVEPKLPAHLYAAA

SEQ ID NO: 10583 - protein, 519 aa, Panicum virgatum
MELPPWAAFLGVVLATVMLLKAVLGRRGRRAYNLPPGPKPWPIIGNLDLMGALPHRSIHELSRKYGPLMQLRFGSFPVVVGSSVDMAKFFLKTHDVMFTDRPKTAAGKYTTYNNRDITWSPYGAYWRQARKMCLTELFSAKRLESYEYIRTAEVQALLRDLHAASGTGRAVMLKDYLSTVSLNVITRMVLGKKYLDKEVVAGGSSVTTPEEFKWMLDELFLLNGVLNIGDSIPWLDWMDLQGYIRRMKKISKMFDRFLEHVVEEHNQRRLREGKSFVAKDMVDVLLQIADDPTLEVELNRESVKAFTQDLIAGGTESSAVTVEWAISELLKKPEVIAKATEELDRVIGRSRWVTEKDIPQLPYVDAIVKETMRLHPVAPLLVPRLAREDATVDGYDIPAGTRVLVSVWSIGRDPALWDAPEEFMPERFLGSKLDVKGQDYELLPFGSGRRMCPGYSLGLKVIQVSLANLLHGFTWSLPNGMTKEELSMEEIFGLSTPRKFPLEAVVEPKLPAHLYAAEA

SEQ ID NO: 10584 - protein, 513 aa, Avena sativa
MELLHWASSFLGVMLATVVFLRAVLRRSKYNKLPPGPKAWPIIGNLNLMGTLPHRSIHELCKQYGPLTQLWFGSFPVVVGSSVEMAKFFLKTRDVVFTDRPKFAVGKYITYNYSNITWSPYGDYWRQARKIWLTELFSAKRLESYEYIRREEVLALLGDLHRGAAAGRGMVLKDYLSTMSLNVITRMALGRKYLGKEMMDLDLEEFKWMLDELFILSGVLNIGDSIPWLNWMDLQGYIKRMKKLSKMFDLFLENVVEEHCERRRRHDGDSFVAKDMVDVLLQLASDPGLEVKLTREGVKAFTLDLIAGGTETSSVTLEWALSELLKKPEVLAKATEELDRVIGRRRWVTEKDIASLPYTQGIVKETMRLHPVAPMLVPRLSRQDTSVGGYDIPAGTRVLVSVWSIGRDPELWDEPEEFMPERFLGSRIDVKGQDFQLLPFGSGRRMCPGYNLGLKVIEVSLANMLHGFEWRLPDGMAKEQLSMEEIFGLTIPRKYPLEAVLESKLPAHLYAHA

SEQ ID NO: 10585 - protein, 523 aa, Triticum aestivum
MELPPWAPFLGVALATVLFLEAVFRRSRQAYNLPPGPKPWPIIGNLNLMGALPHRSIHALSKRYGPLMYLRFGSFPVVIGSSVEMAKFFLKTHDMVFLDRPKMAAGKYTTYNYRDMTWSPYGAYWRQARKVCLTELFSAKRLDSYEYIRSEEMRALLRDLHEASRSRRAVVLKDYLSTLSLNVITRMVLGKKYLHREATDEGGSGSATTLAEFKRMVDEWFLLNGVLNIGDSIPWLDWMDLQGYIKRMKKLSKMFDQFLEHVVDEHNDRRRVEGESFVSKDMVDVLLEIARDPNLEVQIDRDSVKAFIQDLLVGGTESSAVAVEWAISELLKKPEVLAKATEELDRVVGRGRWVTEKDIPSLPYVEAIVKETLRLHPVAPMLTPRLSREEASVGGYDIPVGTRVFVNVWSIGRDPAVWTAPEEFTPERFLGSKMDVKGQDFELLPFGSGRRMCPGYSLGLKVIQASLANLLHGFAWRLPDGVATDELSMEETFGLSTPRKFPLEVVLKPKLLDHLYTAGHRTQ

SEQ ID NO: 10586 - protein, 367 aa, Sorghum bicolor
MGGAAMWAAALAATVVFLAVEVSGAAGALPRFAEAPEYRNGEGCPAAAAGVCDPGLVHIAMTLDAHYLRGSMAAVYSLLKHASCPESIFFHFLAAEADGEEDPEPELLRRAVAASFPSLRFEIYPFRAEAVAGLISASVRAALEAPLNYARNHLADLLPRCVPRAIYLDSDVLAADDVRRLWETRLPAAAVVAAPEYCHANLSRYFTPAFWSDPELGARVFAGRRRPPCYFNTGVMVIDLRRWRAGNYRQRIERWMEIQKVKRIYELGSLPPFLLVFAGEVEAVDHRWNQHGLGGDNVHGSCRPLHAGPVSLMHWSGKGKPWDRLDAGRPCPLDHTWKSYDLYIPSDSFGAASPASGPALSASVLSW

SEQ ID NO: 10587 - protein, 366 aa, Setaria italica
MRAGVAVAAAVFLAFAFSGAAAALPRFAEAPEYRNGEGCPAAAAGVCDPGLVHIAMTLDAHYLRGSMAAVYSLLKHASCPESIFFHFLAAEAGAAGGEGPEPEPELLRRAVAASFPSLRFEIYPFRAEAVAGLISASVRAALEAPLNYARNHLADLLPRCVPRAIYLDSDVLAADDVRRLWETRLPAAAVVAAPEYCHANFSRYFTPAFWSDPDLGARVFAGRRRPPCYFNTGVMVIDLRRWRAGNYRQRIERWMEIQKEKRIYELGSLPPFLLVFAGEVEAVDHRWNQHGLGGDNVHGSCRPLHDGPVSLMHWSGKGKPWDRLDAGRPCPLDHTWRLYDLYIPSDGSGAASPASGPALSASLFSW

SEQ ID NO: 10588 - protein, 356 aa, Brachypodium distachyon
MAGAVALLFLATAAAVLVSGGEAGAEALPRFAEAPEYRNGEGCPAAAAGVCDPGLVHIAMTLDAHYLRGSMAAIYSLLKHASCPESLFFHFMAAAPGDAELRRAVAASFPSLRFEIYPFRAEAVAGLISASVRAALEAPLNYARNHLADLLPPCVPRAIYLDSDVLAADDVRRLWETRLPAAAVVAAPEYCHANFSRYFTPAFWSDPELGARVFADRRRPPCYFNTGVMVIDLRRWRAGNYRRRIERWMEIQKDKRIYELGSLPPFLLVFAGEVEAVDLRWNQHGLGGDNVHGSCRPLHDGPVSLMHWSGKGKPWDRLDAGRPCPLDHTWKSYDLYIGGDGSSAATPASGPALSSW

SEQ ID NO: 10589 - protein, 359 aa, Avena sativa
MMAGAAAAAALIIFLAATAAVSGAELPRFAEAPQYRNGEGCPAAAAGVCDPGLVHIAMTLDAHYLRGSMAAIYSLLKHASCPESLFFHFLAADAPPGDITDLRRAVAASFPSLRFEIYPFRAEAVAGLISASVRAALDAPLNYARNHLADLLPPCVPRAIYLDSDVLAADDVRRLWETRLPAAAVVAAPEYCHANFSRYFTPAFWSDPELGTRVFAGRRRPPCYFNTGVMVIDLRRWRAGNYRRRIERWMEIQKEKRIYELGSLPPFLLVFAGEVEAVDLRWNQHGLGGDNVHGSCRPLHDGPVSLMHWSGKGKPWDRLDAGRPCPLDHTWKSYDLYIAGDGSGAASPASGPALSASWL

SEQ ID NO: 10590 - protein, 365 aa, Zea mays
MGAASPAMWAGLVLVVLLAASGPASAGLPRFAEAPEYRNGDGCPAPVTGAGVCDPGLVHIAMTLDAHYLRGSMAAIYSLLKHASCPESIFFHFLAAEGGGAPAVAELRAAVAASFPSLRFEIYPFRADAVAGLISASVRAALEAPLNYARNHLADLLPRCVPRAIYLDSDVLAVDDVRRLWETRLPAAAVVAAPEYCHANFSRYFTEAFWDDPVLGARVFAGRRRAPCYFNTGVMVIDLRRWRVGNYRQRIERWMEMQKEKRIYELGSLPPFLLVFAGEIEAVDHRWNQHGLGGDNVFGSCRPLHNGPVSLMHWSGKGKPWDRLDAGKPCPLDHTWKSYDLYIGENDSSPASGPSRSALSSLVAW

SEQ ID NO: 10591 - protein, 370 aa, Panicum virgatum
MGAASPAMWAGLVLAALLLAQSAAGALPRFAEAPEYRNGEGCPAPVAGAGVCDPGLVHIAMTLDAHYLRGSMAAIYSLLKHASCPESLFFHFLAAGGGGAPPVADLRAAVAASFPSLRFEIYPFRADAVAGLISASVRAALEAPLNYARNHLADLLPRCVPRAIYLDSDVLAVDDVRRLWETRLPAAAVVAAPEYCHANFSRYFTEAFWNDPVLGARVFAGRRRAPCYFNTGVMVIDLRRWRVGNYRQRIERWMEMQKEKRIYELGSLPPFLLVFAGEIEAVDHRWNQHGLGGDNVFGSCRPLHNGPVSLMHWSGKGKPWDRLDAGKPCPLDHTWKSYDLYIGENDSSASWQSRSSLSSSAALPAGVFSW

SEQ ID NO: 10592 - protein, 374 aa, Setaria italica
MGAATPAMWAGLVLAAMLLLAQSGPAAAAGLPRFAEAPEYRNGEGCLAPVAGAGVCDPGLVHIAMTLDAHYLRGSMAAIYSLLKHASCPESLFFHFLAAEGGGAPPVADLRAAVAASFPSLRFEIYPFRADAVAGLISASVRAALEAPLNYARNHLADLLPRCVPRAIYLDSDVLAVDDVRRLWETRLPAAAVVAAPEYCHANFSRYFTEAFWNDPVLGARVFAGRRRAPCYFNTGVMVIDLRRWRVGNYRQRIERWMEMQKEKRIYELGSLPPFLLVFAGEIEAVDHRWNQHGLGGDNVFGSCRPLHNGPVSLMHWSGKGKPWDRLDAGKPCPLDHTWKSYDLYIGENDSSASGQSRSALSSSAALPAAVFSW

SEQ ID NO: 10593 - protein, 369 aa, Panicum virgatum
MGAASPAMWAGLVLAALLLAQSAAALPRFAEAPEYRNGEGCPAPVAGAGVCDPGLVHIAMTLDAHYLRGSMAAIYSLLKHASCPESLFFHFLAAEGGGAPAVADLRAAVATSFPSLRFEIYPFRADAVAGLISASVRAALEAPLNYARNHLADLLPRCVPRAIYLDSDVLAVDDVRRLWETRLPAAAVVAAPEYCHANFSRYFTEAFWNDPVLGARVFAGRRRAPCYFNTGVMVIDLRRWRVGNYRQRIERWMEMQKEKRIYELGSLPPFLLVFAGEIEAVDHRWNQHGLGGDNVIGSCRPLHNGPVSLMHWSGKGKPWDRLDAGKPCPLDHTWKSYDLYIGENDSSASGQSRSALSSSAALPAGVFSW

SEQ ID NO: 10594 - protein, 368 aa, Sorghum bicolor
MGAPSPAMWAGLVLVALLAASGPAATAAAGLPRFAEAPEYRNGEGCPAPVAGAGVCDPGLVHIAMTLDAHYLRGSMAAIYSLLKHASCPESLFFHFLAAEGGGAPAVADLRAAVSASFPSLRFEIYPFRADAVAGLISASVRAALEAPLNYARNHLADLLPRCVPRAIYLDSDVLAVDDVRRLWETRLPAAAVVAAPEYCHANFSRYFTEAFWNDPVLGARVFAGRRRAPCYFNTGVMVIDLRRWRVGNYRQRIERWMEMQKEKRIYELGSLPPFLLVFAGEIEAVDHRWNQHGLGGDNVFGSCRPLHNGPVSLMHWSGKGKPWDRLDAGKPCPLDHTWRSYDLYIGENDSSSASGPSRSALSSSAAW

SEQ ID NO: 10595 - protein, 367 aa, Setaria italica
MWAGLVLAAMLLLAQSGPAAAAGLPRFAEAPEYRNGEGCLAPVAGAGVCDPGLVHIAMTLDAHYLRGSMAAIYSLLKHASCPESLFFHFLAAEGGGAPPVADLRAAVAASFPSLRFEIYPFRADAVAGLISASVRAALEAPLNYARNHLADLLPRCVPRAIYLDSDVLAVDDVRRLWETRLPAAAVVAAPEYCHANFSRYFTEAFWNDPVLGARVFAGRRRAPCYFNTGVMVIDLRRWRVGNYRQRIERWMEMQKEKRIYELGSLPPFLLVFAGEIEAVDHRWNQHGLGGDNVFGSCRPLHNGPVSLMHWSGKGKPWDRLDAGKPCPLDHTWKSYDLYIGENDSSASGQSRSALSSSAALPAAVFSW

SEQ ID NO: 10596 - protein, 366 aa, Zea mays
MGAASPAMWAGLVLVALLAVSGPAVAAGLPRFAEAPEYRNGEGCPAPVAGAGVCDPGLVHIAMTLDAHYLRGSMAAIYSLLKHASCPESLFFHFLAAAEGGGAPAASGLRAVVAASFPSLSFEIYPFRADAVAGLISASVRAALEAPLNYARNHLAGLLPRCVPRAIYLDSDVLAVDDVRWLWETRLPAAAVVAAPEYCHANFSRYFTDAFWDDPVLGARVFAGRRRAPCYFNTGVMVIDLRRWRVGNYRQRIERWMEMQKEKRIYELGSLPPFLLVFAGEIEAVDHRWNQHGLGGDNVFGSCRPLHNGPVSLMHWSGKGKPWDRLDAGKPCPLDHTWKAYDLYIGENDSSSSGPSRSALSSLAAW

SEQ ID NO: 10597 - protein, 372 aa, Brachypodium distachyon
MRAGWVLVAFILAASGPGAAVVALPRFAEAPEYRNGDGCPAAVAGAGVCDPGLVHIAMTLDAHYLRGSMAAIYSLLKHASCPESLFFHFLAAADGGGPGAGAPEVGELRSALAASFPSLRFEIYPFRADAVTGLISASVRAALEAPLNYARNHLADLLPRCVPRAIYLDSDVLAVDDVRRLWETRLPAAAVVAAPEYCHANFSRYFTDAFWSDPDLGARVFAGRRRAPCYFNTGVMVIDLRRWRSGNYRHRIEQWMELQKEKRIYELGSLPPFLLVFAGEVEAVDHRWNQHGLGGDNVLGSCRPLHKGPVSLMHWSGKGKPWDRLDAGRPCPLDHTWKSYDLYVDDGDASSASAPSRTSLSSSALPAAVFSW

SEQ ID NO: 10598 - protein, 367 aa, Oryza sativa
MRAGLALVVVVVAVVVGDVGAALPRFAEAPEYRNGEGCPAAVAGAGVCDPGLVHIAMTLDAHYLRGSMAAIYSLLKHASCPESIFFHFLAAADGGEGCGGGVGELRTAVAASFPSLRFEIYPFRADAVTGLISASVRAALEAPLNYARNYLADLLPKCVPRAIYLDSDVLAVDDVRRLWETRLPAAAVVAAPEYCHANFSRYFTETFWSDPQLGDRVFAGRRRAPCYFNTGVMVIDLRRWRVGNYRRRIEVWMELQKEKRIYELGSLPPFLLVFAGEVEAVDHRWNQHGLGGDNVLGSCRPLHKGPVSLMHWSGKGKPWDRLDAGKPCPLDHTWKSYDLYIAEGDSSSASAPFALSSSALPAAAFSW

SEQ ID NO: 10599 - protein, 363 aa, Avena sativa
SWLGGSWPAIGAGVVGGGRRLPRFAEAPEYRNGEGCPAPVAGAGVCDPGLVHIAMTLDAHYLRGSMAAIYSLLKHASCPESLFFHFLAADAAAPGVGELRSALAASFPSLRFEIYPFRADAVTGLISASVRAALEAPLNYARNYLADLLPKCVPRAIYLDSDVLAVDDVRRLWETRLPAAAVVAAPEYCHANFSRYFTDAFWSDPELGARVFAGRRRAPCYFNTGVMVIDLRRWRSGNYRHRIEQWMELQKEKRIYELGSLPPFLLVFAGEVEAVDHRWNQHGLGGDNVLGSCRPLHKGPVSLMHWSGKGKPWDRLDAGRPCPLDHTWKSYDLYVDQGDASSASAPSLTSLSSSALPAAVFSW

SEQ ID NO: 10600 - protein, 317 aa, Sorghum bicolor
MAATATATAMAIATISPSAPIPSAPFPSLPLRLRSQPLLAASRRLLLPVPKASSWDESVAEEGGDTEESAAAGDEEDEDEKPRPEPVSSSEFQFAAPPEGYVEPAAFDELPPESPEDVAAAYESLYGPAFSGESLLGNNVYEVKVVDPIDMDREQRPNDDFTERVVQVNRVTKVVKGGRQLSYRAIVVVGDMKGHVGVGVGKAKEVTEAITKAAMNGRRNLVTVPLTKYSTFPHRADADYGAARVMLRPACPGSGVIAGGAVRVVLEMAGVENALGKQLRSKNPLNNARATIKATQMMKQFKDVAEERGVPMEELWK

SEQ ID NO: 10601 - protein, 321 aa, Panicum virgatum
MAATATMAMATISPTTPIPTAPFPSLPLGFRLLPQPLLLSASRRLLLVPVPRASSWDESAPEEEGEAEESEQSSAAGDEEDEDEKPRPEPVSSAEFQFAAPPEGYVEPAAFDELPPESPEDVAAAYESLYGPAFSGETVLGNNVFEVKVVDPIDMDREQRPNDDFSERVVQVNRVTKVVKGGRQLSYRAIVVVGDMKGHVGVGVGKAKEVTEAITKAAMNGRRNLVTVPLTKYSTFPHRADADFGAARVMLRPACPGSGVIAGGAVRVVLEMAGVENALGKQLRSKNPLNNARATIKATQMMRQFKDVSEERGIPMEELWK

SEQ ID NO: 10602 - protein, 329 aa, Panicum virgatum
MAATASTATAVAMATISPTTPIPTAPFPSLPLGFRFRLRPQPLLLSASRRLLLVPVPRASSWDESGPEEEGEAEESEESAAAGDEEDEDEDEKPRPEPVSSAEFQFAAPPEGYVEPAAFDELPPESPEDVAAAYESLYGPAFSGETVLGNNVFEVKVVDPIDMDREQRPNDDFSERVVQVNRVTKVVKGGRQLSYRAIVVVGDMKGHVGVGVGKAKEVTEAITKAAMNGRRNLVTVPLTKYSTFPHRADADFGAARVMLRPACPGSGVIAGGAVRVVLEMAGVENALGKQLRSKNPLNNARATIKATQMMRQFKDVSEERGIPMEELWK

SEQ ID NO: 10603 - protein, 327 aa, Setaria italica
MAATASTATAMAMATVSPTTPTPTAPFPSLPLAFRLRPQPLNPLLIRLLLLPVPKVSSWDESAPGEEGEAEDSEESGAAAGDEDEDEEDEKPRPEPVSSAEFQFAAPPEGYVEPAAFDELPPESPEDVAAAYESLYGPAFSGETVLGNNVFEVKVVDPVDMDREQRPNDEFSERVVQVNRVTKVVKGGRQLSYRAIVVVGDMKGHVGVGVGKAKEVSEAITKAAMNGRRNLVTVPLTKYSTFPHRADADFGAARVMLRPACPGSGVIAGGAVRVVLEMAGVENALGKQLRSKNPLNNARATIKATQMMRQFKDVADERGIPMEELWK

SEQ ID NO: 10604 - protein, 327 aa, Setaria italica
MAATASTATAMAMATVSPTTPTPTAPFPSLPLAFRLRPQPLTPLRLRLLLLPVPKVSSWDESAPGEEGEAEDSEESGAAAGDEDEDEEDEKPRPEPVSSAEFQFAAPPEGYVEPAAFDELPPESPEDVAAAYESLYGPAFSGETVLGNNVFEVKVVDPVDMDREQRPNDEFSERVVQVNRVTKVVKGGRQLSYRAIVVVGDMKGHVGVGVGKAKEVSEAITKAAMNGRRNLVTVPLTKYSTFPHRADADFGAARVMLRPACPGSGVIAGGAVRVVLEMAGVENALGKQLRSKNPLNNARATIKATQMMRQFKDVADERGIPMEELWK

SEQ ID NO: 10605 - protein, 326 aa, Oryza sativa
MAATSSTASAMAVAATSPTIATAPFSSLPLCLRLRPKPLLFTSRLLLPVPKSSSWVESVSEEGEEEGVEEDSEESGAAGEDDDGEDNDEKPRPEPVAASGFEFASPPEGYVEPAPFDELPPESPEDVAAAYEALYGPAFSGETVMGNNVFEVKVVDPVDMDREQRPSDEFSERVVQVNRVTKVVKGGRQLSFRAIVVVGDMKGHVGVGVGKAKEVTEAITKAAMNGRRNLVTVPLTKYSTFPHRADADYGAARVMLRPACPGSGVIAGGAVRVVLEMAGVENALGKQLRSKNPLNNARATIKATQMMRQFKDVAAERGLPMEQLWK

SEQ ID NO: 10606 - protein, 368 aa, Sorghum bicolor
MGRASAATVLVALAVLALAVMAQATCDDELPAQLAGNFSGLACAPVWNNFVLRYAQGKDNVLRVVLSTMYSTGWVGMGFSKNGLMVGSSAMVGWMGKTGVPHIKPFSLEGKTPSKVVADQGFLASSDHHKPTVLVQQAKIYLAFQLSFTEPLKSQNVLFAIGSAIPVNDHLSEHQDKTAIVFDFTTGSASSSSSFPDGLKRTHGALNLFAWGVLLPIGAIVARYCRRWDPLWFYLHAGIQFVGFILGLAGVVAGVSLYNKIQADVPAHRGLGIFVLVLGILQILAIFLRPNKDSKYRKFWNWYHHWVGRLALFFAAINIVLGIKVGGAGNSWKIGYGFNLAILLITIITLEVLLWTRWKNNSGSTGAY

SEQ ID NO: 10607 - protein, 366 aa, Panicum virgatum
MGRASVGALLVALAVLAPAATAQSCGDELPTQLVGNYSGLACAPVWNNFVLRYAQDRDNVLRVVLSTMYSTGWVGMGFSKDGLMVGSSAMVGWMGKTGVAHIKQFSLQGKVPSQVVVDKGSLVSNDHDHTVLVQQAKIYLAFQLRFTAPLKRQNVLLAIGSAIPVNDRLSEHQDKTSITFDFTTGSSSSGSSFQEGLKRTHGALNLFAWGVLLPIGAIVARYCRRWDPLWFYLHAGIQFVGFILGLAGIVAGVSLYNKIQANVPTHRGLGIFVLVLGILQILAIFLRPNKDSKYRKFWNWYHHWVGRLALFFAAINIVVGIKVGGAGSSWKVGYGFNLAVLLITIIALEVLLWTRWRNNSSSTTAY

SEQ ID NO: 10608 - protein, 372 aa, Oryza sativa
MARAGAVLVVVLAAASVLLAPWAATAQTSSCDDALPPALAGNYSGLACRPVWNNFVLRYAQGKDNVLRVVISSMYSTGWVGMGFSKDGMMVGSSAMVGWVGKTGLSHVKQFSLRGKTPSQVVADEGFLQSKDHDHTVVVQQAKIYLAFQLRFQSPLRRQQVLLAFGNAIPVNDRLTEHQGKTSFTFDFTTGSSSGSSYPDGLKRAHGALNLFAWGVLLPIGAIIARYCRRWDPLWFYLHAGIQLVGFILGLAGIVAGVSLYNKIQADVPAHRGLGIFVLVLGILQILAFFLRPHKDSKYRKYWNWYHHWVGRLALFFAAINIVLGIKVGAAGNSWKIGYGFNLAILLITIITLEVLLWTRWKNNNSSSMPTY

SEQ ID NO: 10609 - protein, 227 aa, Zea mays
MATSAALSTAANPTQLCRSRAALGKPVKGLGLGMGRERASQRSITCQAASSIPADRVPDMEKRKLMNLLLLGAISLPTVGMVVPYGAFFVPAGSGNGGGGTYAKDKLGNDITVEEWLNTHGPNDRTLAQGLKGDPTYLVVEQDKTLATYGINAVCTHLGCVVPWNGAENKFICPCHGSQYNNQGKVVRGPAPLSLALVHADVDDGKVLFVPWVETDFRTGQDPWWSA

SEQ ID NO: 10610 - protein, 226 aa, Sorghum bicolor
MATTAALSTAANPTHQLCRSRATLGKPVKGLGLGMGRERAQSITCQAASSIPADRVPDMEKRKLMNLLLLGAISLPTVGMVVPYGAFFVPAGSGGAGGGTYAKDKLGNDITVDEWLKTHGPNDRTLAQGLKGDPTYLVVEQDKTLATYGINAVCTHLGCVVPWNGAENKFICPCHGSQYNNQGKVVRGPAPLSLALVHADVDDGKVLFVPWVETDFRTGEDPWWKA

SEQ ID NO: 10611 - protein, 225 aa, Saccharum officinarum
MATSAALSTAANPTQLCRSRATLGKPAKGLGPGMGRERAQSITCQAASSIPADRVPDMEKRKLMNLLLLGAISLPTVGMVVPYGAFFVPAGSGGAGGGTYAKDKLGNDITVDEWLKTHGPNDRTLAQGLKGDPTYLVVEQDKTLATYGINAVCTHLGCVVPWNSAENKFICPCHGSQYNNQGKVVRGPAPLSLALVHADVDDGKVLFVPWVETDFRTGEDPWWKA

SEQ ID NO: 10612 - protein, 221 aa, Avena sativa
MASTALSTASNPTQLCRSRAHVCKPVKGLGLGRERIPRNITCMAGSISADRVPDMSKRETMNLLLLGAISLPTFGMLVPYGSFLVPAGSGSNAGGVVAKDKLGNDILVSEWLNTHGPNDRTLAQGLKGDPTYLVVESDKTLATYGVNAVCTHLGCVVPWNAAENKFLCPCHGSQYNNQGKVVRGPAPLSLALVHADVDDGKVVFVPWVETDFRTGENPWWK

SEQ ID NO: 10613 - protein, 221 aa, Avena sativa
MASTALSTASNPTQLCRSRAHVCKPVKGLGIGRERIPRNITCMAGSISADRVPDMSKRETMNLLLLGAISLPTFGMLVPYGSFLVPAGSGSNAGGVVAKDKLGNDILVSEWLNTHGPNDRTLAQGLKGDPTYLVVESDKTLATYGVNAVCTHLGCVVPWNAAENKFLCPCHGSQYNNQGKVVRGPAPLSLALVHADVDDGKVVFVPWVETDFRTGENPWWK

SEQ ID NO: 10614 - protein, 214 aa, Avena sativa
TASNPTQLCRSRAHVCKPVKGLGLGRERIPRNITCMAGSISADRVPDMSKRETMNLLLLGAISLPTFGMLVPYGSFLVPAGSGSNAGGVVAKDKLGNDILVSEWLNTHGPNDRTLAQGLKGDPTYLVVESDKTLATYGVNAVCTHLGCVVPWNAAENKFLCPCHGSQYNNQGKVVRGPAPLSLALVHADVDDGKVVFVPWVETDFRTGENPWWK

SEQ ID NO: 10615 - protein, 507 aa, Triticum aestivum
MAVAAPGQLNLDEFPSWGSRGVDCFEKLEQIGEGTYGQVYMAKETETNEIVALKKIRMDNEREGFPITAIREIKILKKLHHQNVIQLKEIVTSPGPDRDEQGKPIDGNKYKGSIYMVFEYMDHDLTGLADRPGMRFTVPQIKCYMKQLLTGLHYCHVNQVLHRDIKGSNLLIDNEGNLKLADFGLARSFSSDHNGNLTNRVITLWYRPPELLLGSTRYGPAVDMWSVGCIFAELLNGKPILPGKNEPEQLTKIFELCGTPDELIWPGVTKMPWYNNFKPPRVLKRKVKDAFKHFDRHALDLLERMLTLDPSQRIPAKEALDAEYFWTDPLPCDPKSLPSYEASHEFQTKKKRQQQRQAEEAAKRQKINHPPPHSRLPPIQHPGQSHQIRPGHAPPVAGGSSHYAKPRGPGGPNRYPQGGNQGAGYNNPNRGGQGSGYGSAPYPQQGRGPPPFPAAGAPRGGAGSGYGVGGPNYPPGGPPYGTSGPGRGGPNYPQGGSRNQQQYGSWQ

SEQ ID NO: 10616 - protein, 360 aa, Brachypodium distachyon
MAAPSHHALLPFLSSTASPRTAPSAGRRRLLRCAAAAGQAGFFTRLGRLIKEKAKSDVDKLFSGFSKTRESLSVVDELLTYWNLADTDRVLDDLEEALLVSDFGPKISFRIVDTLRDEIRDGKLKSGPEIKASLKRCILQLLTSKGSNTELQLGFRKPAVIMIVGVNGGGKTTSLGKLAYRFKNEGVKVLMAAGDTFRAAARDQLEIWAERTGSEIVIDNDKKAQAPSVLSQAVKRGKREGFDVVLCDTSGRLHTNYGLMEELVSCKKVIAKALPGAPNEILLVLDGTTGLNMLQQAREFNDVVGITGFILTKLDGTARGGCVVSVVDELGIPVKFVGIGEGVEDLQPFDAEAFVEAIFP

SEQ ID NO: 10617 - protein, 361 aa, Avena sativa
MAAPSHVVPFLSPSSAYASLRAPSGRPAASHLRCAAAAGQAGFFTRLGRLIKEKAKSDVDKLFSGFSKTRENLSVVDELLTYWNLADTDRVLDDLEEALLVSDFGPKISFRIVDTLRDEIRDGKLKSGAEIKASLKRCILELLTSKGSNTELKLGFRKPAVIMIVGVNGGGKTTSLGKLAYRFKNEGAKVLMAAGDTFRAAARDQLEVWAERTGSEIVIDKDKKAQAPSVLSQAVKRGKREGFDIVLCDTSGRLHTNYGLMEELVTCKKVMAKALPGAPNEVLLVLDGTTGLNMLQQAREFNDVVGITGFILTKLDGTARGGCVVSVVDELGIPVKFVGVGEGVEDLQPFDAEAFVEAIFP

SEQ ID NO: 10618 - protein, 360 aa, Setaria italica
MAAPSHVLPFLSPASTASSVRVSPGRRSGLLRCAAAAGQAGFFTRLGRLIKEKAKSDVEKLFSGFSKTRENLSVVDELLTYWNLADTDRVLDELEEALLVSDFGPKISFRIVDTLREEIRDGKLKSGPEIKASLKRCILELLTSKGGNPELNLGFRKPAVIMIVGVNGGGKTTSLGKLAHRFKNEGVKVLMAAGDTFRAAARDQLEVWAERTGSEIVIDNDKKAQPPAVLSQAVKRGKREGFDVVLCDTSGRLHTNYGLMEELVSCKKVIAKALPGAPNEILLVLDGTTGLNMLQQAREFNDVVGVTGFILTKLDGTARGGCVVSVVDELGIPVKFIGVGEGMEDLQPFDAEAFVEAIFP

SEQ ID NO: 10619 - protein, 358 aa, Panicum virgatum
MAAPSHVLPFLSPTATGTASSVRASPARLRCAAAAGQAGFFTRLGRLIKEKAKSDVEKLFSGFSKTRENLSVVDELLTYWNLADTDRVLDDLEEALLVSDFGPKISFRIVDTLRGEIRDGKLKSGAEIKAALKRCILQLLTSKGGNSELNLGFRKPSVIMIVGVNGGGKTTSLGKLAHRFKNEGVKVLMAAGDTFRAAARDQLEVWAERTGSEIVIDNDKKAQPPAVLSQAVKRGKREGFDVVLCDTSGRLHTNYGLMEELVSCKKVIAKALPGAPNEILLVLDGTTGLNMLQQAREFNDVVGVTGFILTKLDGTARGGCVVSVVDELGIPVKFIGVGEGMEDLQPFDAEAFVEAIFP

SEQ ID NO: 10620 - protein, 360 aa, Panicum virgatum
MAAPSHVLPFLSPVGAASSARAGPGRRAGLLRCAAAAGQAGFFTRLGRLIKEKAKSDVEKLFSGFSKTRENLSVVDELLTYWNLADTDRVLDELEEALLVSDFGPKISFRIVDTLREEIRDGKLKSGAEIKASLKRCILQLLTTKGGNSELNLGFRKPSVIMIVGVNGGGKTTSLGKLAHRFKNEGVKVLMAAGDTFRAAARDQLEVWAERTGSEIVIDNDKKAQPPAVLSQAVKRGKREGFDVVLCDTSGRLHTNYGLMEELVSCKKVIAKALPGAPNEILLVLDGTTGLNMLQQAREFNDVVGVTGFILTKLDGTARGGCVVSVVDELGIPVKFIGVGEGMEDLQPFDAEAFVEAIFP

SEQ ID NO: 10621 - protein, 366 aa, Sorghum bicolor
MAAPSHVLPFLSPAGGCAASSARARSHSHSGRRAGILRCSAAAGQAGFFTRLGRLIKEKAKSDVEKLFSGFSKTRENLSVVDELLTYWNLADTDRVLDDLEEALLVSDFGPKISFRIVDTLREEIRDGKLKSGAEIKAALKRCILELLTSKGGNSELNLGFRKPAVIMIVGVNGGGKTTSLGKLAYRFKNEGVKVLMAAGDTFRAAARDQLEVWAERTGSEIVIDNDKKAQPPAVLSQAVKRGKREGFDVVLCDTSGRLHTNYGLMEELVSCKKVLAKALPGAPNEILLVLDGTTGLNMLQQAREFNDVVGVTGFILTKLDGTARGGCVVSVVDELGIPVKFIGVGEGMEDLQPFDAEAFVEAIFP

SEQ ID NO: 10622 - protein, 363 aa, Oryza sativa
MAAHSHVIPFLSPAATSARCSPYGHRRRGRAGLLRCAAAAGQAGFFTRLGRLIQEKAKSDVEKLFSGFSKTRESLSVVDELLTYWNLADTDRVLDELEEALLVSDFGPKISFRIVDTLREEIRDGKLKSGAEIKEALKRCILELLTSKGGNPELQLGFRKPAVIMIVGVNGGGKTTSLGKLAYRFKNEGVKVLMAAGDTFRAAARDQLEVWAERTGSEIVIDNDKKAKPASVLSQAVKRGKREGFDLVLCDTSGRLHTNYGLMEELVSCKKVIAKALPGAPNEILLVLDGTTGLNMLQQAREFNDVVGVTGFVLTKLDGTARGGCVVSVVDELGIPVKFIGVGEGMEDLQPFDAEAFVEAIFP

SEQ ID NO: 10623 - protein, 324 aa, Festuca arundinacea
MAAPPHVLPFLSPSSASASLRAPSGRRRAAGLRCAAAAGQAGFFTRLGRLIKEKAKSDVDKLFSGFSKTRENLSVVDELLTYWNLADTDRVLDDLEEALLVSDFGPKISFRIVDTLRDEIRDGKLKSGSEIKASLKRCILELLTSKGSNTELKLGFRKPAVIMIVGVNGGGKTTSLGKLAHRFKNEGAKVLMAAGDTFRAAARDQLEVWAERTGSEIVIDKDKKAQAPSVLSQAVKRGKREGFDIVLCDTSGRLHTNYGLMEELVTCKKVMAKALPGAPNEVLLVLDGTTGLNMLQQAREFNDVVGITGFILTKLDGTARGGCV

SEQ ID NO: 10624 - protein, 331 aa, Avena sativa
TSAARPPPGRPASSLASAASSRRRPRATSTSSSPASPRPRENLSVVDELLTYWNLADTDRVLDDLEEALLVSDFGPKISFRIVDTLRDEIRDGKLKSGAEIKASLKKCILELLTSKGSNTELKLGFRKPAVIMIVGVNGGGKTTSLGKLAYRFKNEGAKVLMAAGDTFRAAARDQLEVWAERTGSEIVIDKDKKAQAPSVLSQAVKRGKREGFDIVLCDTSGRLHTNYGLMEELVTCKKVMAKALPGAPNEVLLVLDGTTGLNMLQQAREFNDVVGITGFILTKLDGTARGGCVVSVVDELGIPVKFVGVGEGVEDLQPFDAEAFVEAIFP

SEQ ID NO: 10625 - protein, 227 aa, Triticum aestivum
MDPGAHARCLAVHQHCYHYTIPGINIDFAAHKYFLSKDYLELVWSKLKLQRRILELGYGFLFTDVDIVWLRDPFKHVTAYADMTVSSDVYFGDPDNLGNFPNTGFFHVKPNARTIAMTKLWHGGRGKYPGANEQPVFNMMKKQMVAELGLRVQYLNPAYVGGFCSYGKDLGKIVTMHANCCVGIGNKIRDLKGVLGDWRNYTRMPPWERHRAKWTVPGACIRAEKQV

SEQ ID NO: 10626 - protein, 412 aa, Leymus cinereus x Leymus triticoides
MGKMVVTEATARQVASFVLGAAAVLTVVMLVQYRAPAAGLSHARTPGHFSGLRSSSDDQHHRRNGTTARAVVHRAPPVAASAGDDHHRPANTTTITKPNSTSTAAALSHLPSTHRHEEKGAKEEAAEFRGLAAAVARAATDDRTVIITCVNQAWAAPGSLLDLFLESFRIGDGTARLLPHVLVVAMDPRAHARCLTVHRHCYHYTIPGLNIDFATHKYFLSKDYLELVWSKLKLQRRILELGYGFLFTDVDIMWLRDPLKHVTAYADMTVSSDVYFGNPDNLDNFPNTGFFHVKPNARTITMTKLWHGARGKYPGANEQPVFNLMKKRMVKKLGLRVRYLDPVYVGGFCRYGKDLGKIVTMHANCCVGIGNKIRDLKGVLDDWKNYTRLPHWEKHRAKWTVPGACIRAEKQV

SEQ ID NO: 10627 - protein, 488 aa, Setaria italica
MAREAHFGGDDAAAAKDKNAEADAGAASAATAAPGGGHKKLSLVPLIFLIFFEVAGGPYGAEPAVQSAGPLYALLGFLIFPFIWAIPEALVTAELSTAMPGNGGFVLWADRAFGPFSGSLMGTWKYVSGAINGAAFPALCADYLARVVPAVSGGGPRTATIVAFNVALTVVNYTGLTVVGWTAVGLGVASLSPFLLMSGVALPKIRPRRWAGVAPEKDWKLFFNTLFWNLNYWDSVSTMAGEVERPGKTLPKALVSAVTMTSLGYLLPLMAATGAIDVAPEDWGNGFFADAAGMIAGRWLKYWIEVGAVLSSIGLYSATLSSAAFQLLGMADLGLLPSAFATRAPVFNTPWVSIVTTSAITLGMSFFSFNNIVAAANFLYSLGMLLEFAAFIWLRIKRPDLSRPYRVPARLPGAVALCLVPSAFLVFVMAIAGWKVYAISAAFTAAGVGVYYLMRFCKERGCLRFSDGGDEGAAAAYHQRQGSRNGDV

SEQ ID NO: 10628 - protein, 389 aa, Panicum virgatum
MPGNGGFVLWADRAFGPFPGSLMGTWKYVSGAINGAAFPALCADYLARVVPAVGDGGPRVAAIVAFNVALSFLNYTGLTVVGWTAVGLGVASLSPFLLMSGVALPKIRPRRWRGVAKDKDWKLFFNTLFWNLNYWDSVSTMAGEVERPGKTLPKALVAAVSMTSLGYLLPLMAATGAVDVAPEDWGNGFFADAAGMIAGKWLKYWIEVGAVLSSIGLYSATLSSAAFQLLGMADLGLLPRVFAVRAPVFNTPWVSIVATSAITLGMSFFSFNNIVAAANFLYSLGMLLEFAAFIWLRVKRPDLPRPYRVPARLPGAVALCLVPSAFLVFVMAIAGWKVYAISAAFTAAGVGVYYLMRLCKARGCLSFSEGGGDEGAPAYQRQGSRNGDV

SEQ ID NO: 10629 - protein, 373 aa, Sorghum bicolor
MELDEEAFLDELMSLRREAAASSAPWQQADPCSAYPGAGGGGGGMMMSDLLFYGGTTEGAAADATSMDLSPFHQEPLQAPMPPAAARTPLPPPHPHEEFNFDCLSEVCNPYRSGGGGVAVPGAEAVAVPGHKQALAALHDAMVEEETSGDLDLQGQQHYGGGGSPTFVFGGGARGESSEMPIVRGVGGPHHHRSKLHGAPSKNLMAERRRRKRLNDRLSMLRSIVPKISKMDRTSILGDTIDYVKELTERIKVLEEEIGASPEDLDLLNTLKDSSSCSNEMMVRNSTKFDVEKRGNGSTRIEICCPTNPGVLLSTVSALEVLGLEIEQCVVSCFSDFAMQASCSQEDGKRQVLSTDEIKQALFRSAGYGGRCL

SEQ ID NO: 10630 - DNA, 2000 bp, Wheat SPA Promoter
ttttctcttgcgagagccgctcacctcaaggccccccgccattcctgctgtgaactatagccagcggctggggatgatacaagcaggggcaaccaacgaccaccggagttgccacggttgtcactgatgttgcggtggcgccaccatgaagaccatgtccatgcggtggttggtgcagtttccagcggtgctacaaccgcggaacactaatgctgcaaccggtagcaggagctgttgcgaccgacgacgaaatttgctgccttgaggctgatggtaatggacaagacgagggcggacgccttggtgctacaaccagcatccggtgttgccggaacgacaaccgccatttgctgcaaccggcaatcatgcaacacagagaggaagataccgcgtgctgggatcggccgtcaccctgggcgcgacaaaaagctgcaaccattcgttggtaaagcttcaacctcctgatgaatttcctggaaccagtattcaattttgcttgaactggataattttttgctacaatcgatcaacgagagttcttgctggtaagttgtttttgctagaaccggtgttcaattttgctagaactatattttgctacaatcgatcaccccgagagttcttcttgatgagttgttttgctcgaaccagtattcaattctgctggaactgagtaattttttgcttcaaccaacaaatggtggatttgctgctttccaagttttttgttgggcacgactgtgcaagtcaacgatcgcggcggcgccgatggtgctccaaccatggtgaacgcgcgatggaaccagccgggccggagctgcaatggcctggttcccgagctatggacgcggcgtgcggtgactgcaagcttcagcagaagggtggcagggggctggatgatggtgctgcaaccagtagcggtgcaaggggacggggtgctgccgcccctcgatggagcgcacatgcatgggaccgagagcagagatgctcacggggaacaggaaggaggggatttcctgctcacgttgaccaaagcgagaggaaggagatgattcggtgaccgactacaaatcatcatatcaaacaattgggggccgaccggccaaaacgttcggtcggcgtgctagtggctaataatggcctaccggtatggaccacgttagtcaaatggtaagcgacgcatgtatataaggtatattaatgcgaccaactcgcaaggtccgtcacctatattcggagaacatatttctgtaatatataaatttaataggtaaagtcacatttatcattctcaaaagagggtggcccgtgtgaggaactcgtcctgagcaaagacgaggaggtttccactcaaccgttgtcactctagctatagtgtatattagaagttaagtgtttccgttaccttttcatatacaacaacaatttaaagttagaaaccctgtaaatcacatggaagcgtatggatcgcaacgagtcaaaataaacatggcgcattagtgacacgtattttaaactttctgttaacactttttgttctttcattaaaggatatttgtttgcattagcgttgtcatgctagacgagcacatacattacaacattattatgtgtttgttgtggtttctagagacaagacatgaacacctaaataaagaggacatggacgaaaaggttaaccgtaatagctcatgcaagatgacaagcaaaacatttcattgtatgaggttccgtggatcacacttctctatgtactctcagaaacgaaaacacttgtctagacgatggtagaccgtcggaataggtgaacatcttttgtacaacagaaagtatgactaacgtggcgccgcggccgaaactgcattatcagttcagctgaatttgtactgtatgtcatatctatctcgagtattcaagacagaaaaaccttgtgcagtagtagtactactgaaataaaatagacatgagaggatcgcaccctcaacccatctcattcagca

SEQ ID NO: 10631 - DNA, 1919 bp, Wheat LMW Longer Promoter
  misc_feature (1306)..(1316): n is a, c, g, or t
  misc_feature (1649)..(1649): n is a, c, g, or t
tatcatgatgacatttctatgtgctaaagattcttctacaaagccggttcaaatacaaaacaaatatgccaaaaaactacttaaattaccagtagcgagtgtacaaaagttagcagcagcgcctcaatagcagtagagcgtccggccaaagagcgctagcgctactagcggtagcgagcttctcataaccgcgctgctgctacacttgtgtagcagtagcgcgggtgctcacgcgttactgctatgagttagctgtagcgccgtattagtagcgcgggtacccgcactactgatacatctaaaacccgcgctgctgctagccttttccctagtagtgctagtcgatgtatctccccacaacctcacctctacaccggactacaaggaagtcttctgacggcgggaattgccgaagcacgcttgaccccacttgttcctcgccggacaaaagacatctagcgcggcataattcaaacgccacgctggaaccaatagtcgtagcggggcggtcaggaactgcgtcatctcgcttattaggcatgcttttcatatttttacttgcgaccctacagcacggttccgtgtcaatatcatagacttctagttgtggagttttgttttttcgtcgtcgacatgagaaatatatggtccacctgcttagcgcgcatagggggaaatttgatgattattggaacttttgaagtgaaattctcagaaagcacatagttatattcagctactaaagccacaaatgtacattactgtcaggcttcccagctgaattctgatgcctgaccctcctaatccgtgcagctagcatggagatgggtctgcctctcggatttatgtgcattgaatcgttggaagagacagacgaaacaaatcgataccttgtgttgatggggaggtcggagtggctgccgtcgacgtacggcccacaatcgacggaggagcttcaaaagtgaccttttttgtcgagcggtggtggtggtggtggggggccggatgttgagggtgggagggaggctgacgtctccgctgccgcggaggtacgtggaggggccgcgagcggtgggcgtccgggagaggctgcgacggcgagcggtccggccggcgaggaggacgaggaagggagggacgcagatccgcggagtgtgggctgggcttgtgtcgttggggcctacgagaactatagcccaaatcgaattggtgccctaacacacggcacttatgttgggcctaatctctcgctccaggctgggggcctctgttccagccccatctatcatttccccctagcgtcatnnnnnnnnnnnaaaaaaatccccctagcataaaaaaactatcatttcccccaaaaaaacccttcacaaatagatgaaactgatgatttatctaaaaaaataggcgaaactgatgatgacgtgtcaagagttaggaccggatatatgctagtaggagtagcttgtaagcaattaccatcctttacatgtaaagggaattcgatgagtcatgtcatgctctataggcgtcggttcatctaatcattttagaggaaaaatacaaagttagttctacacttagtcctacacaagttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 10632 - DNA, 326 bp, Wheat LMW Promoter
  misc_feature (56)..(56): n is a, c, g, or t
agttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 10633 - DNA, 2000 bp, Wheat HMW glutenin-1 longer Promoter
cctaccattagaagaacgtccggcaaagagatgcactgcaacatatgaccaaaacgtcatccatgatcgagtacaatttcttagtgcctttttcatcaaagttatatttgaaacattttagaaaatttgtcttaaattttttcccatggcgtttcgatcaaaaaaatgccttaaaacctacctatataaaggcaataagggaaaacacttcaggataccttcgaatctaaggtgtctttctttagatggtatgctaaactgttcttcatggcgcctcaaatcatcattctgcaagtaaagactaaaaataacgctaaatatggagttaaaggtttacaaacgacgagcggaaaaggagtcttatataattccagtagcatttattccattttgcttcacatagaaaatgtagctgaggtggtcgatgtttattttgactcgcgtgaggtcgccggttcgatctcagaagcaacgctggaatatcccatatagatttatttttcaggctgagtgatgctcgggtacctccagcgtatgggctgaaattcgccccccctgcaaatcatgggccctgtgacgttcgcacgggttgcacatgccttggcccgggcctactaggagtgtacctggattatgttggacgacgggagatgaaagggatgtattaattaacaaagataatgaagcttaattttcttatatgttgttaatattgacaagaaacaagctgctaactcaaagttacggttacatagtcgcaaccttttatatctaaataatatctctctctcaacatgcaaacatgccacctcagcatgtagcatgcatggaaattgtccacttcaacatgcaaccatgcatcaaaatttccattttactaggctatttatttgataaaatttcacaaatatacaataatcaaacacaatagatcatatgtgttttcagttttggttctcacattattactccaaatataaatgtttcgtataaccaaatttcattcaaatatactgcaaaacatttccgtgaaaacatgtggggtacatctagttataaggaaatattagtgatgtcctgcaagtgataaggccaaggagagaagaagtgcaccatctacagaggccagggaaagacaatggacatgcagagaggcgggggcggggaagaaacacatggagatcatagaagaacataagaggttaaacataggaggaggatataatggacaattaaatccacattacctgaactcatttgggaagtggaaaaatcccctattctggtgtaaatcaaactaattgacgcgagttttctctgaagattctatgttaattttagacatgaatgaccaaaggtttcagttagttgagttttgtcatcgaaaggtgtttacataagtccaaaaattctaccagcttttggtacggcgcgtcatagaacagataaatgttgtgagtcattggatagatattatgagtcatagcatggatttgtgttgcctggaaatctaactatgacaagaaacaaaacataaatgggcttttgaaagatgatttatcaacttaccttatccatgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 10634 - DNA, 425 bp, Wheat HMW glutenin-1 Promoter
catgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 10635 - DNA, 595 bp, wheat alpha gliadin (B genome) Promoter
tcaagcttgtctagttacagtaacaacttgtggaacattacaaaatttatgtttgctagtaacttctagaacactacaacacttgacatgtataaggaatttgatgagtcatggcctactaaagcaagttatattactactcttatctatcttaacaggtcacacaagattacaaactaagttctgtatcagccatgcttatctagtttatgcataacaatttgcagaacattacaaacttagtttcggaaaaataggcaatctagattagtgtttgagctataaagtgaataagatgagtcatgcgtgttatcacacctctttggtggtggaatgatagtgcaacaacatgaaacttcagtgactagtccaagaatacacatgtaagtagtgccaccaaacacaacataccaaattatgattttgggaagcatccaagcactttccagacaagaaaatgccaattgtgaaagagatcataccatgggaactataaaaagccttgtagcatgatcatcatccttcctcacccatcattctcataagtagagcgcatcattcaagccaagcaagcagtggtcaatacaaatccacc

SEQ ID NO: 10636 - DNA, 1238 bp, wheat gamma gliadin Promoter
  misc_feature (1231)..(1231): n is a, c, g, or t
atacttatatagggtagcgatattcacttgggaggtcggggttgtgctcggggaagcaggggcttgccggacgcaaggctcggacggcctccacgcctctgttccgtgaacagaggagatgggatcctccaagtgggcggggccacaatagtttatagtaggcccatgtgcacagcaggtcttccatattttccctttttatctcctgtaatatttccaccactctattgcatttagtttatgcagcaaacgacttttgctataactgaaacttggcacataaatcaagcacacaattttggggtggcacaaaaagtttggggccaaattgaaatcacttaaattataattgcatttaaaagagctaaaagggtgtcgttggtccacagtttaatattcataggcattttaaaagtttccagaaaaaactttgctaatgtatgacagttatgtagtgaatattttcaacctaaggaacatttttaatttattttttataaaattataattcgacttggcattcgaatttggatttgagttttggtttgaaacggaaagaggattagtaaaatgattatgatgacatagcatcattaggcatgagattactgtagcatgacatcgggggtgttacacttgtacaatattcctacccttgacataaaaggagaatttgatgagtcatgtattgataacgtatacaacattactacccttgacataaaaggagaatttgatgagtcatgcattgataacatgtacaagattactatcagcttgttcatcttaccatcatattatacaacactacaagttagttttagaaagaacaagagtccacaacaaatatcagaatacttgcctgatctatcttaacaacatgcacaaggacacaaatttagtcccccgcaagctatgaagatttggtttatgtctaacaacttgtacagatccaaaaggaatgcaatccagataattgtttgacatgtaaagtgaataagatgagtcaatgccaattatcagtattcctcactcttagatgatatgtacaataaaaagacaactttgatgatcactctgaaattacgtttgtatgtagtgccaccaaacacaacataccaaataattagtttgataagcatcaaatcacttttaaaaaagaaagcaataatgaaaagaaacctaaccatggtagctataaaaaggcctacaatatgtagactccataccnactccat

SEQ ID NO: 10637 - DNA, 2162 bp, wheat TdPR60 longer Promoter
agaagaagaaggagcaccaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 10638 - DNA, 2147 bp, wheat TdPR60 Promoter
accaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 10639 - DNA, 1992 bp, maize Ub1 Promoter (cultivar Nongda 105)
tctgcagtgcagcgtgacccggtcgtgcccctctctagagataatgagcattgcatgcctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgaccaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgaggcggcacggcaggcggcctcctcctcctctcacggcacggcagcctacgggggattcctttcccaccgctccttcgctttcccttcctcgcccgccgtaataaatagacaccccctccacaccctctttccccaacctcgtgttcgttcggagcgcacacacacacaaccagatctcccccaaatccacccgtcggcacctccgcttcaaggtacgccgctcatcctccccccccccctctctctaccttctctagatcggcgttccggtccatggttagggcccggtagttctacttctgttcatgtttgtgttagatccgtgtttgtgttagatccgtgctgctagcgttcgtacacggatgcgacctgtacatcagacatgttctgattgctaacttgccagtgtttctctttgaggaatcctgggatggctctagccgttccgcagacgggatcgatttcatgatttttttttgtttcgttgcatagggtttggtttgcccttttcctttatttcaatatatgccgtgcacttgtttgtcgggtcatcttttcatgttttttttggcttggttgtgatgatgtggtctggttgggcggtcgttctagatcggagtagaatactgtttcaaactacctggtggatttattaaagatctgtatgtatgtgccatacatcttcatagttacgagtttaagatgatggatggaaatatcgatctaggataggtatacatgttgatgcgggttttactgatgcatatacagagatgctttttttttcgcttggttgtgatgatgtggtctggttgggcggtcgttctagatcggagtagaatactgtttcaaactaactggtggatttattaattttggatctgtatgtgtgtgccatacatcttcatagttacgagtttaagatgatggatggaagtatcgatctaggataggtatacatgttgatgttggttttactgatgcatatacatgatggcatatgcagcatctattcattcatatgctctaaccttgagtacctatctattataataaacaagtatgttttataattattttgatcttgatatacttggatgatggcatatgcagcagctatatgtggattttttttagctctgccttcatacgctatttatttgcttggtactgtttcttttgtcgatgctcaccctgttgtttggtgttacttctgcag

SEQ ID NO: 10640 - DNA, 1358 bp, Ub1 Promoter (cultivar B73)
gtgcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaaatctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttc

SEQ ID NO: 10641 - DNA, 1266 bp, rice actin 1 Promoter
tagctagcatactcgaggtcattcatatgcttgagaagagagtcgggatagtccaaaataaaacaaaggtaagattacctggtcaaaagtgaaaacatcagttaaaaggtggtataagtaaaatatcggtaataaaaggtggcccaaagtgaaatttactcttttctactattataaaaattgaggatgttttgtcggtactttgatacgtcatttttgtatgaattggtttttaagtttattcgcgatttggaaatgcatatctgtatttgagtcggtttttaagttcgttgcttttgtaaatacagagggatttgtataagaaatatctttaaaaaacccatatgctaatttgacataatttttgagaaaaatatatattcaggcgaattccacaatgaacaataataagattaaaatagcttgcccccgttgcagcgatgggtattttttctagtaaaataaaagataaacttagactcaaaacatttacaaaaacaacccctaaagtcctaaagcccaaagtgctatgcacgatccatagcaagcccagcccaacccaacccaacccaacccaccccagtgcagccaactggcaaatagtctccacccccggcactatcaccgtgagttgtccgcaccaccgcacgtctcgcagccaaaaaaaaaaaaagaaagaaaaaaaagaaaaagaaaaacagcaggtgggtccgggtcgtgggggccggaaaagcgaggaggatcgcgagcagcgacgaggcccggccctccctccgcttccaaagaaacgccccccatcgccactatatacatacccccccctctcctcccatccccccaaccctaccaccaccaccaccaccacctcctcccccctcgctgccggacgacgagctcctcccccctccccctccgccgccgccggtaaccaccccgcccctctcctctttctttctccgttttttttttcgtctcggtctcgatctttggccttggtagtttgggtgggcgagagcggcttcgtcgcccagatcggtgcgcgggaggggcgggatctcgcggctggcgtctccgggcgtgagtcggcccggatcctcgcggggaatggggctctcggatgtagatcttctttctttcttctttttgtggtagaatttgaatccctcagcattgttcatcggtagtttttcttttcatgatttgtgacaaatgcagcctcgtgcggagcttttttgtaggtagaagatggctgacgccgaggatatc

SEQ ID NO: 10642 - DNA, 2199 bp, rice GOS2 longer Promoter
tctagaatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 10643 - DNA, 1024 bp, rice GOS2 Promoter
ggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 10644 - DNA, 2103 bp, arabidopsis Pho1 Promoter
actgtttaaggacaaaaaatgtggaactgatgtctcctaggtggtggaatatgtgaagctagaaaacaaataaatgcggtccgactcagaccatcattttcctcttgtctcattggttttaaaattaaatattatattataaaatctgttgcagtattttttttaatctcaattagagttatttatttaggtctcaacccatggtggggaaaaaaacagctattttaggtaaatttagattacaaaattgtatagtcaatatcaataataggttaaagttttaataaactgggtgaatcagtttttgtttggtcttcttggatctttgtttggtctcaatattttggattacatataaattccatcccgactattatttgggttttgccgctggactctataacacactgattttagttttatatgaattttacgttgttttacgtttgatcatgaactaaaaattcagcaatccataagaaaatattttttggactagttcgaaactcggccagacaatactaaacctattcacatatttaactttttttttttttggacaaacataattaactttagtaagtgttatatttttgtcaatattaaactagatgtggtgtttttaattgtgggaaataaaattaaagaagcaaagttccatgaaatatggactttccgtaattggaaggccgccatatgttgccttcatttgtattttccttttattgacccttttgttttcttataagataaatatatatataactaattaggcagaagctgagtggcattagttagtgaaatatatttatcattatcccaaattcctctagctgacattactttgaatttagaaatttcttatccgcaaaatttgtactaatattatgaagtagtacatcgaatagaatatatattggtgcacattatgatccactttcaatgccatccattcgaatggttgctcagaacgtacttgtagaaaccgcgtgcataaagtttcatatgagcatcgtgtgctttgttatttaattttttcttccctaaataatcagacagaaaaattcataaacttctttaataaaaccatccaaaaggggattatactacgaaaattatggcatctaaacgcaaagtttaatatatttttagtaccaatgcattgtaaaagaatggaaattaaataaaaacaatatgaaactgtttgttcccttggacaaaaaaaaaacttggtatgactatgatttttatatgcgcttttgtaattgcattgtaattttgtcgatatggaagtggattttaaagaacattaatccatgatctgataggtgaaaactcacactacttgactgctatataacatggtttggtagtatctgcatttgtaatgtgaaactatgaaatcagaatttgattggtaattcttcttctgcttcttttttcttgattctttaagatttagtatgtgtttcaaatttttcattgtcctccgaaaaaatgtagtggaaatcgagctggtccaatctaagttcactcaccttttgtgtctcttggcacctaatttctttttggtccatttcagctatcttcttccttttccacacaaaacattacaaaatacttactatttctagttctccgatttacaatacccaaattacccttacccttgcccctcatatagttcgtataacaactttcactctaagatgaaacattttgagtgttgagaaaggtatatgaagctcggtagccggaggaagcacggtggatatacactggcgagaatcaggacggtcccacacgagacaagatttacctctcccaaaagcacaagtggaaggagcataggataaaaattagtacatgaaattaggtttcaagaaggatatttgagaatgtgctttgtgaggcatcgtcagtaggagtaagcaatccagtcaaatatattcttctttttttctctgcctttgcttttgtccactataaaacaaatctcatcctcctctcttgccctacactcacaaaacaaacacactctcttcttgatcattttctcttttgagtttttgagtttaaggacttaaaagagaaaacgctatg

SEQ ID NO: 10645 - DNA, 901 bp, rice ExpB5 longer Promoter
gttgatgggccgtagaggagtataatggcaacgtttgacgagacatctagaaattataaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataattaaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 10646 - DNA, 844 bp, rice ExpB5 Promoter
taaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataataaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 10647 - DNA, 602 bp, barley ExpB1 Promoter
cgtggagttgaaactggttcggggtttgcgtcgtcgcccaactcgcttgtccgtcggctccggccggtggtaaagacgaggagatggcaccgcaggaaaacaaggctgtcttcgatggccgacgacttgagacaccgttattttgatgaaggcaccatgaaggctttcggtgtcgctttaccttcgggggacatcgtttttggagtagctacaggctagagggatgggtcaggatggaccgtttatgaaacgtgcgaacattttatttgaagggtacgaaacattttgaaggctgcataggatggaccgttgaaccccacgtgcacgcaatcacgcaacaaacccggccggatgagtcctctttatccaaaatctccggagttgaaagagccttcagcgccatggctccgtcatcaaaggatcggccggctccgtctcagttgaccacagtgcaaagtatgtatgcgcaccctctccgtgaacaagttgccgccacgttcgcctccataattcgtgtgtgcacgactaaacgtattcgctcccacgtttataacacctagaccttccttatcctatatataccaaccaaccgaaccacccca

SEQ ID NO: 10648 - DNA, 1729 bp, Barley SS2 Promoter
gaattgtagtaagtcacgggtgtttatttgatccagactcttttgtaaactaaaggcctctacctacatataaaggagagccctcgagttagaaagatcaagtaaacaactctcgagagctaggttagtgattacgcatccttgtagttgagatccccatcaacatagacaccaaagcaggacgtaggcttttatctccattgaaggggccgaacctgggtaaatccacctctcgttcccgattaacctcttcgagtcgccacaccgccatgatggcctcaacactaagtccgttcacgagctaggtcatgtcgtttggtgacattggccctagactcggagcccgacatcatggggacgaggctccatcgctagggttgcgctccaccccgtgtagttagtcgccactctacctacaaccaatgctcaccacctccattccgtcgcgctcacgcaccttgagttgtcgacgccgctggaaccgagccccactcttgtggatgcaatggggccagagtgactccgacaacggagctcgagtttcctctcgggactagcaaagtgccagctggacgactaactcctcctcgtccgcacatgaggacgaggtcccacccgatggatccagagttgtcaaattcaggctcgctattggccatgtcagaaaagggtggagatcactagagaggagttgggggtggagcggagtggactcggagtgggtggttagggtttcgtttggatagggacacattatgaggccgaggtgggttggtcggggcaagattcaatgtgaagaatgtgtcggggcacctcatatgacatatatgaccggtttaagggtccgattagatggcattttcgtgactagaccgtccgctcagacataaatggacgtgttaagtgcaagacaagttacaaaccaacatgtatatcaaatttaagttctaaactacactcatgcttatatttttcttaaattatttcaaaccttccaacgatgcgacttcaccaggagatgtttctgtcatgaacatatatgcaaatgtattttgcgttaccgtgtttcaaaaagaaaaaagtattccatccgtttttaaatataaaaccttttagagattttactgtagactacgtactgcgatggaaattaaaatgcaaaccacatggcagcggcatacgagagccattcatcgctacaggacactttgcatcggtagccagctagtttccgacggtaccgacgagccgcagagaacttctaaatgcggtttttatgtgcagggacaaacgcgggtttctctgtctgcggaacagaaaaacaaattcggttcccagcaaaaacaaaacaaaacaaagaaacaaaaaaactgcggttgcacgtagtaacaaagtctgtcgcgcacggagcatctcatgcagccgatgatggctcgccagcacgaaaacacttgtcacggcgcgctcccacgaaccggaaacacttggcgcggtgcgtccctccgaaccgaagcacctgtctctaccgcctcgggaaccgggcgctaatctccaaatcaggccggaggcctccacggccgtcgatgcgatgccgccaagagccagtgcggaaaagagagtgtccttttcccccggccgcccggcgagaggaggtggcagcggcgcctgacgcacgcctcctgctggcagctcctccggcgcgccgcgtgtataaataggggcgcagcgc

SEQ ID NO: 10649 - DNA, 879 bp, rice PG5a Promoter
aagcttgcgcgcggaatacggtggtggagatgggttgggaaccctggattccaaacacagcccaagtctatccaaaatgtttagacaagaaaatacgtaacaagttggtttacagaaatagcaattagatcaatcctgcactacaagtagagtaaagtggtgatttctcttaaatctctcgaatggtgatttaagaattcagtgcaaaccaaatccttgctataatcaaatgttcggtaccccatcaacggaacaataaaaagcgcctggctaccataattttgtcattcttcttcaatttgtaatttaagatgcatgaggccacacgaccttaatgttcaacgtgtcatgcattagtgaaataatagctcacaaaacgcaacaaatatagctagataacggttgcaatccttaccaaactaacgtataaagtgagcgattagtcatatcattatctcccgcctgctaaccatcgtgtacaccatccgatccaaaaatgacaacttctagggatgaacctggacaaggtttagggtttagggatgaatctggacaatgattgttcaggttcatccctagatgttgctttctccttacgggacggagggagtatatgtgatggacacaaaagttactttcatgatgaaaggaaaggggatttgttggggcactaatagaacatctgtccaaatggcatgactcacttatatcctaataggacatccaagaaaaactaacactctaaagcaaccgatgaggaattgaaagaaaatacgtgccaccgcatctataaatggacaagcgcaatggaaaccctcctcatcgttcacacagttcaagcattatacagcaaaatagaaagatctatgtcccagagca

SEQ ID NO: 10650 - DNA, 666 bp, CaMV 35S (pQXNC) Promoter
gcatgcctgcaggtcaattctcatgtttgacagcttatcatcggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcccccctcagaagaccagagggctattgagacttttcaacaaagggtaatatcgggaaacctcctcggattccattgcccagctatctgtcacttcatcgaaaggacagtagaaaaggaaggtggctcctacaaatgccatcattgcgataaaggaaaggctatcgttcaagatgcctctaccgacagtggtcccaaagatggacccccacccacgaggaacatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacaggcttcttgagatccttcaacaattaccaacaacaacaaacaacaaacaacattacaattactatttacaattaca

SEQ ID NO: 10651 - DNA, 781 bp, PJJ 35S from Brachypodium Promoter
tcgacctgcagccaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttagcttcatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactcttgaccatgg

SEQ ID NO: 10652 - DNA, 877 bp, CaMV 35S (OLD) Promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 10653 - DNA, 2322 bp, Arabidopsis At6669 (OLD) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 10654 - DNA, 2318 bp, Arabidopsis At6669 (NEW) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 10655 - DNA, 1321 bp, RBCS Promoter
ccaagagtcgttgtctccatgacaacgcccccaaggaggaaatcgacgtaaaaacgccgttgtcgcccgatctggccatagccaaatcttaggttttcacccgaagacaccaaacatcaaagtgagggaaagtgaagctcttcgacgacacctccaagaaggaaaacggcgctacaacatcgttgtcttcggcatacctcgcacacgggcagttttcatccagagcaacactccaaacaccggagccgacgtccatacctcgcacacgggcagcagccgaagacgcgaccgaaaatgaaaaccacgccaccatggcatcgaaaaggaccgacttggaccatgtatggccgcagcagcagcccatctgccgccggtgaagttcaatcagccgcctcaccaaactgagaggaaaaatgatggaaacgaagagacctgggacatgccggatcagccggaggagatgacggatctggccaacgagtagctagatccggccgaagagcgccgccgtgaagccgcgcagccacgagcagaccgagcaccagggagaggaagaacgaggggaaacaccggatccgggaggaagccggccggatctagccgaagacgaggcatagcctgccggatcgggccggagacgccgcgaccacgatgaggcagcacctcaaacgcctcagccaagagctctaggacacccccgccaagaaaaacagccccgccgccgccgtccccgtgcgggctttgcccggcggcggcgagggggaggagaggacggggagaggctgctgccggggctggtgtggttgccgcccgtgtcgccccagactgagcgacgcgggggcaagcttcgttctcgataagatcttagaagagtttctcttaatttgttgttcctctagttcataaaaagtgctgctcattttgcattaactcattacaaattttctaataagtgggcgagattttttatggattggagggattagcaagttctgtttttgagtgcatgccgtggcacattggatctatcctgataggtgaaaattggtcacttcatggcatgatttgcagagtgcgttgcagccaattgtatccgtccagaggataacgcgcgccatttcgtgcggccatgtggcgcccgacctgatccgtaggatgccagcgtggcctgggcaaatccgcgcggcgaactgcagccacccctcctagatcttgtgctgatattggatgggtggggagcctacagttatataagccgctgtagctagagagcactcaagcaagcctgcctcctcttgttagctatctacgtacgtgtacg

SEQ ID NO: 10656 - DNA, 1599 bp, Arabidopsis AT5G06690 Promoter
ggaccatttgtttagacgacattgttaaggggatgacttaaagtgatgagtttcaaattaaaatacccctcgtttttggagttatttacttaaaatgccacttcaaagaagcgtgtcggtgtgttcgagattcgaattttaattactgtcttttgcccctatctatatatatctcactttaatcacacttttattatcgttaatgtttaatgtttatttatgttaatgaaggattagtggttagtggttgtgttactaattgttcgttgctaatgtccttgaaaggtgtaatttgtatgatctatctaactaaattatccggaaataatgcggttgaaataaaatcacgatacatattaggatatcacaatctatttatagtatattttagtcgagatttgaaaataaaaagggaatatattactcgattaaagacattttcaaacgcaaaatcgtatataactatagattgaatcatatatatatctgtgactcaagtcttttatctttgttttttggtttaatgttaaaactttatatcaacaaagacttttatcttgtatcttatgtttactatttctgatgagtaaatattaattttgtaggtaagtaaggtggcaggtttgggtaaagaggaaatcaaaaatgtatggtaggatagtacttgacaaaatacaaaattctaattcgcgtttattaaagtccttagcgtgtggactctacttgtttaatttcgactctctaaacgtcggcctttattttctttcaaacgtacttcaccaactctattagagagatcgattataaccgacaagcataagtatgtgatttctatattagtttatatatagctatgtcttcgaatgattatttatagtaaacacataattatacgtaataagtccgagagtatataaactatgaaggataattaattgaagacaagaaaattaacgaaatagtgtggggaattcccaaggcatcatattcagatcaatgcaccgtcacaagtttggctattctttatttggttttctgattaacacaaagttttaaatagttttgaacgtttctaatccatttgaggcagtgattttttctgttccaagtattttatgttcaatattattaggaatgtgaacggaacgatttttttttttttttgtggaaccgagcgaccaaatttgagaaaataaaacaaattagattgatttaacatttagacgaggtttaattagaaaggaaaaaaaaaacacaattttatataaatatgaacagccaaaataattttcctagagtttataagttcagggtttacctttttcatagagaaaactaataaagtcactattaacattttaagaatatacatttttaaaacaaattataaagacaatgagagaaaggtagcccccaccagtagcacatcgttggcattgtccaactcatcttccggataagctctctatccatctcctcacatctcttcccaaaactttcaaaaacaaaaaaaatatcttaattatggcatttgaaaacttaaaaatatctcgtcacatatcttcatcgacaaaaaatttactgaaagcgaaaaaaata

SEQ ID NO: 10657 - DNA, 1774 bp, Arabidopsis AT5G61520 (AtSTP3) Promoter
ctgttatgaggtgttcttgcacggcatgtctagttgcaggctgctgaagaattgcccaccggcttttaaacaacgacccaactctttctgcaacatctgcaacattcactttcgcatccttagcaacttccccgacaaaactaccagcagtctgccctgcttccctaagcttcgttcctaattcagtaactccatagtaagctttccaccataaacactcacagagagaaacgaaatgaggttagcatagaaattatcaaacctgatgaagaaaagaatccactagtcctctcctgccattgctgtgagatgagagaaggcattatccaataccaaccactttaaacaagtcactagaaacctgtttgcatcaagaaacaaatgggaagatatatacttattcttagcaaattatgatacaacctcacaagcggtattatccgttgtaatcaacttcatcacatgaaatcatcttcaatctaatcatatacaattgatacagaagaaacacaaaagaaaaccaaaaccttgacttcatcgtcaaccatggaatgaatttcttgacaaagaataaaaaccaagtctttaactgccaaaaggagataacttttaaggaacacaaaccctaatcctatattctctaatcaatcatatacgagaatcaaaaagaacaaatagaacaaaagcaatccgatcatcaaacctttagaacaatccccagaaaaattgagatagctgatgatcgaatcgaactaaacccaattcctcgatacgatcaaagacgacgaagacgagagtcagcgatatgatgaaaaagaaattgatcgctccaggagatgaaaaggttccacttttttaatttccccctggagcagagaaaaaaagatattattgctgtttaggtaaaaaaaaagtcggctttgaattttgaataggaaagtcttcttccctttgcaaatcacagatattctctccgtcacggactgtgacggtaataaatattctgttggtgccacgtgtaataagtttttctcttcacaaaaatggtccttcatcttcttttagtatctcatttgtgacctaagcttctaatttcacagcttatcatccccttaatgttttaagttttttgaccatagagtaaaattattttactataaaattaaaagcaaaaaataaaatttactataaaattataattataaaaagtgaatgtaaaaatgattccataaatttacatgattgatagtaattattctgccaacttaattccacatgtatatcagtatttatatatagaaaatgatggtttttctacatagtcaaattccaaaacaaaatatcagtattatggaattaaacaatcaaagtttgcaacttggtatgtccaatatcatcgaaagagctttatcattcagtcgttgaaaaaagtatagccatctttttcttctatcgattttcaaaaaaaaaaaaaaaaaaaaaaaaaaaaaaaaaaaaaaaaaaagaggaagataatgaaggtaggcagtgaaaagtctttcttcacatgtcttttattgtccactttcgatatctcatcagccagaaccgaaacaaacaaaaactataagtcccacactcaagtcaattaaagcactccaatggtccaacaagtttcgtcgtctaccttgaaactcaacctttggatgattgatatacaaaaatacaggatctaaaaacacctaccgaacttgaatagtaggtgtgttgtgtttgagtgtctctctaggtaaac

SEQ ID NO: 10658 - DNA, 1127 bp, Brassica napus NAPIN Promoter
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 10659 - DNA, 916 bp, Arabidopsis AT1G61720 (BAN) Promoter
ttgtacttttgaaattacagagatagagatttagttgttatgagtttatcgtcttgagacttctatataagaagtaaaaagatttgcaaatagtccttgctcattaggtacaacagtagatcaataaggctgttttagaaggtaagcacgtgatctttgaaataaccaacttgtcttcacctaagaatcaaaaaagattgaccttcagagttctgatttgttatcatctaccaaattatcacaagagtttgattatttctgtctctaaacaatataacacagctttagagtaacgaatagtgttacagtaaggttctgttacttcaattttttctttgccgatcttaaaatgagttgcaaaagaatgctttttacttccaccaatctgtcaaattctctgcagtttttaacacaacttggacttgctatgttctgtttcacgaattacacgagtcaattcaacataacttgctctgttcttgtccatgtttcacagaatctggccttaagcaattttatcatatttaagctacaaatccataacagagtttaacaaagataaaataaccagaaagttacattgaaagataaaaagtgaagaagacaaaaaaaagagagggtaaatcctaaatcgaaaacaaaagaaggcattggcaatagcattccgattttaaaaaaccgataaatctatgtatctaatggcttgttcttagaagcttcaacgaacatagaagcaacctcattcaaaaacttagtcttctccaacacaaattccaactccttagcttgcaacaacttatacttctcttcaacaatcttcttactctcaaccgaaaccaaactccattgctgcttcacataatactcatcaacacccaaactagcaatcatcctaacaagagacgagttatcaaac

SEQ ID NO: 10660 - DNA, 3965 bp, Arabidopsis ABI3 (AT3G24650) longer Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgt

SEQ ID NO: 10661 - DNA, 4074 bp, Arabidopsis ABI3 (AT3G24650) Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgttgtttaaagattcgatgatagccaagttgggttaactttctttttccttgcctccttactcacatacaaaccctatctgtccgtacaaaatactaaaaaccctaacttt

SEQ ID NO: 10662 - DNA, 1700 bp, Arabidopsis (AT1G69120) APETALA 1
ttagactgatttctctatacactatcttttaacttatgtatcgtttcaaaactcaggacgtacatgtttaaatttggttatataaccacgaccatttcaagtatatatgtcataccataccagatttaatataacttctatgaagaaaatacataaagttggattaaaatgcaagtgacatctttttagcataggttcatttggcatagaagaaatatataactaaaaatgaactttaacttaaatagattttactatattacaattttttctttttacatggtctaatttatttttctaaaattagtataattgttgttttgatgaaacaataataccgtaagcaatagttgctaaaagatgtccaaatatttataaattacaaagtaaatcaaataaggaagaagacacgtggaaaacaccaaataagagaagaaatggaaaaaacagaaagaaattttttaacaagaaaaatcaattagtcctcaaacctgagatatttaaagtaatcaactaaaacaggaacacttgactaacaaagaaatttgaaacgtggtccaactttcacttaattatattgttttctctaaggcttatgcaatatatgccttaagcaaatgccgaatctgttttttttttttttgttattggatattgactgaaaataaggggttttttcacacttgaagatctcaaaagagaaaactattacaacggaaattcattgtaaaagaagtgattaagcaaattgagcaaaggtttttatgtggtttatttcattatatgattgacatcaaattgtatatatatggttgttttatttaacaatatatatggatataacgtacaaactaaatatgtttgattgacgaaaaaaaatatatgtatgtttgattaacaacatagcacatattcaactgatttttgtcctgatcatctacaacttaataagaacacacaacattgaacaaatctttgacaaaatactatttttgggtttgaaattttgaatacttacaattattcttctcgatcttcctctctttccttaaatcctgcgtacaaatccgtcgacgcaatacattacacagttgtcaattggttctcagctctaccaaaaacatctattgccaaaagaaaggtctatttgtacttcactgttacagctgagaacattaaatataataagcaaatttgataaaacaaagggttctcaccttattccaaaagaatagtgtaaaatagggtaatagagaaatgttaataaaaggaaattaaaaatagatattttggttggttcagattttgtttcgtagatctacagggaaatctccgccgtcaatgcaaagcgaaggtgacacttggggaaggaccagtggtccgtacaatgttacttacccatttctcttcacgagacgtcgataatcaaattgtttattttcatatttttaagtccgcagttttattaaaaaatcatggacccgacattagtacgagatataccaatgagaagtcgacacgcaaatcctaaagaaaccactgtggtttttgcaaacaagagaaaccagctttagcttttccctaaaaccactcttacccaaatctctccataaataaagatcccgagactcaaacacaagtctttttataaaggaaagaaagaaaaactttcctaattggttcataccaaagtctgagct

SEQ ID NO: 10663 - DNA, 1096 bp, RootP Promoter
tcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatctcttcttaggttgaaacactgttgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaa

SEQ ID NO: 10664 - DNA, 2432 bp, arabidopsis ATTPS-CIN (AT3G25820) Promoter
atgtcaattttcatggcacatcgaggagaaactgtttccttgtggtaatcctttataatctctgttgctaggaggagatttttcattaatagtctatctttcacaaaggcagattgatttgaagagatgaacttgggaagaatgattttgagtctgtttgcaagaatcttcgatatcaccttatagagaacattacagcatgatatcggtctatagtccttcatcatcacagcttcttttctcttgggtatcaaggccaaaatagtggagtttactcctttgggtaggaagcctgtcttaaaaaaagattggatggctaccacaaaatcgtttcctactatcgaccatgtctcgttaaagaactcacaagtatatccgtcagggcctggggatttatttgaaggcattgagaagagaactttccgcacctcctctgcagtgacttctagtgtgagcttgtcttgtcattctcatcacatctataatccagtagagtttccagttcctcccgcgaccaatccacgtagtctggcggtttgagcgttaaaaagtctctgaagtatcgaactgcctctgcttttatttgctgctgatttgatgcaatatgtccatcatcacacttaatctctctaacattgttacgaacctcccgaatctttgcagcattgtagaaagttttattattttggtctcctatcttcatccaatgcagttttgctttttgcctaaggtagctttcctcaatacccgacagccttaaccacttctcatatgcgtccgcttcagctaccactgcctgtgaagatggccttgtcatagtttctgcttgcttttcacataaagttttataggcttcttttgctttttttgagatatcaccaagtaactgcttccccatctttctgaaatgtggcttcagaccttttaatttttttgataagcggtgcatggctgaggtagaatgaaagagaggctgagttgtcttccaaagctcttctgtctcacttctgaaatccgaatacgaaattaaagcatttataaatttaaaaggcctcttgactcgttgttcctgctccataatatagaatcgacatcttaggtgatctgaacaaccgcctgattcaaagacgctgtaggactgttcatactattgcatccattgcttgctaatcagtaccctatccagcttcttacatattactccttcctttctcttgttacaccatgtgtatctctggccttggtagctcatatctgttaattcacaatgtctgattaagtcttgaaaatctctcatcccttggagaacgaatggagatgattcatagagtgaatggtcctctccttctaatatctcattaaagtctccacatattaaccaagctttgttatagaacaaaggggaatcatgatgatatttaatatcactccacaaatcctttctttctgctgcaaaatttgatgcataaacaaacgacacaaagaactcttcttgtcttccttctaataagacagagcaagtgatgagttgtgacgtcttatatattggagatacacgcacgttatcttctattatctttcaatagtaatttgatataaattaagataatgtgcagtgaacgagtggcgattgttaagccaagtgaacattatatactttattttatactttctccaagcttcgaatggagaatttatttccatacgactaactctacctaaaagggccatgtttgtttgccaacataacacgacgatcacgagatacacataacatttagaatttggagaagatacattttgtttgacttcactttttgtgcgaatggctgttctacctgaaggggccattagtataatttttttgtacataataacgtcaccaaatataacacgagaatcacgaggtacacaaatcatttaggcttggacattatctaatcaaataagctatgatatcaaatttacatacatatagtggcctcgtgggtataattacacaaggagcttttggagaaaaagaagtgtgtgatttaaatgacaattatacaaatgtgtacaattatcagatccaaagttcatgttttaaatcatcaaaaaaataataattgatgagttaaatgatatttttttcatttagatttagttagattagttgtacggttgtaccattatttaataatttaaaagttgaaatgattataatgtataaaagttgaaaatattgtaacagatatagattaagcatttttgcggtcaatatattataaaagcttttttagctattaattgaaaaatattttacacccttagatcttttgatctcctaattatataaaatattttcttctaccgtttgtctatataaccatatgtgttgtctagtgcatgtattcagccacgaataagagaatagtctactaaatcaatgg

SEQ ID NO: 10665 - DNA, 277 bp, NOS TERMINATOR
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 10666 - DNA, 538 bp, 35S pEBbVNi Promoter
catggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggact

SEQ ID NO: 10667 - DNA, 555 bp, Streptomyces hygroscopicus (A10) Bar Gene
atgagcccagaacgacgcccggccgacatccgccgtgccaccgaggcggacatgccggcggtctgcaccatcgtcaaccactacatcgagacaagcacggtcaacttccgtaccgagccgcaggaaccgcaggagtggacggacgacctcgtccgtctgcgggagcgctatccctggctcgtcgccgaggtggacggcgaggtcgccggcatcgcctacgcgggcccctggaaggcacgcaacgcctacgactggacggccgagtcgaccgtgtacgtctccccccgccaccagcggacgggactgggctccacgctctacacccacctgctgaagtccctggaggcacagggcttcaagagcgtggtcgctgtcatcgggctgcccaacgacccgagcgtgcgcatgcacgaggcgctcggatatgccccccgcggcatgctgcgggcggccggcttcaagcacgggaactggcatgacgtgggtttctggcagctggacttcagcctgccggtaccgccccgtccggtcctgcccgtcaccgagatctgatga

SEQ ID NO: 10668 - DNA, 36 bp, Artificial Sequence
  Primer
aaaaagaattcacagtctctctctttctctctcgtg

SEQ ID NO: 10669 - DNA, 33 bp, Artificial Sequence
  Primer
aaaaagaattcacgagaatgttggtcgctctac

SEQ ID NO: 10670 - DNA, 33 bp, Artificial Sequence
  Primer
aaaaagaattccaaccgactacctttgctcaac

SEQ ID NO: 10671 - DNA, 31 bp, Artificial Sequence
  Primer
aaaaagaattccactcctctcagacgccatc

SEQ ID NO: 10672 - DNA, 33 bp, Artificial Sequence
  Primer
aaaaagaattccggcaggtgctaaatacaaatc

SEQ ID NO: 10673 - DNA, 34 bp, Artificial Sequence
  Primer
aaaaagaattcctaatcaatggttgcaatccgac

SEQ ID NO: 10674 - DNA, 33 bp, Artificial Sequence
  Primer
aaaaagaattcgagaaccaacaatcctagcctg

SEQ ID NO: 10675 - DNA, 31 bp, Artificial Sequence
  Primer
aaaaagaattcgcacactctgctccaagaag

SEQ ID NO: 10676 - DNA, 33 bp, Artificial Sequence
  Primer
aaaaagaattcgctgcacttcctgttcctttac

SEQ ID NO: 10677 - DNA, 33 bp, Artificial Sequence
  Primer
aaaaagaattctacaggctacaacccaacaatg

SEQ ID NO: 10678 - DNA, 28 bp, Artificial Sequence
  Primer
aaaaagaattctctctcgtgcgcgacaa

SEQ ID NO: 10679 - DNA, 33 bp, Artificial Sequence
  Primer
aaaaggcctaaactgaaataatgttccagggag

SEQ ID NO: 10680 - DNA, 31 bp, Artificial Sequence
  Primer
aaaaggcctaagaacctgtcagacaacccat

SEQ ID NO: 10681 - DNA, 31 bp, Artificial Sequence
  Primer
aaaaggcctacctggacttaacatggattgg

SEQ ID NO: 10682 - DNA, 31 bp, Artificial Sequence
  Primer
aaaaggcctacggacagatctaatacggtcg

SEQ ID NO: 10683 - DNA, 31 bp, Artificial Sequence
  Primer
aaaaggcctacttgcccagggtagaggatac

SEQ ID NO: 10684 - DNA, 31 bp, Artificial Sequence
  Primer
aaaaggcctagcggaacaaagtgcagattac

SEQ ID NO: 10685 - DNA, 31 bp, Artificial Sequence
  Primer
aaaaggcctagggaatcagactatggtgacg

SEQ ID NO: 10686 - DNA, 31 bp, Artificial Sequence
  Primer
aaaaggcctattccaaagactggaagcagtg

SEQ ID NO: 10687 - DNA, 32 bp, Artificial Sequence
  Primer
aaaaggcctcaccatgtttatggtgattgatg

SEQ ID NO: 10688 - DNA, 30 bp, Artificial Sequence
  Primer
aaaaggcctcataaccgcttcttctcctcc

SEQ ID NO: 10689 - DNA, 32 bp, Artificial Sequence
  Primer
aaaaggcctccctaacactatcacagaaatgg

SEQ ID NO: 10690 - DNA, 34 bp, Artificial Sequence
  Primer
aaaaggcctccttgcatttcagtagattcaagac

SEQ ID NO: 10691 - DNA, 31 bp, Artificial Sequence
  Primer
aaaaggcctcgacgggtgaaatgagaattag

SEQ ID NO: 10692 - DNA, 32 bp, Artificial Sequence
  Primer
aaaaggcctctaacataacatgtggtcggtcg

SEQ ID NO: 10693 - DNA, 31 bp, Artificial Sequence
  Primer
aaaaggcctctacatgtggtcggtcgtcaag

SEQ ID NO: 10694 - DNA, 32 bp, Artificial Sequence
  Primer
aaaaggcctctagccacatccatcccaagtag

SEQ ID NO: 10695 - DNA, 34 bp, Artificial Sequence
  Primer
aaaaggcctctatcataaacaaaccaccgtcaag

SEQ ID NO: 10696 - DNA, 33 bp, Artificial Sequence
  Primer
aaaaggcctctatccatcccaagtagagctttg

SEQ ID NO: 10697 - DNA, 34 bp, Artificial Sequence
  Primer
aaaaggcctctatttacagtgtgtcctgagctgc

SEQ ID NO: 10698 - DNA, 41 bp, Artificial Sequence
  Primer
aaaaggcctcttcttcattttatattagcatcatgagtagt

SEQ ID NO: 10699 - DNA, 31 bp, Artificial Sequence
  Primer
aaaaggcctgcagagcacacactttgacatc

SEQ ID NO: 10700 - DNA, 36 bp, Artificial Sequence
  Primer
aaaaggcctgcatcatgagtagttctctgaactatg

SEQ ID NO: 10701 - DNA, 31 bp, Artificial Sequence
  Primer
aaaaggcctgctatccttgtggtgatggaag

SEQ ID NO: 10702 - DNA, 31 bp, Artificial Sequence
  Primer
aaaaggcctggctttacctgaatgtcacctc

SEQ ID NO: 10703 - DNA, 31 bp, Artificial Sequence
  Primer
aaaaggcctgtcagtctgagcaaacagcatc

SEQ ID NO: 10704 - DNA, 31 bp, Artificial Sequence
  Primer
aaaaggcctgtggaacctggacttaacatgg

SEQ ID NO: 10705 - DNA, 31 bp, Artificial Sequence
  Primer
aaaaggccttaaacaagctgctgcatagcac

SEQ ID NO: 10706 - DNA, 31 bp, Artificial Sequence
  Primer
aaaaggccttaaaccctaagtccgccataac

SEQ ID NO: 10707 - DNA, 31 bp, Artificial Sequence
  Primer
aaaaggccttaacagacaagttggcaagcag

SEQ ID NO: 10708 - DNA, 29 bp, Artificial Sequence
  Primer
aaaaggccttacaatagaggggcaccgtc

SEQ ID NO: 10709 - DNA, 31 bp, Artificial Sequence
  Primer
aaaaggccttacgccacactctcattgtttc

SEQ ID NO: 10710 - DNA, 31 bp, Artificial Sequence
  Primer
aaaaggccttcacagagaagtagggcacttg

SEQ ID NO: 10711 - DNA, 31 bp, Artificial Sequence
  Primer
aaaaggccttcactctacaactcatgcgctc

SEQ ID NO: 10712 - DNA, 35 bp, Artificial Sequence
  Primer
aaaaggccttcatggggagtatgatatgaccattg

SEQ ID NO: 10713 - DNA, 29 bp, Artificial Sequence
  Primer
aaaaggccttcgcttcaactttacgccac

SEQ ID NO: 10714 - DNA, 32 bp, Artificial Sequence
  Primer
aaaaggccttctcatttcagttctcaggaagc

SEQ ID NO: 10715 - DNA, 36 bp, Artificial Sequence
  Primer
aaaaggccttgaatagatacaacattgtcaatggag

SEQ ID NO: 10716 - DNA, 31 bp, Artificial Sequence
  Primer
aaaaggccttgctgttgagcgttgacaatac

SEQ ID NO: 10717 - DNA, 32 bp, Artificial Sequence
  Primer
aaaaggcctttaaacgcatctcaatcatgttc

SEQ ID NO: 10718 - DNA, 36 bp, Artificial Sequence
  Primer
aaaaggcctttaacggaaacgctatgtacactacag

SEQ ID NO: 10719 - DNA, 39 bp, Artificial Sequence
  Primer
aaaaggcctttaagactattggacaccaattaatagtgg

SEQ ID NO: 10720 - DNA, 36 bp, Artificial Sequence
  Primer
aaaaggcctttatacggaccaacaacacaattaact

SEQ ID NO: 10721 - DNA, 36 bp, Artificial Sequence
  Primer
aaaaggcctttatatcattgcttctgaatcactcac

SEQ ID NO: 10722 - DNA, 31 bp, Artificial Sequence
  Primer
aaaaggcctttgaatattcggactcggacac

SEQ ID NO: 10723 - DNA, 28 bp, Artificial Sequence
  Primer
aaaaggcctttgattcctgcaagcgatg

SEQ ID NO: 10724 - DNA, 31 bp, Artificial Sequence
  Primer
aaaaggcctttgtgtttgagtacagggttgg

SEQ ID NO: 10725 - DNA, 35 bp, Artificial Sequence
  Primer
aaacccgggacttctattttcatcaattttcagtg

SEQ ID NO: 10726 - DNA, 27 bp, Artificial Sequence
  Primer
aaacccgggagagatgctgctgcacgg

SEQ ID NO: 10727 - DNA, 29 bp, Artificial Sequence
  Primer
aaacccgggagcagcaccaacttcatcac

SEQ ID NO: 10728 - DNA, 29 bp, Artificial Sequence
  Primer
aaacccgggcaacgttcgtctcctcttcc

SEQ ID NO: 10729 - DNA, 32 bp, Artificial Sequence
  Primer
aaacccgggcagtagctaggaagaaggcaagg

SEQ ID NO: 10730 - DNA, 30 bp, Artificial Sequence
  Primer
aaacccgggcatcgtgtcgtctccactagg

SEQ ID NO: 10731 - DNA, 29 bp, Artificial Sequence
  Primer
aaacccgggcgctagtcagtcagcagcac

SEQ ID NO: 10732 - DNA, 36 bp, Artificial Sequence
  Primer
aaacccggggaatgatgagaaggattaaaggaacac

SEQ ID NO: 10733 - DNA, 29 bp, Artificial Sequence
  Primer
aaacccgggggagaggagagatgctgctg

SEQ ID NO: 10734 - DNA, 31 bp, Artificial Sequence
  Primer
aaactcgagacagccaacacaaatcagagtg

SEQ ID NO: 10735 - DNA, 31 bp, Artificial Sequence
  Primer
aaactcgagatagccagggaacaaggtaagc

SEQ ID NO: 10736 - DNA, 31 bp, Artificial Sequence
  Primer
aaactcgaggtgtcatctctcctgaggaacc

SEQ ID NO: 10737 - DNA, 26 bp, Artificial Sequence
  Primer
aaagaattcaaaatcccacccgcttg

SEQ ID NO: 10738 - DNA, 31 bp, Artificial Sequence
  Primer
aaagaattcaaacagtgcacttcaatcccac

SEQ ID NO: 10739 - DNA, 36 bp, Artificial Sequence
  Primer
aaagaattcaaacgtgtacaacacattgaacattag

SEQ ID NO: 10740 - DNA, 33 bp, Artificial Sequence
  Primer
aaagaattcaaagattcagaacaacttccttgc

SEQ ID NO: 10741 - DNA, 31 bp, Artificial Sequence
  Primer
aaagaattcaaagctatcatcagcatcgtcc

SEQ ID NO: 10742 - DNA, 31 bp, Artificial Sequence
  Primer
aaagaattcaaatcaagcggaactcactcag

SEQ ID NO: 10743 - DNA, 31 bp, Artificial Sequence
  Primer
aaagaattcaaccaaccgtagcatctctcac

SEQ ID NO: 10744 - DNA, 26 bp, Artificial Sequence
  Primer
aaagaattcaaccctcgtgctctcgc

SEQ ID NO: 10745 - DNA, 31 bp, Artificial Sequence
  Primer
aaagaattcaagaatagaaccaacccgttcc

SEQ ID NO: 10746 - DNA, 31 bp, Artificial Sequence
  Primer
aaagaattcaagacctgaacaaatggacacc

SEQ ID NO: 10747 - DNA, 28 bp, Artificial Sequence
  Primer
aaagaattcaagatctcccactcgcctc

SEQ ID NO: 10748 - DNA, 31 bp, Artificial Sequence
  Primer
aaagaattcaagctgattcttggtggaaatg

SEQ ID NO: 10749 - DNA, 31 bp, Artificial Sequence
  Primer
aaagaattcaaggcacacacttctcttcgtc

SEQ ID NO: 10750 - DNA, 31 bp, Artificial Sequence
  Primer
aaagaattcaatataacgggaatcacccacc

SEQ ID NO: 10751 - DNA, 32 bp, Artificial Sequence
  Primer
aaagaattcaatccatagggagaccaaacatc

SEQ ID NO: 10752 - DNA, 31 bp, Artificial Sequence
  Primer
aaagaattcaatcttgtcgtaggatcgatgg

SEQ ID NO: 10753 - DNA, 32 bp, Artificial Sequence
  Primer
aaagaattcaatgcagaggaaagaccatacag

SEQ ID NO: 10754 - DNA, 32 bp, Artificial Sequence
  Primer
aaagaattcaatgcgtggatctcacttaacag

SEQ ID NO: 10755 - DNA, 31 bp, Artificial Sequence
  Primer
aaagaattcaattacggtcaccactagccac

SEQ ID NO: 10756 - DNA, 31 bp, Artificial Sequence
  Primer
aaagaattcaattcaatagcacagcgagagc

SEQ ID NO: 10757 - DNA, 31 bp, Artificial Sequence
  Primer
aaagaattcaatttggtcaggaggtcatctg

SEQ ID NO: 10758 - DNA, 35 bp, Artificial Sequence
  Primer
aaagaattcacaaaaaccaattttatgattactcc

SEQ ID NO: 10759 - DNA, 33 bp, Artificial Sequence
  Primer
aaagaattcacaaattctgtgccaaatttcaag

SEQ ID NO: 10760 - DNA, 31 bp, Artificial Sequence
  Primer
aaagaattcacacacgctacacaagatgctc

SEQ ID NO: 10761 - DNA, 31 bp, Artificial Sequence
  Primer
aaagaattcacacatgaatgcacatttcagc

SEQ ID NO: 10762 - DNA, 31 bp, Artificial Sequence
  Primer
aaagaattcacacttggaatggaaagaaacg

SEQ ID NO: 10763 - DNA, 31 bp, Artificial Sequence
  Primer
aaagaattcacatgctggaagcattacactg

SEQ ID NO: 10764 - DNA, 31 bp, Artificial Sequence
  Primer
aaagaattcaccaccacccaaataattcctc

SEQ ID NO: 10765 - DNA, 26 bp, Artificial Sequence
  Primer
aaagaattcaccccacgctcaactca

SEQ ID NO: 10766 - DNA, 30 bp, Artificial Sequence
  Primer
aaagaattcaccgtggtatactcccgtctc

SEQ ID NO: 10767 - DNA, 31 bp, Artificial Sequence
  Primer
aaagaattcacgacccaaacttgactgattc

SEQ ID NO: 10768 - DNA, 29 bp, Artificial Sequence
  Primer
aaagaattcacgctcgagtcctccgtaac

SEQ ID NO: 10769 - DNA, 29 bp, Artificial Sequence
  Primer
aaagaattcacggaccaagtcattcttgc

SEQ ID NO: 10770 - DNA, 31 bp, Artificial Sequence
  Primer
aaagaattcactcctagcagctcatcagacg

SEQ ID NO: 10771 - DNA, 34 bp, Artificial Sequence
  Primer
aaagaattcagagatcgtcgatcagatttagttg

SEQ ID NO: 10772 - DNA, 31 bp, Artificial Sequence
  Primer
aaagaattcagcaccctgattaacacctgag

SEQ ID NO: 10773 - DNA, 31 bp, Artificial Sequence
  Primer
aaagaattcagcttgccaaacattgagaaac

SEQ ID NO: 10774 - DNA, 32 bp, Artificial Sequence
  Primer
aaagaattcagtcgcctacgaaattcaatagc

SEQ ID NO: 10775 - DNA, 31 bp, Artificial Sequence
  Primer
aaagaattcagtgtcttgtggatgaaccaac

SEQ ID NO: 10776 - DNA, 31 bp, Artificial Sequence
  Primer
aaagaattcagttcattggagtaaggcatgg

SEQ ID NO: 10777 - DNA, 31 bp, Artificial Sequence
  Primer
aaagaattcatcaatgatttggcgttgaatg

SEQ ID NO: 10778 - DNA, 31 bp, Artificial Sequence
  Primer
aaagaattcatcacaccacacgattctcaag

SEQ ID NO: 10779 - DNA, 31 bp, Artificial Sequence
  Primer
aaagaattcatcagtcgaagggtcaacaaac

SEQ ID NO: 10780 - DNA, 31 bp, Artificial Sequence
  Primer
aaagaattcatgcaactcgaacactgacatc

SEQ ID NO: 10781 - DNA, 31 bp, Artificial Sequence
  Primer
aaagaattcatgcctcacatttgagaagacc

SEQ ID NO: 10782 - DNA, 31 bp, Artificial Sequence
  Primer
aaagaattcatgcttgcatggcttagatgac

SEQ ID NO: 10783 - DNA, 31 bp, Artificial Sequence
  Primer
aaagaattcatgtacaggaaaggccatcatc

SEQ ID NO: 10784 - DNA, 29 bp, Artificial Sequence
  Primer
aaagaattcattcgaggcaaccacctatc

SEQ ID NO: 10785 - DNA, 28 bp, Artificial Sequence
  Primer
aaagaattcattcttgctgcgacgattc

SEQ ID NO: 10786 - DNA, 31 bp, Artificial Sequence
  Primer
aaagaattcattgtgtcaagagcaggaggac

SEQ ID NO: 10787 - DNA, 31 bp, Artificial Sequence
  Primer
aaagaattcatttctactgcacgcctactgg

SEQ ID NO: 10788 - DNA, 33 bp, Artificial Sequence
  Primer
aaagaattcatttcttgtacacggcaaattcac

SEQ ID NO: 10789 - DNA, 31 bp, Artificial Sequence
  Primer
aaagaattccaaagaataaccaccgatgatg

SEQ ID NO: 10790 - DNA, 33 bp, Artificial Sequence
  Primer
aaagaattccaaccctacacaccaaatttaagc

SEQ ID NO: 10791 - DNA, 31 bp, Artificial Sequence
  Primer
aaagaattccaagatgtaccaacgacgacac

SEQ ID NO: 10792 - DNA, 31 bp, Artificial Sequence
  Primer
aaagaattccaagcagaaactctccaggaac

SEQ ID NO: 10793 - DNA, 32 bp, Artificial Sequence
  Primer
aaagaattccaataagcaatgctatgtcgtca

SEQ ID NO: 10794 - DNA, 31 bp, Artificial Sequence
  Primer
aaagaattccaatgcaccttaacagcaacag

SEQ ID NO: 10795 - DNA, 32 bp, Artificial Sequence
  Primer
aaagaattccacgctacacaagatgctcctac

SEQ ID NO: 10796 - DNA, 30 bp, Artificial Sequence
  Primer
aaagaattccagcattgcaaattcgaaact

SEQ ID NO: 10797 - DNA, 31 bp, Artificial Sequence
  Primer
aaagaattccatgggcacacttcattacttg

SEQ ID NO: 10798 - DNA, 32 bp, Artificial Sequence
  Primer
aaagaattcccaccgatgatgtctctcaatac

SEQ ID NO: 10799 - DNA, 30 bp, Artificial Sequence
  Primer
aaagaattcccacgaccttacttgaacagg

SEQ ID NO: 10800 - DNA, 30 bp, Artificial Sequence
  Primer
aaagaattcccagtaacacagcctttggtg

SEQ ID NO: 10801 - DNA, 31 bp, Artificial Sequence
  Primer
aaagaattcccatccagtacacacaagaacg

SEQ ID NO: 10802 - DNA, 31 bp, Artificial Sequence
  Primer
aaagaattcccatttaatttgttcgtcctgc

SEQ ID NO: 10803 - DNA, 31 bp, Artificial Sequence
  Primer
aaagaattcccatttatgtccagctcacaag

SEQ ID NO: 10804 - DNA, 32 bp, Artificial Sequence
  Primer
aaagaattccccaacatctttcacactttacc

SEQ ID NO: 10805 - DNA, 28 bp, Artificial Sequence
  Primer
aaagaattcccgcctgtctccagagttc

SEQ ID NO: 10806 - DNA, 33 bp, Artificial Sequence
  Primer
aaagaattccctgctatcttaaagaccttcgtg

SEQ ID NO: 10807 - DNA, 29 bp, Artificial Sequence
  Primer
aaagaattccctgtcaatagcagacgagc

SEQ ID NO: 10808 - DNA, 31 bp, Artificial Sequence
  Primer
aaagaattccgaccttgtttacggtttatgc

SEQ ID NO: 10809 - DNA, 31 bp, Artificial Sequence
  Primer
aaagaattccgacgctaaactgagtacatgc

SEQ ID NO: 10810 - DNA, 31 bp, Artificial Sequence
  Primer
aaagaattccgagcattacaacaaacaccac

SEQ ID NO: 10811 - DNA, 31 bp, Artificial Sequence
  Primer
aaagaattccgagtcctccgtaaccctaaac

SEQ ID NO: 10812 - DNA, 33 bp, Artificial Sequence
  Primer
aaagaattccgcagttaatagtaaggcacacac

SEQ ID NO: 10813 - DNA, 31 bp, Artificial Sequence
  Primer
aaagaattccgcatcatgccaacataataag

SEQ ID NO: 10814 - DNA, 30 bp, Artificial Sequence
  Primer
aaagaattccgcatgacgatatacatgcac

SEQ ID NO: 10815 - DNA, 29 bp, Artificial Sequence
  Primer
aaagaattccgtcggctagctttgaattg

SEQ ID NO: 10816 - DNA, 36 bp, Artificial Sequence
  Primer
aaagaattcctaacaacaagcctttaacagagaagg

SEQ ID NO: 10817 - DNA, 34 bp, Artificial Sequence
  Primer
aaagaattcctaacaaccgttaattacgaccagc

SEQ ID NO: 10818 - DNA, 34 bp, Artificial Sequence
  Primer
aaagaattcctaacaagtacacaaacgaccgagg

SEQ ID NO: 10819 - DNA, 32 bp, Artificial Sequence
  Primer
aaagaattcctaactctccgagacgagctgac

SEQ ID NO: 10820 - DNA, 32 bp, Artificial Sequence
  Primer
aaagaattcctaagaaggccccatgagagatg

SEQ ID NO: 10821 - DNA, 33 bp, Artificial Sequence
  Primer
aaagaattcctaagctagaacaaaggcctgagc

SEQ ID NO: 10822 - DNA, 34 bp, Artificial Sequence
  Primer
aaagaattcctaagttctagagacccgagcagag

SEQ ID NO: 10823 - DNA, 38 bp, Artificial Sequence
  Primer
aaagaattcctaatatagacacagagagcacacattgc

SEQ ID NO: 10824 - DNA, 35 bp, Artificial Sequence
  Primer
aaagaattcctaattgcgtacgaatgaatgatgag

SEQ ID NO: 10825 - DNA, 31 bp, Artificial Sequence
  Primer
aaagaattcctaatttgcatgatgaagccag

SEQ ID NO: 10826 - DNA, 34 bp, Artificial Sequence
  Primer
aaagaattcctacaagagggcacagcaatagttc

SEQ ID NO: 10827 - DNA, 34 bp, Artificial Sequence
  Primer
aaagaattcctacaaggttctcacaccagaatcc

SEQ ID NO: 10828 - DNA, 33 bp, Artificial Sequence
  Primer
aaagaattcctacacacacatcaaccagaatgg

SEQ ID NO: 10829 - DNA, 30 bp, Artificial Sequence
  Primer
aaagaattcctacacgggatgttcgttcag

SEQ ID NO: 10830 - DNA, 34 bp, Artificial Sequence
  Primer
aaagaattcctaccagtagatcactgccactctg

SEQ ID NO: 10831 - DNA, 35 bp, Artificial Sequence
  Primer
aaagaattcctacccaactaatttcacatacgcac

SEQ ID NO: 10832 - DNA, 34 bp, Artificial Sequence
  Primer
aaagaattcctacccaagttgattagctccacac

SEQ ID NO: 10833 - DNA, 31 bp, Artificial Sequence
  Primer
aaagaattcctacgacactggcattgacaag

SEQ ID NO: 10834 - DNA, 33 bp, Artificial Sequence
  Primer
aaagaattcctacgactcgacactgactacgtg

SEQ ID NO: 10835 - DNA, 34 bp, Artificial Sequence
  Primer
aaagaattcctacgatttcacacgacaatgactc

SEQ ID NO: 10836 - DNA, 32 bp, Artificial Sequence
  Primer
aaagaattcctacgcctcatcacaatcacaac

SEQ ID NO: 10837 - DNA, 34 bp, Artificial Sequence
  Primer
aaagaattcctacttctgatgttcacaggactgc

SEQ ID NO: 10838 - DNA, 34 bp, Artificial Sequence
  Primer
aaagaattcctagacgagatacgcctggtatttg

SEQ ID NO: 10839 - DNA, 34 bp, Artificial Sequence
  Primer
aaagaattcctagctggaagtgttgctgtagatg

SEQ ID NO: 10840 - DNA, 31 bp, Artificial Sequence
  Primer
aaagaattcctaggagcgtgaagtcatctgc

SEQ ID NO: 10841 - DNA, 34 bp, Artificial Sequence
  Primer
aaagaattcctaggcctgagcatacacaaacaac

SEQ ID NO: 10842 - DNA, 31 bp, Artificial Sequence
  Primer
aaagaattcctaggtatggcatccacgttcc

SEQ ID NO: 10843 - DNA, 34 bp, Artificial Sequence
  Primer
aaagaattcctatactgctcctctgcttgatttg

SEQ ID NO: 10844 - DNA, 34 bp, Artificial Sequence
  Primer
aaagaattcctatcaacatttatgtgagccatcg

SEQ ID NO: 10845 - DNA, 32 bp, Artificial Sequence
  Primer
aaagaattcctatctagctcgtcccaagttgc

SEQ ID NO: 10846 - DNA, 39 bp, Artificial Sequence
  Primer
aaagaattcctatgagaacattacattcttcagttatgg

SEQ ID NO: 10847 - DNA, 34 bp, Artificial Sequence
  Primer
aaagaattcctatgtgacttcaaatggaacaacc

SEQ ID NO: 10848 - DNA, 35 bp, Artificial Sequence
  Primer
aaagaattcctattcacacccaagttgattagctc

SEQ ID NO: 10849 - DNA, 35 bp, Artificial Sequence
  Primer
aaagaattcctatttgctcttcaacaacatcttcc

SEQ ID NO: 10850 - DNA, 31 bp, Artificial Sequence
  Primer
aaagaattcctcatcagatcgagagctccac

SEQ ID NO: 10851 - DNA, 31 bp, Artificial Sequence
  Primer
aaagaattcctcatgtaccacaacacgaagc

SEQ ID NO: 10852 - DNA, 30 bp, Artificial Sequence
  Primer
aaagaattcctgctctactcatgctcccac

SEQ ID NO: 10853 - DNA, 31 bp, Artificial Sequence
  Primer
aaagaattcctgcttgcctcttgcttacatc

SEQ ID NO: 10854 - DNA, 31 bp, Artificial Sequence
  Primer
aaagaattcctgtttgcattcttgctcaatg

SEQ ID NO: 10855 - DNA, 31 bp, Artificial Sequence
  Primer
aaagaattccttagattcccacgagcaagtc

SEQ ID NO: 10856 - DNA, 33 bp, Artificial Sequence
  Primer
aaagaattccttcttcactctgcaaatatggtg

SEQ ID NO: 10857 - DNA, 31 bp, Artificial Sequence
  Primer
aaagaattcgaaggtacatgcatttgtgtcc

SEQ ID NO: 10858 - DNA, 31 bp, Artificial Sequence
  Primer
aaagaattcgacaagtaggatctcacggctc

SEQ ID NO: 10859 - DNA, 31 bp, Artificial Sequence
  Primer
aaagaattcgacacacggtgaaactgaactg

SEQ ID NO: 10860 - DNA, 29 bp, Artificial Sequence
  Primer
aaagaattcgactcatctcgacgcggtag

SEQ ID NO: 10861 - DNA, 31 bp, Artificial Sequence
  Primer
aaagaattcgacttcggagtacagcaacagc

SEQ ID NO: 10862 - DNA, 29 bp, Artificial Sequence
  Primer
aaagaattcgagcagcaagtaatccggtc

SEQ ID NO: 10863 - DNA, 31 bp, Artificial Sequence
  Primer
aaagaattcgagcctatgttcatatgccacc

SEQ ID NO: 10864 - DNA, 29 bp, Artificial Sequence
  Primer
aaagaattcgaggcacagcagatggagta

SEQ ID NO: 10865 - DNA, 31 bp, Artificial Sequence
  Primer
aaagaattcgatgaaccacaatgctgtcaac

SEQ ID NO: 10866 - DNA, 31 bp, Artificial Sequence
  Primer
aaagaattcgattcattcaggttcgttcgtc

SEQ ID NO: 10867 - DNA, 31 bp, Artificial Sequence
  Primer
aaagaattcgcaaactggttgattggtatgc

SEQ ID NO: 10868 - DNA, 32 bp, Artificial Sequence
  Primer
aaagaattcgcacaggttccactaaattcttg

SEQ ID NO: 10869 - DNA, 31 bp, Artificial Sequence
  Primer
aaagaattcgcagaaggagcagcaagtaatc

SEQ ID NO: 10870 - DNA, 31 bp, Artificial Sequence
  Primer
aaagaattcgcatgggcaatagaagtatgtg

SEQ ID NO: 10871 - DNA, 31 bp, Artificial Sequence
  Primer
aaagaattcgcattgaatagcagaagtgcag

SEQ ID NO: 10872 - DNA, 30 bp, Artificial Sequence
  Primer
aaagaattcgccaaatttcaagagcaaacc

SEQ ID NO: 10873 - DNA, 27 bp, Artificial Sequence
  Primer
aaagaattcgccatggagatggtcctg

SEQ ID NO: 10874 - DNA, 31 bp, Artificial Sequence
  Primer
aaagaattcgccgagtttactcatgacaatg

SEQ ID NO: 10875 - DNA, 34 bp, Artificial Sequence
  Primer
aaagaattcgcgataatctaccaaattgacaaac

SEQ ID NO: 10876 - DNA, 31 bp, Artificial Sequence
  Primer
aaagaattcgcgcacagtttcacacactaac

SEQ ID NO: 10877 - DNA, 31 bp, Artificial Sequence
  Primer
aaagaattcgcttactggagagcagcatagg

SEQ ID NO: 10878 - DNA, 31 bp, Artificial Sequence
  Primer
aaagaattcggactctcaacaaggactcgac

SEQ ID NO: 10879 - DNA, 30 bp, Artificial Sequence
  Primer
aaagaattcggagtacagcaacagcaatgg

SEQ ID NO: 10880 - DNA, 31 bp, Artificial Sequence
  Primer
aaagaattcggcagagtgctacattgacaag

SEQ ID NO: 10881 - DNA, 31 bp, Artificial Sequence
  Primer
aaagaattcggcttcatccatgtacaattcc

SEQ ID NO: 10882 - DNA, 32 bp, Artificial Sequence
  Primer
aaagaattcgggcatcaatgtcgtgtactaat

SEQ ID NO: 10883 - DNA, 31 bp, Artificial Sequence
  Primer
aaagaattcgtacacggcaaattcacacctc

SEQ ID NO: 10884 - DNA, 31 bp, Artificial Sequence
  Primer
aaagaattcgtcaagcacaatttagcagcag

SEQ ID NO: 10885 - DNA, 31 bp, Artificial Sequence
  Primer
aaagaattcgtcctgctatctgctgtcattg

SEQ ID NO: 10886 - DNA, 29 bp, Artificial Sequence
  Primer
aaagaattcgtcgtttcgctctcagttgg

SEQ ID NO: 10887 - DNA, 31 bp, Artificial Sequence
  Primer
aaagaattcgtctttggtccctacgtgaatc

SEQ ID NO: 10888 - DNA, 31 bp, Artificial Sequence
  Primer
aaagaattcgtgatgctgatgaacatccttg

SEQ ID NO: 10889 - DNA, 27 bp, Artificial Sequence
  Primer
aaagaattcgtgggaggcacagcagat

SEQ ID NO: 10890 - DNA, 31 bp, Artificial Sequence
  Primer
aaagaattcgtgtttcgtcacaactgcaatc

SEQ ID NO: 10891 - DNA, 29 bp, Artificial Sequence
  Primer
aaagaattcgttgctctctctcctcggtc

SEQ ID NO: 10892 - DNA, 31 bp, Artificial Sequence
  Primer
aaagaattctaaaggatggctttattcgacg

SEQ ID NO: 10893 - DNA, 31 bp, Artificial Sequence
  Primer
aaagaattctaatgcccaaagctgattcttg

SEQ ID NO: 10894 - DNA, 32 bp, Artificial Sequence
  Primer
aaagaattctacaagacacaagccactgaaac

SEQ ID NO: 10895 - DNA, 31 bp, Artificial Sequence
  Primer
aaagaattctacaattggcttggctcttctc

SEQ ID NO: 10896 - DNA, 31 bp, Artificial Sequence
  Primer
aaagaattctactaaacgaggaaatggggaa

SEQ ID NO: 10897 - DNA, 31 bp, Artificial Sequence
  Primer
aaagaattctagcatacaaggcccatactgc

SEQ ID NO: 10898 - DNA, 31 bp, Artificial Sequence
  Primer
aaagaattctagcctccatgtataggcacag

SEQ ID NO: 10899 - DNA, 33 bp, Artificial Sequence
  Primer
aaagaattctagcttgcatactagcatcaggtg

SEQ ID NO: 10900 - DNA, 31 bp, Artificial Sequence
  Primer
aaagaattctatagggccaatcaagatgcac

SEQ ID NO: 10901 - DNA, 32 bp, Artificial Sequence
  Primer
aaagaattctcaaaactcctgcacagcaccat

SEQ ID NO: 10902 - DNA, 31 bp, Artificial Sequence
  Primer
aaagaattctcaagagcaggaggactagagc

SEQ ID NO: 10903 - DNA, 34 bp, Artificial Sequence
  Primer
aaagaattctcaagcaaggtaagctagaatcaac

SEQ ID NO: 10904 - DNA, 33 bp, Artificial Sequence
  Primer
aaagaattctcaccatttcatcatacttcaacc

SEQ ID NO: 10905 - DNA, 29 bp, Artificial Sequence
  Primer
aaagaattctcagatcgagagctccacag

SEQ ID NO: 10906 - DNA, 38 bp, Artificial Sequence
  Primer
aaagaattctcagtatcaaatattcaagcctcaacgta

SEQ ID NO: 10907 - DNA, 32 bp, Artificial Sequence
  Primer
aaagaattctcatatacgacgacgacgacgac

SEQ ID NO: 10908 - DNA, 31 bp, Artificial Sequence
  Primer
aaagaattctcattagccacatcaatccaac

SEQ ID NO: 10909 - DNA, 31 bp, Artificial Sequence
  Primer
aaagaattctccaagtcaaacatggtacatc

SEQ ID NO: 10910 - DNA, 31 bp, Artificial Sequence
  Primer
aaagaattctccagcacataacaccagagac

SEQ ID NO: 10911 - DNA, 34 bp, Artificial Sequence
  Primer
aaagaattctcctattcctttggaactctctctc

SEQ ID NO: 10912 - DNA, 33 bp, Artificial Sequence
  Primer
aaagaattctgcaccttaacagcaacagattac

SEQ ID NO: 10913 - DNA, 33 bp, Artificial Sequence
  Primer
aaagaattctgccctccttaacctttaattctc

SEQ ID NO: 10914 - DNA, 31 bp, Artificial Sequence
  Primer
aaagaattctggtcttgaaaggaacaactcc

SEQ ID NO: 10915 - DNA, 34 bp, Artificial Sequence
  Primer
aaagaattctggtggctacctacagatcattaca

SEQ ID NO: 10916 - DNA, 36 bp, Artificial Sequence
  Primer
aaagaattctgtctcatccaaatctattctcttctg

SEQ ID NO: 10917 - DNA, 31 bp, Artificial Sequence
  Primer
aaagaattcttaacacaaactcctgcacagc

SEQ ID NO: 10918 - DNA, 36 bp, Artificial Sequence
  Primer
aaagaattcttaacacacgtagtacaacgtagggca

SEQ ID NO: 10919 - DNA, 31 bp, Artificial Sequence
  Primer
aaagaattcttacatccctcggctcctaaac

SEQ ID NO: 10920 - DNA, 35 bp, Artificial Sequence
  Primer
aaagaattcttattacataagtaggcgaaacgatg

SEQ ID NO: 10921 - DNA, 30 bp, Artificial Sequence
  Primer
aaagaattcttcagattctcaaggtccacg

SEQ ID NO: 10922 - DNA, 31 bp, Artificial Sequence
  Primer
aaagaattcttctccaattgacaagggctac

SEQ ID NO: 10923 - DNA, 31 bp, Artificial Sequence
  Primer
aaagaattcttctgagctccatatctcggtc

SEQ ID NO: 10924 - DNA, 31 bp, Artificial Sequence
  Primer
aaagaattcttcttccgttattcacctctgg

SEQ ID NO: 10925 - DNA, 30 bp, Artificial Sequence
  Primer
aaagaattcttcttgttagtggcctccttg

SEQ ID NO: 10926 - DNA, 31 bp, Artificial Sequence
  Primer
aaagaattcttggtatgcaggagttgagttc

SEQ ID NO: 10927 - DNA, 31 bp, Artificial Sequence
  Primer
aaagagctcaaatgcctgactacacctccac

SEQ ID NO: 10928 - DNA, 31 bp, Artificial Sequence
  Primer
aaagagctcaacgggaagtcgattaaagagg

SEQ ID NO: 10929 - DNA, 30 bp, Artificial Sequence
  Primer
aaagagctcaatggatggaggtgacctgac

SEQ ID NO: 10930 - DNA, 31 bp, Artificial Sequence
  Primer
aaagagctcatagcaactgaaaccgaaccag

SEQ ID NO: 10931 - DNA, 30 bp, Artificial Sequence
  Primer
aaagagctcattatcagcagccagtcggtc

SEQ ID NO: 10932 - DNA, 32 bp, Artificial Sequence
  Primer
aaagagctccaaatgcagtccattaaagcaag

SEQ ID NO: 10933 - DNA, 31 bp, Artificial Sequence
  Primer
aaagagctccgtaacccaagcaatgttcaag

SEQ ID NO: 10934 - DNA, 35 bp, Artificial Sequence
  Primer
aaagagctcctaagtttcaaccatacaacacttgg

SEQ ID NO: 10935 - DNA, 31 bp, Artificial Sequence
  Primer
aaagagctcgaaatggctttacacaccgaac

SEQ ID NO: 10936 - DNA, 31 bp, Artificial Sequence
  Primer
aaagagctcgcctgatgatgattacacaacc

SEQ ID NO: 10937 - DNA, 33 bp, Artificial Sequence
  Primer
aaagagctctgcagtccattaaagcaagtttac

SEQ ID NO: 10938 - DNA, 31 bp, Artificial Sequence
  Primer
aaagagctctgtttcttccaaatttcaatgg

SEQ ID NO: 10939 - DNA, 39 bp, Artificial Sequence
  Primer
aaagagctcttaatagtagtacactctgcatacctttgc

SEQ ID NO: 10940 - DNA, 30 bp, Artificial Sequence
  Primer
aaagatatcaaaggaatatgccactcgctc

SEQ ID NO: 10941 - DNA, 31 bp, Artificial Sequence
  Primer
aaagatatcaacctttactgccgtgtgattc

SEQ ID NO: 10942 - DNA, 31 bp, Artificial Sequence
  Primer
aaagatatcaagagaaagaggcgtcatcaac

SEQ ID NO: 10943 - DNA, 29 bp, Artificial Sequence
  Primer
aaagatatcaatccaagatcgccaagtcc

SEQ ID NO: 10944 - DNA, 30 bp, Artificial Sequence
  Primer
aaagatatcaatcttgagccggttctgttc

SEQ ID NO: 10945 - DNA, 28 bp, Artificial Sequence
  Primer
aaagatatcactccagcctccaaggaac

SEQ ID NO: 10946 - DNA, 28 bp, Artificial Sequence
  Primer
aaagatatcagatccgctgaggtggaac

SEQ ID NO: 10947 - DNA, 29 bp, Artificial Sequence
  Primer
aaagatatcaggaggagagatccgctgag

SEQ ID NO: 10948 - DNA, 31 bp, Artificial Sequence
  Primer
aaagatatcatgacacagagaaacggacatc

SEQ ID NO: 10949 - DNA, 31 bp, Artificial Sequence
  Primer
aaagatatcatttggaaccgatgacacagag

SEQ ID NO: 10950 - DNA, 31 bp, Artificial Sequence
  Primer
aaagatatccaacaatggcaagaatcaaatg

SEQ ID NO: 10951 - DNA, 27 bp, Artificial Sequence
  Primer
aaagatatccatttctgggtctccgca

SEQ ID NO: 10952 - DNA, 29 bp, Artificial Sequence
  Primer
aaagatatcccttacccctattgcgcttg

SEQ ID NO: 10953 - DNA, 31 bp, Artificial Sequence
  Primer
aaagatatccgagtacttccgtcatctcctc

SEQ ID NO: 10954 - DNA, 31 bp, Artificial Sequence
  Primer
aaagatatcctacatgctagcggtgacgaac

SEQ ID NO: 10955 - DNA, 30 bp, Artificial Sequence
  Primer
aaagatatcctcctacatgctagcggtgac

SEQ ID NO: 10956 - DNA, 30 bp, Artificial Sequence
  Primer
aaagatatcctgcttccatcgcatactctc

SEQ ID NO: 10957 - DNA, 26 bp, Artificial Sequence
  Primer
aaagatatcgcacctgccagatctgc

SEQ ID NO: 10958 - DNA, 29 bp, Artificial Sequence
  Primer
aaagatatcgcatactctcgcctctgacc

SEQ ID NO: 10959 - DNA, 26 bp, Artificial Sequence
  Primer
aaagatatcgccggagctcggtaatg

SEQ ID NO: 10960 - DNA, 28 bp, Artificial Sequence
  Primer
aaagatatctacaaaagccgcgagaagc

SEQ ID NO: 10961 - DNA, 33 bp, Artificial Sequence
  Primer
aaagatatctctgagagatcacaccttcagttc

SEQ ID NO: 10962 - DNA, 34 bp, Artificial Sequence
  Primer
aaagatatctggctgaagctagttaagttcaaag

SEQ ID NO: 10963 - DNA, 32 bp, Artificial Sequence
  Primer
aaagatatctgttcaactccagtgattgattg

SEQ ID NO: 10964 - DNA, 32 bp, Artificial Sequence
  Primer
aaagatatcttacggcatgtagatgtacgtgt

SEQ ID NO: 10965 - DNA, 28 bp, Artificial Sequence
  Primer
aaaggatccaaaccctagcttcgcccag

SEQ ID NO: 10966 - DNA, 28 bp, Artificial Sequence
  Primer
aaaggatccaaaggagccgaaacagcac

SEQ ID NO: 10967 - DNA, 35 bp, Artificial Sequence
  Primer
aaaggatccaaatagtggtgtaattctctgggaag

SEQ ID NO: 10968 - DNA, 31 bp, Artificial Sequence
  Primer
aaaggatccaaatcactcgtccaagaacacc

SEQ ID NO: 10969 - DNA, 28 bp, Artificial Sequence
  Primer
aaaggatccaacattgcctccgtgtctc

SEQ ID NO: 10970 - DNA, 28 bp, Artificial Sequence
  Primer
aaaggatccaaccctcgctccatcactc

SEQ ID NO: 10971 - DNA, 31 bp, Artificial Sequence
  Primer
aaaggatccaacccttctcccacatttatcc

SEQ ID NO: 10972 - DNA, 31 bp, Artificial Sequence
  Primer
aaaggatccaaccttcagttcagggaaagtg

SEQ ID NO: 10973 - DNA, 30 bp, Artificial Sequence
  Primer
aaaggatccaacgaaacgaggtactgggag

SEQ ID NO: 10974 - DNA, 31 bp, Artificial Sequence
  Primer
aaaggatccaactcctacctacgcagcagag

SEQ ID NO: 10975 - DNA, 28 bp, Artificial Sequence
  Primer
aaaggatccaactcttcgagggtcgctg

SEQ ID NO: 10976 - DNA, 31 bp, Artificial Sequence
  Primer
aaaggatccaaggttgaagaggcagatcaag

SEQ ID NO: 10977 - DNA, 31 bp, Artificial Sequence
  Primer
aaaggatccaagtacacctgtcggaccaaag

SEQ ID NO: 10978 - DNA, 30 bp, Artificial Sequence
  Primer
aaaggatccaagttaccaacggcgtaccac

SEQ ID NO: 10979 - DNA, 32 bp, Artificial Sequence
  Primer
aaaggatccaatcaaaccatcttccaccattc

SEQ ID NO: 10980 - DNA, 28 bp, Artificial Sequence
  Primer
aaaggatccaattccggagcagcaagag

SEQ ID NO: 10981 - DNA, 34 bp, Artificial Sequence
  Primer
aaaggatccaattcttcatctttctcaagcatcc

SEQ ID NO: 10982 - DNA, 31 bp, Artificial Sequence
  Primer
aaaggatccaattgcaatcttctcggttgtg

SEQ ID NO: 10983 - DNA, 30 bp, Artificial Sequence
  Primer
aaaggatccacacgaagtgaaatcctctgc

SEQ ID NO: 10984 - DNA, 27 bp, Artificial Sequence
  Primer
aaaggatccacagcagtacgggccaac

SEQ ID NO: 10985 - DNA, 31 bp, Artificial Sequence
  Primer
aaaggatccacagtaacacaagcacctgagc

SEQ ID NO: 10986 - DNA, 30 bp, Artificial Sequence
  Primer
aaaggatccaccaccacctttaattcctgc

SEQ ID NO: 10987 - DNA, 35 bp, Artificial Sequence
  Primer
aaaggatccaccacccacgatattgatattaactg

SEQ ID NO: 10988 - DNA, 27 bp, Artificial Sequence
  Primer
aaaggatccaccacttcagcagccagg

SEQ ID NO: 10989 - DNA, 27 bp, Artificial Sequence
  Primer
aaaggatccacccagcacagcagtacg

SEQ ID NO: 10990 - DNA, 30 bp, Artificial Sequence
  Primer
aaaggatccaccttgatctcgtctccttcc

SEQ ID NO: 10991 - DNA, 31 bp, Artificial Sequence
  Primer
aaaggatccacgagaacaaaggtagcaaagc

SEQ ID NO: 10992 - DNA, 31 bp, Artificial Sequence
  Primer
aaaggatccacgagttctgggtctgattctc

SEQ ID NO: 10993 - DNA, 31 bp, Artificial Sequence
  Primer
aaaggatccacgatctgcttcatttctcctc

SEQ ID NO: 10994 - DNA, 31 bp, Artificial Sequence
  Primer
aaaggatccacggagctagcaacaatcactg

SEQ ID NO: 10995 - DNA, 33 bp, Artificial Sequence
  Primer
aaaggatccacgtctcttgagtcttcttcttcc

SEQ ID NO: 10996 - DNA, 31 bp, Artificial Sequence
  Primer
aaaggatccactccacgtcaatccacaactc

SEQ ID NO: 10997 - DNA, 30 bp, Artificial Sequence
  Primer
aaaggatccactctcgcctgttcctctacc

SEQ ID NO: 10998 - DNA, 29 bp, Artificial Sequence
  Primer
aaaggatccagaatataaccgccgccttg

SEQ ID NO: 10999 - DNA, 30 bp, Artificial Sequence
  Primer
aaaggatccagacaagagcaaccggacaag

SEQ ID NO: 11000 - DNA, 31 bp, Artificial Sequence
  Primer
aaaggatccagatatacccgcagcaattcag

SEQ ID NO: 11001 - DNA, 31 bp, Artificial Sequence
  Primer
aaaggatccagcaaatcaaaccatcttccac

SEQ ID NO: 11002 - DNA, 31 bp, Artificial Sequence
  Primer
aaaggatccagcagacagcatcctacctacg

SEQ ID NO: 11003 - DNA, 31 bp, Artificial Sequence
  Primer
aaaggatccagcagacaggagcaacattcac

SEQ ID NO: 11004 - DNA, 28 bp, Artificial Sequence
  Primer
aaaggatccagcagtggtggaagggttg

SEQ ID NO: 11005 - DNA, 28 bp, Artificial Sequence
  Primer
aaaggatccagcgagtcgtccactctcc

SEQ ID NO: 11006 - DNA, 28 bp, Artificial Sequence
  Primer
aaaggatccagcttccacaaggctcgac

SEQ ID NO: 11007 - DNA, 30 bp, Artificial Sequence
  Primer
aaaggatccaggaagagacgacgacgagac

SEQ ID NO: 11008 - DNA, 28 bp, Artificial Sequence
  Primer
aaaggatccaggctcatgtccactgctg

SEQ ID NO: 11009 - DNA, 30 bp, Artificial Sequence
  Primer
aaaggatccaggttatctgcactgcaccac

SEQ ID NO: 11010 - DNA, 32 bp, Artificial Sequence
  Primer
aaaggatccagtcacagtaacacaagcacctg

SEQ ID NO: 11011 - DNA, 30 bp, Artificial Sequence
  Primer
aaaggatccagtccagttcctttgcgaaac

SEQ ID NO: 11012 - DNA, 31 bp, Artificial Sequence
  Primer
aaaggatccagttcccactccactcatcctc

SEQ ID NO: 11013 - DNA, 28 bp, Artificial Sequence
  Primer
aaaggatccatcatcaacggccaagctc

SEQ ID NO: 11014 - DNA, 30 bp, Artificial Sequence
  Primer
aaaggatccatccctagacgagagagctgg

SEQ ID NO: 11015 - DNA, 29 bp, Artificial Sequence
  Primer
aaaggatccatcctcgagttggtccaagt

SEQ ID NO: 11016 - DNA, 31 bp, Artificial Sequence
  Primer
aaaggatccatcgagcaaacatctctgaacc

SEQ ID NO: 11017 - DNA, 30 bp, Artificial Sequence
  Primer
aaaggatccatcggccgtagtatcttgctc

SEQ ID NO: 11018 - DNA, 31 bp, Artificial Sequence
  Primer
aaaggatccatctcgctctttagcctgtagc

SEQ ID NO: 11019 - DNA, 30 bp, Artificial Sequence
  Primer
aaaggatccatctgggaaggtctcgtcttg

SEQ ID NO: 11020 - DNA, 31 bp, Artificial Sequence
  Primer
aaaggatccatgtttgtcgtgaagtgctctg

SEQ ID NO: 11021 - DNA, 29 bp, Artificial Sequence
  Primer
aaaggatccattcacacacgctctccctc

SEQ ID NO: 11022 - DNA, 31 bp, Artificial Sequence
  Primer
aaaggatccattccaagaacccaagtgaatc

SEQ ID NO: 11023 - DNA, 28 bp, Artificial Sequence
  Primer
aaaggatccattgatcgtcatccgcttc

SEQ ID NO: 11024 - DNA, 28 bp, Artificial Sequence
  Primer
aaaggatccatttcttcgcttccccagc

SEQ ID NO: 11025 - DNA, 30 bp, Artificial Sequence
  Primer
aaaggatccatttgattcgcgttcctcttc

SEQ ID NO: 11026 - DNA, 33 bp, Artificial Sequence
  Primer
aaaggatcccaaatcagaatcatcctcaaactg

SEQ ID NO: 11027 - DNA, 31 bp, Artificial Sequence
  Primer
aaaggatcccaacaatttcgtctcccgttac

SEQ ID NO: 11028 - DNA, 29 bp, Artificial Sequence
  Primer
aaaggatcccaacattcacggacggaaac

SEQ ID NO: 11029 - DNA, 26 bp, Artificial Sequence
  Primer
aaaggatcccaaccagccaaggcaag

SEQ ID NO: 11030 - DNA, 30 bp, Artificial Sequence
  Primer
aaaggatcccaagcatcaatcttgcaaagc

SEQ ID NO: 11031 - DNA, 27 bp, Artificial Sequence
  Primer
aaaggatcccaaggcaagcgagcagag

SEQ ID NO: 11032 - DNA, 33 bp, Artificial Sequence
  Primer
aaaggatcccaatatccacattcaaatcaaacc

SEQ ID NO: 11033 - DNA, 36 bp, Artificial Sequence
  Primer
aaaggatcccaatcaaatagtggtgtaattctctgg

SEQ ID NO: 11034 - DNA, 32 bp, Artificial Sequence
  Primer
aaaggatcccacacgtgcgctaataagctaag

SEQ ID NO: 11035 - DNA, 30 bp, Artificial Sequence
  Primer
aaaggatcccaccggatctattggtcgttc

SEQ ID NO: 11036 - DNA, 31 bp, Artificial Sequence
  Primer
aaaggatcccacctgtcggaccaaagtaaac

SEQ ID NO: 11037 - DNA, 32 bp, Artificial Sequence
  Primer
aaaggatcccagcaaattaattaggaacccct

SEQ ID NO: 11038 - DNA, 30 bp, Artificial Sequence
  Primer
aaaggatcccagctgcctctcctctctttg

SEQ ID NO: 11039 - DNA, 31 bp, Artificial Sequence
  Primer
aaaggatcccagctttagcttccacttccac

SEQ ID NO: 11040 - DNA, 29 bp, Artificial Sequence
  Primer
aaaggatcccaggatcactctctcggctg

SEQ ID NO: 11041 - DNA, 31 bp, Artificial Sequence
  Primer
aaaggatcccagtccaccaccacaagtagag

SEQ ID NO: 11042 - DNA, 31 bp, Artificial Sequence
  Primer
aaaggatcccagtctttcttggtcgttcctc

SEQ ID NO: 11043 - DNA, 31 bp, Artificial Sequence
  Primer
aaaggatcccatcaatcttgcaaagcaaagc

SEQ ID NO: 11044 - DNA, 28 bp, Artificial Sequence
  Primer
aaaggatcccatcacccttgctacctcg

SEQ ID NO: 11045 - DNA, 31 bp, Artificial Sequence
  Primer
aaaggatcccatcagcccacatattcttcac

SEQ ID NO: 11046 - DNA, 29 bp, Artificial Sequence
  Primer
aaaggatcccatcataacgccactcccac

SEQ ID NO: 11047 - DNA, 28 bp, Artificial Sequence
  Primer
aaaggatcccatcatctccaccaccacc

SEQ ID NO: 11048 - DNA, 28 bp, Artificial Sequence
  Primer
aaaggatcccatccatccaccaggaaag

SEQ ID NO: 11049 - DNA, 26 bp, Artificial Sequence
  Primer
aaaggatcccatccgatcatggccaa

SEQ ID NO: 11050 - DNA, 32 bp, Artificial Sequence
  Primer
aaaggatcccatccttgtgcataatttgttcc

SEQ ID NO: 11051 - DNA, 30 bp, Artificial Sequence
  Primer
aaaggatcccatttgcaaacaattcgactg

SEQ ID NO: 11052 - DNA, 28 bp, Artificial Sequence
  Primer
aaaggatcccatttgcatccgtctcagg

SEQ ID NO: 11053 - DNA, 28 bp, Artificial Sequence
  Primer
aaaggatccccaagaacctcatcggctc

SEQ ID NO: 11054 - DNA, 24 bp, Artificial Sequence
  Primer
aaaggatccccaggccagcaagcc

SEQ ID NO: 11055 - DNA, 31 bp, Artificial Sequence
  Primer
aaaggatccccagtatgcaactttagccctg

SEQ ID NO: 11056 - DNA, 31 bp, Artificial Sequence
  Primer
aaaggatccccataatttctgtgtgtggtcg

SEQ ID NO: 11057 - DNA, 30 bp, Artificial Sequence
  Primer
aaaggatccccatccatctacaagcagcag

SEQ ID NO: 11058 - DNA, 27 bp, Artificial Sequence
  Primer
aaaggatccccatctcccagaggaagc

SEQ ID NO: 11059 - DNA, 36 bp, Artificial Sequence
  Primer
aaaggatcccccacgatattgatattaactgaaacc

SEQ ID NO: 11060 - DNA, 31 bp, Artificial Sequence
  Primer
aaaggatcccccatttctccctctctcaaac

SEQ ID NO: 11061 - DNA, 28 bp, Artificial Sequence
  Primer
aaaggatcccccggaactcctatccaac

SEQ ID NO: 11062 - DNA, 31 bp, Artificial Sequence
  Primer
aaaggatccccgacaccttatcatcatcatc

SEQ ID NO: 11063 - DNA, 30 bp, Artificial Sequence
  Primer
aaaggatccccgcatcgtatagtcatccag

SEQ ID NO: 11064 - DNA, 28 bp, Artificial Sequence
  Primer
aaaggatccccggagctgtttcttcgtc

SEQ ID NO: 11065 - DNA, 32 bp, Artificial Sequence
  Primer
aaaggatccccgtctttaacacttttcaatgg

SEQ ID NO: 11066 - DNA, 28 bp, Artificial Sequence
  Primer
aaaggatcccctcccaaatgacaccaaa

SEQ ID NO: 11067 - DNA, 32 bp, Artificial Sequence
  Primer
aaaggatcccctcttactaaccattcccaacc

SEQ ID NO: 11068 - DNA, 38 bp, Artificial Sequence
  Primer
aaaggatccccttacttgaacaggatctgttctatagg

SEQ ID NO: 11069 - DNA, 29 bp, Artificial Sequence
  Primer
aaaggatccccttagcttccacaaggctc

SEQ ID NO: 11070 - DNA, 31 bp, Artificial Sequence
  Primer
aaaggatcccgagagcttagcgaagtacagc

SEQ ID NO: 11071 - DNA, 30 bp, Artificial Sequence
  Primer
aaaggatcccgatatccgttgcagtacgac

SEQ ID NO: 11072 - DNA, 27 bp, Artificial Sequence
  Primer
aaaggatcccgatcccaatggagcttc

SEQ ID NO: 11073 - DNA, 31 bp, Artificial Sequence
  Primer
aaaggatcccgattcctcgtctattccagag

SEQ ID NO: 11074 - DNA, 27 bp, Artificial Sequence
  Primer
aaaggatcccggacaccacttcagcag

SEQ ID NO: 11075 - DNA, 29 bp, Artificial Sequence
  Primer
aaaggatcccggcacagtctttcttggtc

SEQ ID NO: 11076 - DNA, 31 bp, Artificial Sequence
  Primer
aaaggatcccgtcaagaggttgaagcaagac

SEQ ID NO: 11077 - DNA, 28 bp, Artificial Sequence
  Primer
aaaggatcccgtcctcaccagggtacag

SEQ ID NO: 11078 - DNA, 29 bp, Artificial Sequence
  Primer
aaaggatcccgtggttcagcttaattcgg

SEQ ID NO: 11079 - DNA, 31 bp, Artificial Sequence
  Primer
aaaggatccctagcaggaggcggtagagtag

SEQ ID NO: 11080 - DNA, 27 bp, Artificial Sequence
  Primer
aaaggatccctattccatcgtccgctc

SEQ ID NO: 11081 - DNA, 28 bp, Artificial Sequence
  Primer
aaaggatccctccagttctccgcctctc

SEQ ID NO: 11082 - DNA, 31 bp, Artificial Sequence
  Primer
aaaggatccctccgccaccattaacagtaac

SEQ ID NO: 11083 - DNA, 31 bp, Artificial Sequence
  Primer
aaaggatccctcctcaccctgaatcaaactc

SEQ ID NO: 11084 - DNA, 28 bp, Artificial Sequence
  Primer
aaaggatccctcctccaatcctccgaac

SEQ ID NO: 11085 - DNA, 29 bp, Artificial Sequence
  Primer
aaaggatccctcctcccttggaatggaac

SEQ ID NO: 11086 - DNA, 30 bp, Artificial Sequence
  Primer
aaaggatccctcgaatcaagcacagctctc

SEQ ID NO: 11087 - DNA, 27 bp, Artificial Sequence
  Primer
aaaggatccctcgcctccatccaaatc

SEQ ID NO: 11088 - DNA, 31 bp, Artificial Sequence
  Primer
aaaggatccctcgcttcatatatcctcctgc

SEQ ID NO: 11089 - DNA, 31 bp, Artificial Sequence
  Primer
aaaggatccctcttaccagagccacctcctc

SEQ ID NO: 11090 - DNA, 29 bp, Artificial Sequence
  Primer
aaaggatccctcttctcagcttgccatcc

SEQ ID NO: 11091 - DNA, 28 bp, Artificial Sequence
  Primer
aaaggatccctgaggttcctgatcgcac

SEQ ID NO: 11092 - DNA, 30 bp, Artificial Sequence
  Primer
aaaggatccctgattccgtttccgtttctc

SEQ ID NO: 11093 - DNA, 27 bp, Artificial Sequence
  Primer
aaaggatccctgccgattcgaaagcac

SEQ ID NO: 11094 - DNA, 30 bp, Artificial Sequence
  Primer
aaaggatcccttccaccagtccacattcac

SEQ ID NO: 11095 - DNA, 32 bp, Artificial Sequence
  Primer
aaaggatcccttccctccaattacacaaacac

SEQ ID NO: 11096 - DNA, 30 bp, Artificial Sequence
  Primer
aaaggatcccttctcgtcttcggatcacac

SEQ ID NO: 11097 - DNA, 31 bp, Artificial Sequence
  Primer
aaaggatcccttctgtatccgatcccaacac

SEQ ID NO: 11098 - DNA, 32 bp, Artificial Sequence
  Primer
aaaggatccctttcctattccttctcgtttgc

SEQ ID NO: 11099 - DNA, 31 bp, Artificial Sequence
  Primer
aaaggatccctttgcacttcgaatagcagtc

SEQ ID NO: 11100 - DNA, 30 bp, Artificial Sequence
  Primer
aaaggatccgacaaggccaaaccctagaac

SEQ ID NO: 11101 - DNA, 29 bp, Artificial Sequence
  Primer
aaaggatccgacggattaagccaagatcg

SEQ ID NO: 11102 - DNA, 32 bp, Artificial Sequence
  Primer
aaaggatccgataagcagaggcagagagagag

SEQ ID NO: 11103 - DNA, 29 bp, Artificial Sequence
  Primer
aaaggatccgatacagcagaaacggccac

SEQ ID NO: 11104 - DNA, 31 bp, Artificial Sequence
  Primer
aaaggatccgatattccgcattcctacccag

SEQ ID NO: 11105 - DNA, 27 bp, Artificial Sequence
  Primer
aaaggatccgattcgaaagcacccgtc

SEQ ID NO: 11106 - DNA, 30 bp, Artificial Sequence
  Primer
aaaggatccgcaagcaagcaagtcactgag

SEQ ID NO: 11107 - DNA, 26 bp, Artificial Sequence
  Primer
aaaggatccgcaagtacgcccactgg

SEQ ID NO: 11108 - DNA, 32 bp, Artificial Sequence
  Primer
aaaggatccgcacagagagctagcatacatcg

SEQ ID NO: 11109 - DNA, 31 bp, Artificial Sequence
  Primer
aaaggatccgcactcgtcttcttcctagcag

SEQ ID NO: 11110 - DNA, 33 bp, Artificial Sequence
  Primer
aaaggatccgcatacatcgctagctcactttag

SEQ ID NO: 11111 - DNA, 29 bp, Artificial Sequence
  Primer
aaaggatccgccctcttcaatctttgcac

SEQ ID NO: 11112 - DNA, 29 bp, Artificial Sequence
  Primer
aaaggatccgcgaaccttgatctcgtctc

SEQ ID NO: 11113 - DNA, 29 bp, Artificial Sequence
  Primer
aaaggatccgcgtcttccaatcaccaatc

SEQ ID NO: 11114 - DNA, 28 bp, Artificial Sequence
  Primer
aaaggatccgctacgcaaacccttctcc

SEQ ID NO: 11115 - DNA, 29 bp, Artificial Sequence
  Primer
aaaggatccgctcacgccaccatcataac

SEQ ID NO: 11116 - DNA, 31 bp, Artificial Sequence
  Primer
aaaggatccgctcctccattaactcgttctc

SEQ ID NO: 11117 - DNA, 30 bp, Artificial Sequence
  Primer
aaaggatccgctcgattccttgatcctctc

SEQ ID NO: 11118 - DNA, 30 bp, Artificial Sequence
  Primer
aaaggatccgcttctcttaccagagccacc

SEQ ID NO: 11119 - DNA, 32 bp, Artificial Sequence
  Primer
aaaggatccggagattggagagtacaagcagg

SEQ ID NO: 11120 - DNA, 27 bp, Artificial Sequence
  Primer
aaaggatccggcagtcagtagcgcagc

SEQ ID NO: 11121 - DNA, 29 bp, Artificial Sequence
  Primer
aaaggatccgggtgtcttcctcgtctgtc

SEQ ID NO: 11122 - DNA, 31 bp, Artificial Sequence
  Primer
aaaggatccggtctctatccagtccacttgc

SEQ ID NO: 11123 - DNA, 30 bp, Artificial Sequence
  Primer
aaaggatccggtcttgggatcatccttgtg

SEQ ID NO: 11124 - DNA, 30 bp, Artificial Sequence
  Primer
aaaggatccgtacagacgtgctcctccttc

SEQ ID NO: 11125 - DNA, 30 bp, Artificial Sequence
  Primer
aaaggatccgtgcaatcgatctactcccag

SEQ ID NO: 11126 - DNA, 31 bp, Artificial Sequence
  Primer
aaaggatccgtggatagataggcagcgagtg

SEQ ID NO: 11127 - DNA, 31 bp, Artificial Sequence
  Primer
aaaggatccgtgtgaagaagactgccacaag

SEQ ID NO: 11128 - DNA, 29 bp, Artificial Sequence
  Primer
aaaggatccgttccatgagaccacagagc

SEQ ID NO: 11129 - DNA, 26 bp, Artificial Sequence
  Primer
aaaggatccgttcccgcgacagcttc

SEQ ID NO: 11130 - DNA, 29 bp, Artificial Sequence
  Primer
aaaggatccgttcctgatcgcaccatctc

SEQ ID NO: 11131 - DNA, 28 bp, Artificial Sequence
  Primer
aaaggatccgttctccgcctctccttcc

SEQ ID NO: 11132 - DNA, 30 bp, Artificial Sequence
  Primer
aaaggatccgttgaaattaacgaggccgac

SEQ ID NO: 11133 - DNA, 27 bp, Artificial Sequence
  Primer
aaaggatccgtttgctcgcaatccagc

SEQ ID NO: 11134 - DNA, 31 bp, Artificial Sequence
  Primer
aaaggatcctagagtgtggcttgtggtcttg

SEQ ID NO: 11135 - DNA, 31 bp, Artificial Sequence
  Primer
aaaggatcctagtagcagctaggggttgtcg

SEQ ID NO: 11136 - DNA, 29 bp, Artificial Sequence
  Primer
aaaggatcctatccaaccttcacccaagc

SEQ ID NO: 11137 - DNA, 31 bp, Artificial Sequence
  Primer
aaaggatcctatgcaactttagccctgtgtc

SEQ ID NO: 11138 - DNA, 31 bp, Artificial Sequence
  Primer
aaaggatcctcagctcaggtccttaggttgg

SEQ ID NO: 11139 - DNA, 31 bp, Artificial Sequence
  Primer
aaaggatcctcataccaaccctaatcggaat

SEQ ID NO: 11140 - DNA, 31 bp, Artificial Sequence
  Primer
aaaggatcctcatcagtcaatttccaaggtg

SEQ ID NO: 11141 - DNA, 31 bp, Artificial Sequence
  Primer
aaaggatcctcatctcacggttccatatcag

SEQ ID NO: 11142 - DNA, 31 bp, Artificial Sequence
  Primer
aaaggatcctccaccatgcaataaagaattg

SEQ ID NO: 11143 - DNA, 31 bp, Artificial Sequence
  Primer
aaaggatcctccacttccacctaacatttcc

SEQ ID NO: 11144 - DNA, 31 bp, Artificial Sequence
  Primer
aaaggatcctcccgttccaactcctacctac

SEQ ID NO: 11145 - DNA, 29 bp, Artificial Sequence
  Primer
aaaggatcctccttggtgcttcgtctctc

SEQ ID NO: 11146 - DNA, 31 bp, Artificial Sequence
  Primer
aaaggatcctcgttccatttccaacttcatc

SEQ ID NO: 11147 - DNA, 31 bp, Artificial Sequence
  Primer
aaaggatcctcgttctctaccaaagtccacc

SEQ ID NO: 11148 - DNA, 30 bp, Artificial Sequence
  Primer
aaaggatcctctcagcactccacgtcaatc

SEQ ID NO: 11149 - DNA, 31 bp, Artificial Sequence
  Primer
aaaggatcctgacacttactcccgtcgaaag

SEQ ID NO: 11150 - DNA, 30 bp, Artificial Sequence
  Primer
aaaggatcctgcagtacacagcacatttcc

SEQ ID NO: 11151 - DNA, 29 bp, Artificial Sequence
  Primer
aaaggatcctgccgtccagagagctagag

SEQ ID NO: 11152 - DNA, 28 bp, Artificial Sequence
  Primer
aaaggatcctgctcatgccactcatcac

SEQ ID NO: 11153 - DNA, 32 bp, Artificial Sequence
  Primer
aaaggatcctgtctccttgaggtattcaacct

SEQ ID NO: 11154 - DNA, 32 bp, Artificial Sequence
  Primer
aaaggatcctgttcttagtcatcgcacaagac

SEQ ID NO: 11155 - DNA, 30 bp, Artificial Sequence
  Primer
aaaggatccttccaaggtggttctgcatac

SEQ ID NO: 11156 - DNA, 31 bp, Artificial Sequence
  Primer
aaaggatccttctctcgactcctttggtttc

SEQ ID NO: 11157 - DNA, 30 bp, Artificial Sequence
  Primer
aaaggatccttggttgagatgatgcgtatg

SEQ ID NO: 11158 - DNA, 27 bp, Artificial Sequence
  Primer
aaaggatcctttccactgctctgcgtc

SEQ ID NO: 11159 - DNA, 31 bp, Artificial Sequence
  Primer
aaaggtaccaaactctgtaacacccaccacc

SEQ ID NO: 11160 - DNA, 31 bp, Artificial Sequence
  Primer
aaaggtaccaacctgggaaacagtagctgag

SEQ ID NO: 11161 - DNA, 31 bp, Artificial Sequence
  Primer
aaaggtaccaactcatttccaccatgacagg

SEQ ID NO: 11162 - DNA, 31 bp, Artificial Sequence
  Primer
aaaggtaccaataacaggtcatccacgatgc

SEQ ID NO: 11163 - DNA, 32 bp, Artificial Sequence
  Primer
aaaggtaccaatatccttcagatgcacaccag

SEQ ID NO: 11164 - DNA, 31 bp, Artificial Sequence
  Primer
aaaggtaccaatgaccagaaccgttgacatc

SEQ ID NO: 11165 - DNA, 31 bp, Artificial Sequence
  Primer
aaaggtaccaccctaaaggagcatacacacg

SEQ ID NO: 11166 - DNA, 31 bp, Artificial Sequence
  Primer
aaaggtaccactcgatttgctacctcgtgac

SEQ ID NO: 11167 - DNA, 31 bp, Artificial Sequence
  Primer
aaaggtaccactctcaaggatgaaggagctg

SEQ ID NO: 11168 - DNA, 31 bp, Artificial Sequence
  Primer
aaaggtaccagcaacaaacactccgttaagc

SEQ ID NO: 11169 - DNA, 31 bp, Artificial Sequence
  Primer
aaaggtaccagccagcatgaacgagaactac

SEQ ID NO: 11170 - DNA, 31 bp, Artificial Sequence
  Primer
aaaggtaccatgtgcaactcaacaaggactg

SEQ ID NO: 11171 - DNA, 31 bp, Artificial Sequence
  Primer
aaaggtaccattaccaatggttctcgctcac

SEQ ID NO: 11172 - DNA, 32 bp, Artificial Sequence
  Primer
aaaggtacccatgttcttcttccgctctactc

SEQ ID NO: 11173 - DNA, 32 bp, Artificial Sequence
  Primer
aaaggtacccccagtcccttacactaccaaac

SEQ ID NO: 11174 - DNA, 32 bp, Artificial Sequence
  Primer
aaaggtaccccgctctactcaatcttcatgtc

SEQ ID NO: 11175 - DNA, 30 bp, Artificial Sequence
  Primer
aaaggtacccgttgacatcaggcaaagaac

SEQ ID NO: 11176 - DNA, 34 bp, Artificial Sequence
  Primer
aaaggtaccctaacccgctgtcactttatcacac

SEQ ID NO: 11177 - DNA, 34 bp, Artificial Sequence
  Primer
aaaggtaccctaactaactgatggcaaggaatgg

SEQ ID NO: 11178 - DNA, 31 bp, Artificial Sequence
  Primer
aaaggtaccctacaacaaacatcccctgcct

SEQ ID NO: 11179 - DNA, 34 bp, Artificial Sequence
  Primer
aaaggtaccctactttgacagtttccgaatgatg

SEQ ID NO: 11180 - DNA, 34 bp, Artificial Sequence
  Primer
aaaggtaccctatgcgacaatgacttgcactaac

SEQ ID NO: 11181 - DNA, 33 bp, Artificial Sequence
  Primer
aaaggtaccctattcttggtacagaggcgacac

SEQ ID NO: 11182 - DNA, 32 bp, Artificial Sequence
  Primer
aaaggtaccgcaaccaggtgaagctatacaac

SEQ ID NO: 11183 - DNA, 33 bp, Artificial Sequence
  Primer
aaaggtaccgccaaatattgaatagcaacatcc

SEQ ID NO: 11184 - DNA, 31 bp, Artificial Sequence
  Primer
aaaggtaccgccgggtggatagttacttagg

SEQ ID NO: 11185 - DNA, 36 bp, Artificial Sequence
  Primer
aaaggtaccgctacagaattaatgtacactcttcgc

SEQ ID NO: 11186 - DNA, 31 bp, Artificial Sequence
  Primer
aaaggtaccgctgatcaatcaattcccaatc

SEQ ID NO: 11187 - DNA, 32 bp, Artificial Sequence
  Primer
aaaggtaccggatagagcaaagaagcaattcg

SEQ ID NO: 11188 - DNA, 31 bp, Artificial Sequence
  Primer
aaaggtaccggccttcttctctcctaaatgg

SEQ ID NO: 11189 - DNA, 31 bp, Artificial Sequence
  Primer
aaaggtaccgtaagggagtgatccagtcgag

SEQ ID NO: 11190 - DNA, 31 bp, Artificial Sequence
  Primer
aaaggtaccgtcccaatagacaggaggtgtg

SEQ ID NO: 11191 - DNA, 31 bp, Artificial Sequence
  Primer
aaaggtacctaaactaacgacatcgcgaaac

SEQ ID NO: 11192 - DNA, 30 bp, Artificial Sequence
  Primer
aaaggtacctagtttctgtttcgcgtcctg

SEQ ID NO: 11193 - DNA, 35 bp, Artificial Sequence
  Primer
aaaggtacctcagatctgataccgtcttcatctca

SEQ ID NO: 11194 - DNA, 31 bp, Artificial Sequence
  Primer
aaaggtacctcgcatgagtaagatcgacatc

SEQ ID NO: 11195 - DNA, 31 bp, Artificial Sequence
  Primer
aaaggtacctctattcctgcatgagcaactc

SEQ ID NO: 11196 - DNA, 31 bp, Artificial Sequence
  Primer
aaaggtacctctgtaacaatgcaagagcctg

SEQ ID NO: 11197 - DNA, 31 bp, Artificial Sequence
  Primer
aaaggtacctcttacaagtttcctgtgcctg

SEQ ID NO: 11198 - DNA, 31 bp, Artificial Sequence
  Primer
aaaggtacctgcattcagagttcattcgttg

SEQ ID NO: 11199 - DNA, 31 bp, Artificial Sequence
  Primer
aaaggtacctgtttgcattctctgtagcagg

SEQ ID NO: 11200 - DNA, 32 bp, Artificial Sequence
  Primer
aaaggtaccttacagtgacacctagagggagg

SEQ ID NO: 11201 - DNA, 31 bp, Artificial Sequence
  Primer
aaaggtaccttacgaaacatcggctaattcc

SEQ ID NO: 11202 - DNA, 31 bp, Artificial Sequence
  Primer
aaaggtaccttactttacagcggccaagaac

SEQ ID NO: 11203 - DNA, 33 bp, Artificial Sequence
  Primer
aaaggtaccttatgttctgaagtgatggtgtga

SEQ ID NO: 11204 - DNA, 31 bp, Artificial Sequence
  Primer
aaaggtaccttcaacatcgacagaactccag

SEQ ID NO: 11205 - DNA, 31 bp, Artificial Sequence
  Primer
aaaggtaccttgcacccatattgtaatggtc

SEQ ID NO: 11206 - DNA, 33 bp, Artificial Sequence
  Primer
tatcccgggacgagacgctgttcagattaaagg

SEQ ID NO: 11207 - DNA, 33 bp, Artificial Sequence
  Primer
tttaggccttcaaggaaacaagcttggagagga

SEQ ID NO: 11208 - DNA, 30 bp, Artificial Sequence
  Primer
tttaggccttcaccttccatgccaaactgc

SEQ ID NO: 11209 - DNA, 30 bp, Artificial Sequence
  Primer
tttaggccttcaggggatctgattctctgg

SEQ ID NO: 11210 - DNA, 41 bp, Artificial Sequence
  Primer
tttaggccttctcataatcagaatacagttatacacaatgc

SEQ ID NO: 11211 - DNA, 30 bp, Artificial Sequence
  Primer
tttgaattcgcagcttgtttctggagactg

SEQ ID NO: 11212 - DNA, 33 bp, Artificial Sequence
  Primer
tttgaattctcaaaacaagtcctgcagatgcac

SEQ ID NO: 11213 - DNA, 34 bp, Artificial Sequence
  Primer
tttgaattctcacccttctgatacagcttccaag

SEQ ID NO: 11214 - DNA, 36 bp, Artificial Sequence
  Primer
tttgaattctcacctacacaatctgctctagcaacc

SEQ ID NO: 11215 - DNA, 33 bp, Artificial Sequence
  Primer
tttgaattctcatcggcagcttatatatgtggc

SEQ ID NO: 11216 - DNA, 36 bp, Artificial Sequence
  Primer
tttgaattcttatgacatatatgcagatggtagcgt

SEQ ID NO: 11217 - DNA, 31 bp, Artificial Sequence
  Primer
aaaaggcctaagggtgctgattggttagatg

SEQ ID NO: 11218 - DNA, 35 bp, Artificial Sequence
  Primer
aaaaggcctgcagtttcaaatgcaatgatatttag

SEQ ID NO: 11219 - DNA, 34 bp, Artificial Sequence
  Primer
aaaaggccttgaactcaacatggactatcatacg

SEQ ID NO: 11220 - DNA, 31 bp, Artificial Sequence
  Primer
aaaaggcctttgagatttcaagaaaccgagc

SEQ ID NO: 11221 - DNA, 31 bp, Artificial Sequence
  Primer
aaactcgagaacctccttcactgaccatcac

SEQ ID NO: 11222 - DNA, 31 bp, Artificial Sequence
  Primer
aaactcgagaagaccaatgagagcaacacag

SEQ ID NO: 11223 - DNA, 31 bp, Artificial Sequence
  Primer
aaactcgagaatccgcatacataccatgacc

SEQ ID NO: 11224 - DNA, 31 bp, Artificial Sequence
  Primer
aaactcgagagctgcttgcatggtagctaag

SEQ ID NO: 11225 - DNA, 31 bp, Artificial Sequence
  Primer
aaactcgagaggaaggcagttccaggtaaac

SEQ ID NO: 11226 - DNA, 31 bp, Artificial Sequence
  Primer
aaactcgagataaacatgtggaaatgggtgc

SEQ ID NO: 11227 - DNA, 36 bp, Artificial Sequence
  Primer
aaactcgagcacataacagcataccaccataataac

SEQ ID NO: 11228 - DNA, 31 bp, Artificial Sequence
  Primer
aaactcgagcattacagcaactgcatacacg

SEQ ID NO: 11229 - DNA, 31 bp, Artificial Sequence
  Primer
aaactcgagcattgaacattggtttcattcg

SEQ ID NO: 11230 - DNA, 31 bp, Artificial Sequence
  Primer
aaactcgagccatgtcttgattcacacatcc

SEQ ID NO: 11231 - DNA, 31 bp, Artificial Sequence
  Primer
aaactcgagcccaaacatctccagtttgttc

SEQ ID NO: 11232 - DNA, 33 bp, Artificial Sequence
  Primer
aaactcgagctacacgaaccaccagaaagattg

SEQ ID NO: 11233 - DNA, 34 bp, Artificial Sequence
  Primer
aaactcgagctagtatgaggtgaccactgaatcg

SEQ ID NO: 11234 - DNA, 30 bp, Artificial Sequence
  Primer
aaactcgagctcatcagcatgattcaagcg

SEQ ID NO: 11235 - DNA, 29 bp, Artificial Sequence
  Primer
aaactcgagctgccatttcatcgaacaag

SEQ ID NO: 11236 - DNA, 30 bp, Artificial Sequence
  Primer
aaactcgagctttcaggtgcaaacaacacg

SEQ ID NO: 11237 - DNA, 31 bp, Artificial Sequence
  Primer
aaactcgaggatacttccttccagcccaaac

SEQ ID NO: 11238 - DNA, 31 bp, Artificial Sequence
  Primer
aaactcgaggattctaccagtctcacggcac

SEQ ID NO: 11239 - DNA, 34 bp, Artificial Sequence
  Primer
aaactcgagggaatattattggctcttgaggatg

SEQ ID NO: 11240 - DNA, 28 bp, Artificial Sequence
  Primer
aaactcgagggctccatcttcttcgacc

SEQ ID NO: 11241 - DNA, 31 bp, Artificial Sequence
  Primer
aaactcgagtacgcagtgaagccaaacatag

SEQ ID NO: 11242 - DNA, 32 bp, Artificial Sequence
  Primer
aaactcgagtcagttagctagctggtgatcca

SEQ ID NO: 11243 - DNA, 33 bp, Artificial Sequence
  Primer
aaactcgagtcttgaggatgaacaatggatatg

SEQ ID NO: 11244 - DNA, 31 bp, Artificial Sequence
  Primer
aaactcgagttaagcaattaagcaggcgctc

SEQ ID NO: 11245 - DNA, 31 bp, Artificial Sequence
  Primer
aaactcgagttggtccaatgtttctttcagg

SEQ ID NO: 11246 - DNA, 31 bp, Artificial Sequence
  Primer
aaagaattcaagtatggcagacgaagcagag

SEQ ID NO: 11247 - DNA, 27 bp, Artificial Sequence
  Primer
aaagaattcagcgggacaacagacaca

SEQ ID NO: 11248 - DNA, 31 bp, Artificial Sequence
  Primer
aaagaattcaggctctgctagctccctattc

SEQ ID NO: 11249 - DNA, 31 bp, Artificial Sequence
  Primer
aaagaattcatcgacatctcaaatttgctgc

SEQ ID NO: 11250 - DNA, 31 bp, Artificial Sequence
  Primer
aaagaattccaaggaacggaggcatacatag

SEQ ID NO: 11251 - DNA, 31 bp, Artificial Sequence
  Primer
aaagaattccatgcaaactccaacatcagac

SEQ ID NO: 11252 - DNA, 34 bp, Artificial Sequence
  Primer
aaagaattcctaaacaagccacacattcactctg

SEQ ID NO: 11253 - DNA, 33 bp, Artificial Sequence
  Primer
aaagaattcctaccacacattcactctgtcacc

SEQ ID NO: 11254 - DNA, 29 bp, Artificial Sequence
  Primer
aaagaattcctcctcccgatccaagaaac

SEQ ID NO: 11255 - DNA, 31 bp, Artificial Sequence
  Primer
aaagaattcgaacatggacaccaattcacag

SEQ ID NO: 11256 - DNA, 31 bp, Artificial Sequence
  Primer
aaagaattcgccgatcttgtgttctagtgag

SEQ ID NO: 11257 - DNA, 31 bp, Artificial Sequence
  Primer
aaagaattctaacacttacgtgtgtccctcc

SEQ ID NO: 11258 - DNA, 29 bp, Artificial Sequence
  Primer
aaagaattctactttggcacaagagcacc

SEQ ID NO: 11259 - DNA, 32 bp, Artificial Sequence
  Primer
aaagaattctcaggtagttgacacaggaaacc

SEQ ID NO: 11260 - DNA, 30 bp, Artificial Sequence
  Primer
aaagaattctcccacagctgactgtctttg

SEQ ID NO: 11261 - DNA, 32 bp, Artificial Sequence
  Primer
aaagaattctctcgatccatttgactaagtgc

SEQ ID NO: 11262 - DNA, 28 bp, Artificial Sequence
  Primer
aaagaattctcttccctcctcccaaatc

SEQ ID NO: 11263 - DNA, 28 bp, Artificial Sequence
  Primer
aaagaattcttccctcctcccaaatctc

SEQ ID NO: 11264 - DNA, 31 bp, Artificial Sequence
  Primer
aaagatatcagtgaacaccagccgtattgtc

SEQ ID NO: 11265 - DNA, 27 bp, Artificial Sequence
  Primer
aaagatatcccatcgcttcgccggtat

SEQ ID NO: 11266 - DNA, 30 bp, Artificial Sequence
  Primer
aaaggatccaatcagaactcggcatcacac

SEQ ID NO: 11267 - DNA, 31 bp, Artificial Sequence
  Primer
aaaggatccaatgtcatgggtactgggtagg

SEQ ID NO: 11268 - DNA, 30 bp, Artificial Sequence
  Primer
aaaggatccacacgaaacctaccttcctcc

SEQ ID NO: 11269 - DNA, 30 bp, Artificial Sequence
  Primer
aaaggatccacagaagcatttgtttgcgag

SEQ ID NO: 11270 - DNA, 27 bp, Artificial Sequence
  Primer
aaaggatccacagggacagcgttccag

SEQ ID NO: 11271 - DNA, 30 bp, Artificial Sequence
  Primer
aaaggatccagggtagtttgcactttgcag

SEQ ID NO: 11272 - DNA, 29 bp, Artificial Sequence
  Primer
aaaggatccatcgccttcacggttagttg

SEQ ID NO: 11273 - DNA, 31 bp, Artificial Sequence
  Primer
aaaggatccattcgacagggagaggaaagag

SEQ ID NO: 11274 - DNA, 30 bp, Artificial Sequence
  Primer
aaaggatcccactcatcggagaggaggaag

SEQ ID NO: 11275 - DNA, 29 bp, Artificial Sequence
  Primer
aaaggatcccaggcactcaccaaggaaac

SEQ ID NO: 11276 - DNA, 32 bp, Artificial Sequence
  Primer
aaaggatcccatccttccgatcttacatttgc

SEQ ID NO: 11277 - DNA, 29 bp, Artificial Sequence
  Primer
aaaggatcccatcggagaggaggaagctc

SEQ ID NO: 11278 - DNA, 27 bp, Artificial Sequence
  Primer
aaaggatccccagcgcgagagaagaag

SEQ ID NO: 11279 - DNA, 31 bp, Artificial Sequence
  Primer
aaaggatcccccactactgctactgcgagac

SEQ ID NO: 11280 - DNA, 29 bp, Artificial Sequence
  Primer
aaaggatcccccctctcgcctatttaagg

SEQ ID NO: 11281 - DNA, 28 bp, Artificial Sequence
  Primer
aaaggatcccctccttgcctgttccatc

SEQ ID NO: 11282 - DNA, 31 bp, Artificial Sequence
  Primer
aaaggatcccgagcagagagaatccaagaac

SEQ ID NO: 11283 - DNA, 31 bp, Artificial Sequence
  Primer
aaaggatcccgagctcaccacagcatattac

SEQ ID NO: 11284 - DNA, 31 bp, Artificial Sequence
  Primer
aaaggatccctactagcagtagtgggcggtg

SEQ ID NO: 11285 - DNA, 33 bp, Artificial Sequence
  Primer
aaaggatccctagaactttggaacatgccgaac

SEQ ID NO: 11286 - DNA, 33 bp, Artificial Sequence
  Primer
aaaggatcccttacatttgctctggaaatcagg

SEQ ID NO: 11287 - DNA, 29 bp, Artificial Sequence
  Primer
aaaggatccgaacctcgtgctctgacctc

SEQ ID NO: 11288 - DNA, 29 bp, Artificial Sequence
  Primer
aaaggatccgaagaagcatcgccagattg

SEQ ID NO: 11289 - DNA, 30 bp, Artificial Sequence
  Primer
aaaggatccgcagcctttgaacctctgaac

SEQ ID NO: 11290 - DNA, 31 bp, Artificial Sequence
  Primer
aaaggatccgccactgctcgtagtcgtagtc

SEQ ID NO: 11291 - DNA, 28 bp, Artificial Sequence
  Primer
aaaggatccgcccactcaactcaagctc

SEQ ID NO: 11292 - DNA, 28 bp, Artificial Sequence
  Primer
aaaggatccgctcgagcttcacttcagc

SEQ ID NO: 11293 - DNA, 24 bp, Artificial Sequence
  Primer
aaaggatccggcccccatggcatc

SEQ ID NO: 11294 - DNA, 26 bp, Artificial Sequence
  Primer
aaaggatccggcgatggcgaagaatc

SEQ ID NO: 11295 - DNA, 32 bp, Artificial Sequence
  Primer
aaaggatccggcttcctacaacttcaaaatgg

SEQ ID NO: 11296 - DNA, 31 bp, Artificial Sequence
  Primer
aaaggatccgggtttgcgtgataaatctgac

SEQ ID NO: 11297 - DNA, 31 bp, Artificial Sequence
  Primer
aaaggatccgtgtgtgtgttataagcgcgag

SEQ ID NO: 11298 - DNA, 30 bp, Artificial Sequence
  Primer
aaaggatccgttcagcagccaacaagactc

SEQ ID NO: 11299 - DNA, 32 bp, Artificial Sequence
  Primer
aaaggatcctagcgtaggctgtactggttctc

SEQ ID NO: 11300 - DNA, 31 bp, Artificial Sequence
  Primer
aaaggatcctatgtacaggtgcggagagttg

SEQ ID NO: 11301 - DNA, 27 bp, Artificial Sequence
  Primer
aaaggatcctatttaaggccgccccag

SEQ ID NO: 11302 - DNA, 31 bp, Artificial Sequence
  Primer
aaaggatcctccgagttaaccaaacagaagc

SEQ ID NO: 11303 - DNA, 31 bp, Artificial Sequence
  Primer
aaaggatcctcttgttaaccaggtcctcacc

SEQ ID NO: 11304 - DNA, 31 bp, Artificial Sequence
  Primer
aaaggatcctgccctttctatctctctcgtc

SEQ ID NO: 11305 - DNA, 32 bp, Artificial Sequence
  Primer
aaaggatcctgtctttcaacttctgagcttcg

SEQ ID NO: 11306 - DNA, 32 bp, Artificial Sequence
  Primer
aaaggatccttagtggtcgtagggtagtttgc

SEQ ID NO: 11307 - DNA, 31 bp, Artificial Sequence
  Primer
aaaggtaccaactatggcaccactacgatcc

SEQ ID NO: 11308 - DNA, 31 bp, Artificial Sequence
  Primer
aaaggtaccataaagacatggatcggaatcg

SEQ ID NO: 11309 - DNA, 26 bp, Artificial Sequence
  Primer
aaaggtacccgaagcatgccgagaac

SEQ ID NO: 11310 - DNA, 31 bp, Artificial Sequence
  Primer
aaaggtaccgcaatcactttggaaatggaac

SEQ ID NO: 11311 - DNA, 31 bp, Artificial Sequence
  Primer
aaaggtaccgcgacaggagaaagaatgctac

SEQ ID NO: 11312 - DNA, 31 bp, Artificial Sequence
  Primer
aaaggtacctacaatggccaccaaagaagtc

SEQ ID NO: 11313 - DNA, 34 bp, Artificial Sequence
  Primer
aaaggtacctctttattgctacacacaccaacac

SEQ ID NO: 11314 - DNA, 31 bp, Artificial Sequence
  Primer
aaaggtacctgaatttccaccagtagcagtg

SEQ ID NO: 11315 - DNA, 31 bp, Artificial Sequence
  Primer
aaaggtacctgcgcatttcagtacagttagg

SEQ ID NO: 11316 - DNA, 32 bp, Artificial Sequence
  Primer
aaagtcgacaacaccagcagatctaccacaac

SEQ ID NO: 11317 - DNA, 29 bp, Artificial Sequence
  Primer
aaagtcgacacaaaccctagccctcaacc

SEQ ID NO: 11318 - DNA, 26 bp, Artificial Sequence
  Primer
aaagtcgacacgagcgggaggagatg

SEQ ID NO: 11319 - DNA, 31 bp, Artificial Sequence
  Primer
aaagtcgacatctcacaagttcagctcctgc

SEQ ID NO: 11320 - DNA, 28 bp, Artificial Sequence
  Primer
aaagtcgaccagatgggaatccgattcc

SEQ ID NO: 11321 - DNA, 36 bp, Artificial Sequence
  Primer
aaagtcgactcaattacgattattccagataagcac

SEQ ID NO: 11322 - DNA, 33 bp, Artificial Sequence
  Primer
aaagtcgacttacgattattccagataagcacg

SEQ ID NO: 11323 - DNA, 26 bp, Artificial Sequence
  Primer
acaggatccacgcggacggcaataat

SEQ ID NO: 11324 - DNA, 30 bp, Artificial Sequence
  Primer
gatctcgagttaataacgtcagccgccact

SEQ ID NO: 11325 - DNA, 31 bp, Artificial Sequence
  Primer
taactcgagtgcgtacagctaagctaccagg

SEQ ID NO: 11326 - DNA, 36 bp, Artificial Sequence
  Primer
tatggtacctcatctcttttttcaaacgtctgatgc

SEQ ID NO: 11327 - DNA, 33 bp, Artificial Sequence
  Primer
tttaggccttcaacatttacgccggcgagtcac

SEQ ID NO: 11328 - DNA, 32 bp, Artificial Sequence
  Primer
tttctcgagtcacggatataccgaaccgaagg

SEQ ID NO: 11329 - DNA, 31 bp, Artificial Sequence
  Primer
tttctcgagttaaacatcgcaggccagtgtg

SEQ ID NO: 11330 - DNA, 36 bp, Artificial Sequence
  Primer
tttgaattctcacatcaaccaattgatgaatcaaac

SEQ ID NO: 11331 - DNA, 29 bp, Artificial Sequence
  Primer
tttggtaccccacagcaagacaatggaac

SEQ ID NO: 11332 - DNA, 38 bp, Artificial Sequence
  Primer
tttggtacccttgttacatgagaaacactaataacagg

SEQ ID NO: 11333 - DNA, 29 bp, Artificial Sequence
  Primer
tttggtaccgtccctacatgtcagccacc

SEQ ID NO: 11334 - DNA, 35 bp, Artificial Sequence
  Primer
tttggtaccttatcaaacgtctgatgctaagaagg

SEQ ID NO: 11335 - DNA, 562 bp, BAR_GA
agcagccatgagcccagagaggcgcccagccgatatcagaagggctacagaggccgatatgccggccgtgtgcaccatcgtgaaccactacatcgagacatccaccgtgaacttcaggaccgagccgcaagagccacaagagtggaccgatgatctcgtgaggctccgcgagagatacccatggctcgtggctgaagtggatggcgaggttgccggcattgcttatgctggcccatggaaggctaggaacgcctacgattggaccgccgagtccacagtgtacgtgtccccaaggcatcagagaaccggcctcggctctaccctctacacccatctgctcaagtcccttgaggcccaaggcttcaagtctgtggtggctgttatcggcctcccgaacgatccatccgtgaggatgcatgaggctctcggctatgccccaaggggaatgctcagagctgctggcttcaagcacggcaactggcacgatgtgggcttttggcagctcgacttcagcctcccagttccgccaagaccagtgctcccagtgaccgagatctgatga
